United States Patent 9,567,581 (SELECTIVE REACTIVATION OF GENES ON THE INACTIVE X CHROMOSOME) - sequence listing, part 34

SEQ ID NO: 4081 - DNA, 37001 bp, human
agctagctcagggacttcccagggcccccaccaggctccctgtctgtcctgcaggccagagccatgcacctcacctgaggccatgggaccctctggacacagacgacgctgcttggtcccagcctccccagagcaacacgtggaggtggataaggtgagagtgggtgtgtggcaggtgagggacatctgtcctgggggatctctgcctccccttggaagccaaactcctccctcctcgaggttccagtcgttgccctccctggccttagctcaagggaacctgccgccagacacacaggcccaaggcagagcctgtggagggcaggaaggcaaagatgtgagggcgggtggggatggagagggacggctacggaggcagggatgagagggacagaagacacctggcttgcacgttgggattcatgttcagcttcagagcagggagtggcagggctgagttaaggctgtttacctggtagaggcaagggactccagggcagattcaaggctggcatttgtagctgggctaggtaacaggcggtgccatggcaggcgcttggcacgccagggaggatgaaagggacagatggcagggaggcaggagggggtggctggttggggattggggtggggcagcagcggctctcgaaggagcagagcgaaggctcaagatgtggccctggcaagcgcacaacctgggggaccctgctccgtgctctgtaccatgggccctgtgaacactgtcgggctgaacgtggaagcccgcgggacagttgctaagcccaaggaggagagagcccaagaacatgcgggtgtcccaggtgtggccaagcccccaggcccagggagcccagggagggtccggtagacacggaggagcaggagcgggagccagggacagggcagccaggagacgccatgggaggacattgactggggagtccccgcacgctggcggtccctgaggccatgggcagggggctgtgatctctgccagggaaagagtgggggcgagaagaggggggtccccacttccgggctaaaccaaggaattgctgtcctcagaggagactgtgacagagacaccaacagggacaggagggatgccaggtgcaaagtgggggagagtgacctggaggctgagggactggggatgttggctgagggcttgctttgggagtgggaggaactcaggtgggtcttgggcagggtcagtcgggggaactcactggtcactctccctttctttcccctccgctaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaaaatgagctccaatttttattagggagagaatgaggagggagggattagaaaggcggagacaggaaggtcccctggccccagcctggtccttccttttcaggcccctgggaccgctgtctcacctgggggcacctgctccctctttcctgccactcctcaggcctctgctgcagcccctcctacacccagctcagtgagctgacctgaggggcccccacagtcctggggcctgaagctctcctcatacagctggggatgtggagacccaggcaggggctgtggcttgtccagggccacacagtgtcccagcctcggggccacaggctctggccaattctccacgggtccccctcccagtggctcccaggaccagccccaggaaggcagctgagcttctcaaagcctctagaggcaagacacccaacagctcctcacgatgaagtgtccttggccagggaggagctggcggtggtgcaggactcatcttggggacccaggctgggtggggtgcgtccccgggcacagcagagcaagcttcgcagctctgaggacacgctgctgctgaaagatgcatagatccaggggttggtgcagctgttgaggctggccagcaacatgagtagcacaaagggcgcccctgtggaggtggaggatctaggttgggttcaggatggctggtggggcacaggggcatgcggccaagcccaagtggccccgtcagccctagccacggctacacccaccttccagaggtgcctccgggtcccacgcggcccacagctgcaccaggaagaagggtgcccagcacagcacatagacgaccacaatcactagcgtcatcctcacagtcttggccacagctgctgacacgtgggctccctcaccggggctgcctgtccggcgtcccctgcggcgccccccaggcctctctgatggccctggcaccagactggcatgaatctcccggaagatgagcacctggcaggcggcgatacccagggtaggtgccacgaacaccatcagggcaatccaggtgacataggtgcgacggccccagggctccgcaaagcaggcccagcagtcagtgaccccgctgccaccttccacgttgcgctgggcgaagatgaagagctggggcaggctgagaaggagcgagaaggcccaagccactagcaccggccggttccagtgagccccacttccatggcggtacgccagcatgggacggcagatggcacggtggcggtccagcgtcatggccaggatcatgtaggaggaggcatacatgcccaccatctgcagatacttcacggcccgacacagggcatctggcccacggaagcggtcggtggccttccaggccagctggggcagcacttggaacagagccacggccaggtcggccaggcacaagtggccaatgaagacgtgtatgggtgcccagtggccccgccggccccgccgagctagggccgccagcaccaggccattgctcagggccacagccacaaagactatggagagcagcgccagctccgcccgggctagcagcgggtcccgggtgtccagtggcctctcctggctgctgttgctgggcaggctgggcagagagggatgcccaggcacagctgggaaggagtcgggaagagggcctggttagagagggtgctgtgcagggggactcaggcctgcctcccgtgcccccatccggacacccacttcctggctcctagcagaggggactccaggaaagccatgttatgagggatacacaccccaggctcatgcagtccagaaggaagggcagccccagccccagccccagccccagccctggcggggaagtggggctgtgctcccctccccactcattggcagcctggagagacacacccagaggtgagggtgaaggaggtctttagaaagaggggcttccctgaatcgtcaaacccactctgcccaccggactcatggaggggcaagccttaccggaagtggtggacgccatgagcatggtggggctggggcaggtgttctgagggcctggaggtgatgtgcggactcagcctctgcctgaggagcaagttcaatggcccagggtctctggactggagcccttatagagatgccagcatggcagatgcctgttggcgtgtgtgcacgtgtcggtggcagtatggccagtcctgggcagggaagattgagagggatggtcagacagacggatgcacagaacccaggatcccccaggcagcccatgagtcccgggtttgggagtgggcaccccagacagacacgcagaactcccctgccccaaccgaggccgagagaggccaccatccgagggctggggactgggcaggggggcaggcaggcgcagccccttacctggctgggctcctgggcagctgggcggtggcgtgaaggtggctgggtgctcagatctgctctccatcggctgccctgccctggcccagcccagcctctgggagtgacctggccaggaggggacttcctccccctccccctttcccccaggcctcccctggcctcctgtttcccttcctttccccagggcctccctggtcccggcccaggactccctcctcccactgccatagcctccacgcccaccctcaccctaccacgcccccctggttggattgtctgggttggcagtgctctgggaggtcacttagttcagcattcccattttataagtggggaaactgaggccagagagcggtgggtctggcccaggactgcgctgctttttcatgggagcttcacgcccccttcccaagttggggtcctcctgctcctcgctgggcccaggcaaggaaggggtgaaaacactttcgctgggcccctcccaggcccacgcaggcccctcctcctccccagttagggcccagttggccggagacgagggacaggaaagggaggagtggggcaggggccaagccaggcttcacgaacccctgtgagatccagggacacccccaccctcttcctcctgccccacctgcaactacctgtcctaggaagaggggctggggacctccgtgtgctcacgggctccctcccaccacacacaacctcacatgatacagccacacagccacaaacacacaacacagagacgctcgctcatgttcttgaacataccatgagtatggacgcaccttccctgtacctgagccctcctcctccctcccccaacacctctctccttcccctgtccccacaccccctccagcccccatcccagtagttctctttccactccccccgcacccaggcctggcttggctcagccgaggccagcccagcccagcccagcccaaggcagctgctttcttcctgtttgtctgtcttctctgttgcctgtgaagccagagaccaaaacagcctcacggaccaggcccaagtccggcccgcggccaaggcctcctcttcctgcccagagagcctggcagcaccctggcccctcccggccctgttagggtggtgggaacacagggtgggcattttccagagacagcgcacacaccacaccacatacatacatgcacacagccacacgccacacacacatgcacccaccacacacccatacgccacaccacacacacaccacaccatgcacacatatattacacaccacacacatgcacacatcacacactcccatacgccacacacccacacatgtacccaccacacagccatacacaccacatacgcacagccaacaccacacacgcacacacccgcagcacacacaggtgcacatcacaccccgcatctttgccatgtttttgcagagccccttgggggcaggctgcagagtgctggcaccccaggcctgacgcttcagctgcatctcctcagcgcatgcacatcctcatgctgtccccaataaccgcatgctgtcactaatctaggagcatagaaaaggccttcctaatgccacccagatcagtggaataggagatggcttccctcaactggcagagaatttggggaccctggctggggaataggaaagcaaggctccagcccctgcttggcccctgcccagtagtgtgaccttgaacaggccacgccagctcttggcacctcagcttccccttctgtgcaatgggacttgatgattgagggagactacggtggtaagatgggcaggggtggggactggcagggccttgggaaagcctttgttccctccgtctaaagccggctagggcgaggaatccatgctaaccttttggggtgagcagacaaccatctccttatcagtttctctgcctgaacgaggctgtgcagtgccggatctcagcagcaggttgggacctcccctagcaatgtggccaggcccgtggcaatctctgcccccctggactcctcgcttcctgttgttaaactagggaagaatctggaggaagggcccgcatggcggtctcctctgggatgcaagaagccagatcaggatccagtgccattctgctcagccaggaccccggggaggaactgggagccacatgggcaggcactacatggaactgtgccaggagagaggccctgggcagccacccctcgggggccaagaaagatggggctgggcagcagctcccatgggaagaagggcagactgtgctgattcacgctaggcccacatgagtcactcaagcccctgcccttgggcgttaacgggcagggcatctacctgggggtgtgccaggcccccactcctgccagcgcagcccctgtgtgcacacctcccactggtccctctaagacttgcagaaagggctctgtgagtgccaaggtgtggctcctgatcttccagcctagtgtctgggcagaagaggacaggaggcagattggggggacactgtttgtccctctctatctaccggttccccatgatcagaaccttccattcaccaaactgcaagtgccgctggcctagcactgtggctgcagagatggaaggacctgggctctgccccaggagcacatgggcttctgcagagaagagtggaggcagggaggctggtggaagctgtgcctgtcacccaggagagaaatggtgcgacccacttaacactgggcagcggggctagagggagcaggcaggtggaaaaggcatttaaagggccctgaaggatttgtaaggggtggaagacaaagaggaggcagccaaggacgaggagaaagaggcccccgattgtgtgggaggggtgcatgtgcagatggtggagcctgtgggcagtgggaaggacggagccaagtgcctgtcaacaggaacggccctcacagggactgtgacccgaaggagaatacctagagcccaggagatagggaggaacaacgggttggaggatgggattgaaggggacaaaaacaaatttaataaaaactcaagtgtacttgtgtgaatgtgagggtgtgtgtgagggtgtgcgtgtgtgagggtgtgagagtgtgtgagggtgtgtgtgagagtgtgcgtatgtgagggtgggcgtgtgtgtggggtgtgtgtggtgtgtggtgtgtgagggtgtgcatgtgagggtgtgtggtgtgtgtgtggcgtgggtggttgtgtgtgagggtgtgtggtgtgtgtgtgtgtggcgttgggggggttgtgtgtgagggtgtgcgcgtgtgtgagggtgtgtgcgtgtgtgagggtgtgtgcgtgtgtgagggtgtgtgcgtgtgccaatgatgacaggaagacagcctgcggatgatcatctaattgtgtccattcacctaagtgaataataactgggaaagctggacagagcctgtttatagctgcggaaaggcagcccatggaactggatagattaagagcctcgcggagtggaagggagggccagggtctccagcaggtgctggggtgaggggcggggggtagaaggagggtgagcgttgagggcttgagggccgtacccatagatggcctccaggtcatcatgtgagagtcaggcaggaggcggctccctggcaaaactgcagagattttttttttttttcttttttaaaggcagtggcccctcccgctttcctccccagaggcggccgactgcagttgctgttagtgggctgtttgggtaactgcctcggggtttcccagtctgacttcctcttgctctctctgcctgcacgttcctcccccagattattgcagcagctgctccgggtgtcttcagtgctcatgcactcaccaccctggaatggccctccgcaggcaatgatttctctcctccagaatgacttttttttttttcggctttattgaggtatgattagcatacagtaaaattcattaattgtaattgtactgttcagtaagatttgacaaatgtatacagtcgtgtaaccacaaccacaatcatgacatagaataaatattttcgacattccagaaagttccctcgtggccttttgcagtcaagcttcttcccctacctgaaagcctagcaaccactgatctatcactatagattttccttttctagaattttatataaatagaatcatagagtatgtagtattttcaaaaattagccgggcgtggtggcgcaagcctgtaatcccagctactcagaggctgaggctggagaatcgcttgaacccgggaggcggaggtttcagtgagccgagatcttgccattgcactccagcctgggtgacacagcaagactccgtctcaaaaaaaaataataataaaaataaataaataaataaaagagtacatagtattttgtgtaacttcttttttttttttatattttttttggtggggaggaggcatagtctctcactctgtcacccggtatactgaaagcttttatcacaagtgagtattgaatttttttcttttttttctttttttttttgagtcggagtttcactcttgttgcccaggctgcagtgcaatggcgagatcttggctcactgcaaccttcgcctcccaggttcaagagattctcttgcctcagcctcccaagtagctgggattacaggcaagcgccaccatgcccagctaattttgtacttttagtagagacggggtttcttcatgttggtcaggctggtctcgaattcccgacctcaggtgatccacctgcctcggcctcccaaagtgctgggattacaggcatgagccaccacacccggccaatttttgtgtttttagtagagacagggtttcatcatgttaaccaggatggtctcgatctcttgacctctgatccacccaccttggcctcccaaagtgctgggatgacaggtgtgagccactgtgcctggctgttgtttaccatttttacatctgtattaatgagagatgctggtctacgttttccctttctgtaatatctttggtttggggatgagtataatgctgactttataaaacgagttgggaagtgttctctctttttctgttttctggaagagttagtatagaattggtattatttacacaaacctggagttttctttgtgagaattttttcagttataaattcaactcttctgacagatacagggctaatcaggttatctattttttcctaaatgagcgttgaccatttgtatctttcaaggaatttgtccatttcatctaagttgttggatgtattggaataagtttttcacaacatcctcttatcacttttttatgtttgtaggatctgtaataatgccccctctctcttattctccatattggtaatttgtatcttctctccattttttttttctgatcagtctggctagaggcttatcaatttcattgatctttttgttttgttttgttttgaaacgaagttttgctcttgttgcccaggctggagtgcagtggtgtgatcttggctcactgcaacttctgcctcccagattcaagcaattcttctgcctcagcctcctgagtagctgggattacaggtgcacaccaccacgcccagctaatttttgtattttttagtagagatggggtttcaccatgttggtcaggatcatctcgatctcttgacctcatgatctgcctgcctcggcctcccaaagtgctgggattacaggtgtgagccaccgtgaccggctctagtttcttaaagtagaaatttaaataattattttgggacctttctgcttttctaatataagtagttccttttcctctaatcagttgttttgttgaattcccaaattttcatattttatttgcatttctattcagtgaaagatatgttctaccaataattttacttgtggtttcttctttggttcttgggttatttggaagtagatattttttcatttcaaaatatttagaaaattcctagatgtctttttgttgttgatttctaattcaacatcattttggtcagaaatcgtactttgtatgattttgaccctttgtaatttattgaggcttgctcgattgcccagaagttgtctgtgttggttggggttccatctgcacttgagaagaatatgtgttctgctgttgttggatgtagtgttccgtacatatcaattgagtcaattaggttgatagtgttgttcaaatctatattcttctgatttttttcctatttgttttatcatttactgagaaaggaatgttaaagttggccagtatgtttggagatttatctgtatctagaaccctttagtcctataaattttgtttcatatatttggtagattaggtgcttatatatttgaaatggttgtgttttcttgattatgtgttcttttttcattatgacatgtctctcttgatctctagtaaactctttgtcttgaattctgctctacctgatattagtatgatgccatggcagctttcttatgctcagtggttgcttggtatatctttttccatacttctactctcaacatgtctgtgtctttatgcttcaaatgtgcttcttgtaaataacatatagctattttatctagcccaacagtctctgccttttaactggtgtgtgtggcagattgtgtttttcaaaggtagccccaacaatatctcccatcccacatgctctcctggaaccttgccacttccccatcaagaggtggaatttaaccctcccccctataatctgggcaggcttgtgactttcttgtactcaagataatatggtaaaagtggtgctgattgatttctgaggctagtgcagaaaaggtaatgcagcttctgccttgttaacagggacactcactcttcaagcctttagccaccatgtaagcattccaacttccctgatgctataaggaagcccaattcagccatcatggaaggaccacagaaaatggctctgaggccaggcacagtaactcacacgtgtaatcccaacactttgggaggctgaggtgggtggatcaagaggtcaggagatagagaccagcctgaccaacatggtgaaaccctgtctctactgaaaaacacaaaaattagctgggtgtgctggcgtgcgcctgtaatcccagctactcgggaggctgaggcaggagaatggcttgaacccgggaggcggaggttgcagtgagctgagaccccgccactgcactccagcctgggcaacaaagtgagacaccttctcaaaaaaaaaaaaaaaaaaaaggctctgaggcaatatgaagagggccaccatctgacagccaccacatgaaagacctgggccaggactgcccaggtgagcccttcccaaattcctttttttttttttttttaaggcagggtctcactctgtcagccaggctggagtgcagtggcatgatcacggctcactgcagcctcgacctcccgggctcaagggatcctcccatctcagcctcctgagtagctgggactatagacatgtaccaccatacccagctaattgttgtatttttatagagacagggtctttccatgttgcccaggctgttctcaaactcctgggctcaagcaatcctcccacttcagcctcccaaagtactgggattacaggtgtgagccaccacacctggcctatttctattttaagaagtaaataatcatatatatttatccctcctggggtaaatatatgtaatagaacagtggggaagatacacataaaattatgccccaaaaagggcatgacccttcttgtcaggccattagtgtgtgcatgcgtgtgtgtgtattagaggctggtgtgtagttaagtggagtctggggtttcttgttgctttgcgtagactcagttttctgtatacttcgaatgatttcagagcaggatcagaacattctctttggtgggacttgtgatctgagtggctgggagtttctttgattctcctgcctcacccgtagacttcagcagatccctgagcgcacattcccgggtgcctattgtaggtcttttgcctccactccaaccacagttcgcttctggtttgtactcagtgtaaggattagaatcaaccggaaggtttgtttcagttcttctgtcctgccttaagacttcctagagcctggggatgaactcttcagtcctcctgccctgcttcattcaccagttacagctgctctgtactcagtggaaggtcaggagccccaggggggttcctgtcggttcccttgtcctgcatccagacttcagcagcctgagcacatgtctacctcggagagtatctttcggcccacctgctttgccttcaaactttcttggtgaaggcccatgcaaaagagttagtgggtgaatgtaagctctcttgaatgggaggcattagagagtctatagcctcatgccgtcgcacactcagccttttaaaatgtgttcagagtttctctgtttcttttgtacacaagtctgtggcagcctcctcttcctgctgctgctgtgccaaaaatcaaagcagctatggggctcttttctcctagaaagggcttttcaagattttgattttttttccccccaacctcagcttcccgatagccttaaaagaaaaaaaatcctatgatttgtaggttatccagcttcttgtagctaggatgggagtgatgttgtcttgcaactttctgtattttgttagaagaaaaatatccatctattgaatttttcatgtatgcttccacaaaaaactcttgtttgttcgctgaatgttccttttttatagcatcctattcttgattcatggatatttttacattctattatctccctgagtgagttaatagctttaaaaattctttttaaaaaaatttttttatgagacagattctcgctctgtcgcccaggctggagtgccatggcacaatctcagctcaccgcaagccccgcctcctgggttcaagcaattctcctgcctcggctttctgagtagcttggattacaggcatgcgccaccacgcccagctaatttttgtattttttggtagagacggggtttcaccatgttggtcaggctggtctcaaactcctggccttgtgatctgcccccctcggcctcccaaaatgctgggattacaggcgtgagccaccgtgcccagcctagttttaaaaattattacctctcatagtcgtgtttcccaacaattgttttcctgtttgttttgattttgatctttcctgctttcatgctaaaggttttcctcaggtgtctggtgatccttggttgtcttctcatatttaagaatggggcaggctgggcatggcagctcatgcctgtaatcccaacactttgggaggccgaagtgggcggatcacctgaggtcaagagatcaagtccatcctggccaacatggtgaaaccctgtttgtactaaaaatacaaaaattagctgggcatggtggtacgcacctgtagtcccagctacttgggagcctgaggcaggagaatcgcttgaatccgggaggtggagattgcagtgagccgagattgtgccactgcactccagcctgggcaacaagagcgaaactctgtctcaaaaaaaaaaaaaaaaaaagaatggggcactaatgagctgattgaaaaggaaggacatgtcaactatgagcttcatcataggatgatgtagcggggctggttttattggagaaccccaattttactaccttttcgttcaccttgggatggccaaatacccagagatagatctttagcctgctgcctgaggctggttgtcagcacttgagaaacagagtgggccaggagggtccaaagtggtccaaattcagtaggtaaatatttatttaaccccctcatttttagtatggtgccatctaagctgttcctggtactccccacttgaaacactctttgtttcatcatctccaaagaataaacattctgttccgttgggatggggaaaagcatgtggagatctgactgcctcttcaacagacttttaatggcacttccatactcacccccattttctggatgcgtgtgggttccgcagtgaaattcagctcccatgattttgctgctgttttctattttcccattatttctgtccttgggagtttttctttttaaaaagtcatttactgtcattttggtgggatttcatgaggaagagaaagtgaatgtatgtgcttaatctgtcactttctcctttcttccttccttccttttctttcttttctttctttctttctgatggagtcttgctctgttgcccaggatgcagtgtagtggcatgatctcggctcactgcaacctccgcctcctgggttcaactggttttcctgcctcagtctcccgagtagctgggattacaggtgccccatcatgcccggctaatttttttttttttaaacttttagtagagacagggtttcaccttgttggacaggctggtctcgaactcctgacctcaagtgacccgcccgccttggtctcccaaggtgctgggattacaggcatcagccactgcacccagccggtgcactgcgtggaagggaagcagggctggctaagggcatgtgacaggattgtgatattcatgggcagcttgtttggagcccataagtccctagggataccagtctacacagtaacatgatcacctccaggctgtgaggaggagtggtgaaggcaaacaagcaattcttttcaaagcatggggtttcgtgggcctagtataaagaaaaacaagggaatgcatgacttcagtgtggttagataggagaggtcgagcaagatgcccaccaagacatactccctgctgcagcagcaccactagccagtgacttacccattggtggtgtcttagtcagctccagctgccatcacaaaataccacagactgggtggcttaaacaatggaaatttatcttctcacaattctggaggttggaagtcccagatcaaggtctggcagggtccacttctggtgagggctgtcttcctggtttagagacagccaccttctcactgtgtcctcacatggtaggggcagtggtggaggggagggaacagtgcttttcttgtgttctttttctttctctctttcttttctttctctttctttctttctttctttctctttctttctttccttctttctctttctttctttctttctttctttctttctttctttctttcttctttccttctctctctttctttcttttcttttgaggcagggtcttactctgtcacccaggttggagtgcagtggtgcaatctcggctcactacagcctccccaccaaggctcaagtgattctcccacctcagcctcccgagtaacggactacaggcgtgtgtcactatgcctggctaattttttgtattttttgtagagatggggtttcaccatgtggcccaggctagtctcaaactcctggactcaggtgatctgcccaccttggtctcccaaagtgctgggattataggcatgagccatcatgtccagcctctctgttcttctttatctgctccatctgggggttaggacttcaacgtgcgaattttgggggtacacacacattaagtccataacagatggccatactgcctatcacacagcttgaaccaaccttggcctcagctgcctggaccaggagcccgcacctggccaagactagctagtccataggctggttagttgcctacgaagttacctggcatgaaggctccaccaaaatgaggataatgagtatttgggcccataagtttctctctcttggaattgaaactgcagtgagattagaagccaaaagacatgtgcagaaaaagccacgggtatttgtcacaaagcaggagaatgccaggagaagcaaagacatgaagaaaagatggacacagaggagaggggacagcagctggtgggtagtgacaggcaccgtgggggctacagcaccataatagcagttcaggggtgggagtgtgggggtgtgggtaagtccctagagctactgaaaaccaggcttcccaaagctcagacggctgactctgcctgggttcctgtccacatatctgagctcactgccttcctcattcctacatgataatagggcccacctcatgtggctagtatgttatcccaggccgtgcattgtgtaggaggagggaagatgtattagtgatctgtggctgcaaaccaaatcacccccaaatgcagtagttcaaaatgacagtaaccatttattatctcataatctctgtgggtcaggattcaggagtggcttagctggattgttctagctcaaaggctcttgtgaggctgcagtgggattctggccatgactgcagtcatgcaaaggcttggctggggctggaggatccttttcaaaatggcacactcatggttgttggcggaagacctttgtttctctccatgtgagctcctccatagggctgttgagtgtcctcacgatgtggcacctggcttcacccaacagagcaatccgagagagagagagagagagagagagagagaaaacaaggaggaagcagcagtgcctgtgtgacctagtccccacagctgcagccattgcttccgctttattcttttcatcagaagtgagccaggtgtggtggtgtgtgcctgtggtcccagctcctgaggaggctgaggcgggaggatcacttgagcccagaagttcgaggccgcaatgagctatgaacatgccacagcactccagcctgagtgacagagcaggacctcaacttctaaaataaaatttaaaaaagaaatgaggccgggcacagtggctcaagcctgaaattccagcactttgtgaggctgaggcgggcggatcacctgaggtcaggagttcgagaccagcctggccaacgtgatgaaacctcgtatctactaaaaatacaaaaattagctgggcgtgctggtgggggcttgtaatctcagctacttggggggctgaggcaggagaatcgcttgaacccaggaggtggaggttgcagtgagccgagatcacgccactgcatgccagcctgggcaacagagtgaaactccatctcaaaaaaaaaaaaaaaaaagtggtggctcacacacctgtaatcccagcactttgggaggccgaggtaggtggatcacttgaggtcaggagttcgagaccagactgaccaacatggtgaaaccccatctctactaaaaatacaaaaattagttgggcgtggtggcccacgcctgcaatcccagctacttgggaggctgaggcaggagaattgcttgaacccaggaggtggaggttgcagcaagctgggatcacaccattgcactccagcctgggcaacaggagcgaaactccatctcaaaaaaaaaaaaaaaaaagtgagccaccaagtccagcctatactcaagaggaggagaattaagcactaccttttgaaggcaggagtatcaaataatttatggacctacattaaaaccaccagagcagaggtattagttaactttagactttattaagaatgcatgttaaaataggtagaggaactactaaaaaattcatagagcacttctaaacaaacagaggagaaaatagaatgagagaacaaatccagtccatctaaaagatgaccaagagcagagcatctgcctgggcatattgacagctctcggcactcactcccaccttgtgggctctgcatggcagaggctggaaatgttccagactccagagcagctggactttgggaagcaaatttagttttgccaattggcaaattggcaaatttgccaattgccaaattgggtgtgctcacatgaagtttggatgactgaaggaagggaagccacacttctgctgtgtggggctgcgtttctgctggacatcaaagaatttctggggtctaaccttcacttcttggttgttgaggggcacttgtggcagcaatggcttcctggtcccagcttgctgatcctcaggtcatgactttggtggtgtctttttgaactcaaaggttacactggccgcctcccaatcccccatcttgtggatggtggcagaggtagcagctcccttgaggagccaggtctgcactggtgttatcaacacctagcccagagtccactcctttggcccatccaatggtcaggtaagcatctaatcccttctacagaatccctttctgttcatgatcacgggaggaatttctgcttcctaccctgaacctttgagaggtgaagccagctagacttcctgggtgatgtggggacttggagaacttttctgtctagctagaggattgtaaacacaccaatcagcgctctgtgtctagctaaaggattgtaaatgcaccaatcagcagtctgtaaaaacgcaccagttttctgtgtctagctagaggattgtaaatggaccaatcagcactctgtaaaatggaccaatcagcactctgtaaaatggactaatcagcaggacatgggaggggacaaataagggaataaaagctggcccccccccgccccccacaagcaacggcaacctgcttgggtcctcttccatgctgtggaagctttgttctttcactcttcacaatacatcttgctgctgctcacactttgggtctgtgccacctttaagagctgtaacactcaccgcgaaggtccgcggcttcattcttgaagtcagcgagaccaagaacccactggaaggaaccaactccagacacaccttcactgatacaatgtgggggtgaggccaggtgcagtgactcactcctgtaatcctagcactttgtgaggccaaggcagtggatcaccacttgagcccaggagttcaagaccagtctggacaacatagtgagacctcacctctaccaaaaaagaaaaaaaaattaatcaagtgtggtggtggcacatctgttgtcccagtacttgggaggctgtggtgggaggatcacttgagcccaggaggtcgaggttgcagtgagccatgatcacaccactgcactccagcctagggaacagagtgagaccctgtctcaaagtaataacaacactaataaaaaataataaagtggaggtgggggagagagatggggaaagcaggacaaatagaaagcaaatactcacctggcgtgactacatccagagatagcagcagtcatcaccgtgtgaccagctgacctgcacagttcaaagacaaaggcaggttcaacatcaatctaccacttgactgaacaatccactcctaagcggttaccttagagaaatgaagacacacatttacacaagcttgcatataaatgtttagagctgctccatcataatcacacaaagctggaaactacccaagtgtccttcagtgagtgaatggctgaacaaaccctgatccaaccaaacaatggaatactactcggcaatcaaaaggaaatatactgctctctctcgcccgcatgctctctctctctctctctcacacacacacacaaacacacacaccaacatggatgaagctcaaaaagtatgctgcgtgagtgtgaaagaagccagacaaaagaatatatacggtatgattccatttataataaaatttagaaaagacagaaatcagatcagtggtggccaagggcagggggtggtgggagtggttggctgcacacaacattcaccaaaactccttgaactgtaaacctcaaaaggatgaattttactgtatgtaaattatactccaataaagttgatttttttttttttttttttgagacagggtctcactctgtcacccaggctggagtgtagtggtgtgatcatggctcactgtagcctcaacctcttgggctccagcgatcctcccacctcagcctcctgagtagttgggactacagacatgcaccaccatgcctaattttaaaattttttttgtagagacgtggtctcgctgtgttgcccaggcaggtctcaaagctgatttttaaaaagacaagaattgttagacagaatcaaaccaaaccaaaacccaactatgtgctgtttccaagcgctacacctgagatatgaagacacagaaagattgaaaggagaacagagaaagacacgtctggctgagcccaccccgcctgcctgctggcacttccttactgccccactgtcgtctgtggcttctgcgtcttctgcatgctcatcacagggtcagagtctggggcttcccttgtccagtccactgtgtctatgagggctgggtcacagggagcagggctgtgagaagcacttgacgttgaagggaaagagacagtcatctgtctacttggtgtccccctaacctccaacagcaagcacatggcagtgggggggtggcttgcctcttgttcagggccagtccctcctgcttctcctgggacttgctctgcccttggtcttctgtcactcttgctcttgctcccattggctcctccacttcattacatggaagtgagaatgggcatcgtggtcaagcagaagggaattcaagtccgagttctgccatttaccttctgggctatcttgggtgggtcatttgacccctctgaaccttggtttcctcatctgtgaaatgggggcactgatagtgccaatttcttcctggttgcatgactgcccctctctggaccttgggtacctcactgggagagtgaggataataacagcaccatcatctggggtgtgtgtgtggatgcaatgagccagtggagagaaagagaccttcctaactgtgcttgctggacccagccttgagctctgtgggctttggttttctcatctgtaacgtggggcgaatgcttcaacagacctccccaggttggtgtgcaatttaaatgtgcaggaaatgtaacgatggcaggtccatggctgtgctcaggaaatgtgatgtcgtgtaatcctagtaatgaattttttgttaccataaatggacccatcactacacattagcaggtgcgtataaacgggctctattccctgcttacttcaccatcctgatgggcatcaaaccctagattaggtaaaggatttgcagaagttggggcttggaggaaaggctgggaacgtagggagtgagtggaggcagcaactggaaaggagagaggcctatcagagttcagatcagcaaaggcaggaagctgaccacagctcagtgcctcatggaaagtacgccctcttggcccagctcatgagcctgctggcctcgtgacccaggcgggctcagtttcctctgctgtcacctgaagatgccctgcaagtgcccccactctggaagcagtctccctagccgtccgtcttcactcaggtgcctagtcttgtccattctcctcctaaaggctgggcaaacatggcatccagaccctctctgagcacagatgggtccaccccaagcttcccattccaggggaactgaagctggcactatgggggtggggcatccaagccaggatgccagggctgctcccatgtgggccctccagggccccacaccacttggggagtcttgtgagactgagtcgagggcccctggaatgcttcactgggcaacaggcatgcccataaaaataccgtggccgccagatctgcaatctgccatcggggccctaggccttcctagccctgaggctgcagccagctcgccggctccggaattcttaccccctccattttgcttcctcgcctgtgaggtcatggccttgagcctaggagggggcactggggaggagctccttccttctcgatcctgtgcagggctgcgggggagagtgggagagagtggagtcggcgggaaaggtcgaatggggccaatcccgaggacaaagaaataagacaccagagagctggaggaaaatctgggagttgggggtggcagttcgagggataccctctcccagaccctgtctcccctgggctcgcctcctaccctgccgcccacctgggctctggggtgcgcaggagccggtgctccgcggcgcctccccaacacgctgaggacgaagcccccgcacccctcccaacaggaccctgactgggccctcaggatcggggggcattcgggagaggtcccgggagtcctgccctgtgtgtgtgtgttgggggggcgttgcgtgcaggtgcccatcgctggccggcgccgtcgagggccaggccgaggctaagggagcatccccttccttgccggactcctctctccaccgcccggccccaggcctctgggagcactctcgccccgcgattcccgctccgagctttcacagcgggctcccttgcgctggggctgaggacactctccggccggagactcccggtctgcggggaagggggtctggcgggacccgtcggctggggtcccgctgagctcccggagtgggctgcccgggggcccccagcccaagccgcgctcggctggcaccaggggctagggtgcggcggggcggggcggggcggggcgggcggccggggaggtgatctcactcctccctccctctcctccccggcgctcccctcccccgcccctgcgcgcacgcccgccccgccccgccacagccgctgctgccgcagcatcggcatcgcagacgcgctcgggcggcgggtccgaggccggcgtgcgcggaggctgggcgggcagcccgagcggtggccgcagcgcaggtaaggcgggctggcctccccgtgcgacccgggccgcggccgcgatcccccggcgacaccacaccgctctgcccggggtgcacggaccagggagtcccggcccggtccggcccgcggtaaccggcgttgctgccggagccccacccatgccgggcgtcgggctccgggcaccgcgggctgtaagcggggcgggggagggatgccgggtgcccgagcccgacaggtgaggggtaacctgcggggccccagatgctggcctgggcgggagaacagggcggggggcgtcaggcagggtctgtgtgggcaggcgggggctgaagttggcgggtccccgtgcgtgtgtgcgtgtctgagaaaggaagccagatcgggtcgagcgctcccccacaggccgccgtggggtgtggccctgggcgtggctgcccctcatccccagccgagagctcagtttggttgaaaatcccggctgacagcgtggtgaggggtagatcgggataagccgcccctgcaatggggggaggggagtgaacgggactgggcgctgcctgcccctccgccccaaggttgggggggctttgttctcctccttcttctttccaaatcccagcctgggctcctccgggctcacccgaaaacctgccgcagagccaggggctcctccccggaggcgtagggcgcctctggagcccgtttccacaggctctgtggccagtcagggctggagtgggtgaggtcggttcgggcacccactgctgtgcctcccgtgcatgggtgtccatcaggtagggtccatcaggtaggggtgagggaaggtgggcctcactggctcaggcggtccctgcgcactgcaggtcttttgcccactgccacatcttcctatctctgtgcggttatgggaggggtcagcgattcctattccctccattccaggtcagacttttggggcctcttggttggcagggattgcaaagaacacgcactacaatccattgcccccgacagggtatctggaccccccacctatcactgtccctctcaggaaggcaggcctagagccatctgcccccttctccagaaggagtgggggcctggcaccccccaggtagataccctgcccctgttaaccccaccctgagggcaggggcatcggggcagcccagtgccatctctgctgactcatgtggccctgacgtaaatcagtgcagtccgcccttcttcccctgggggctgctgcccagcatcatctttctggggcgggggcctccccagggcctctcccctcccgtcagctccttgctgcaggtggtgggacttggcccagcctggcctctcccctggcacagctcccatgcagtgcccacatgtgcacacctgagggctccagagcctttgaggactcggctgtcttggccacatgggaagtttggggcagggttgggcctgggaccttcccacctccttggctcctggtcatttctctctgctgcatctgagtctctctccatatttattgatgtttgtgtgtgtatgatcccgaaagtaatacatcttattgtaggacacttgaaatatacagaaaagaacaaaagaaattaagaatcgctagtgatctgatcaccaagagggaaacacgttcagcacgccccagcctccctggtttgctacaccgcgctcctaaaaggctcctccccaagttcccagctgccagctccctgctgagcatcaggaggacaatcagcgcttcaaggtggcggggtcccctgccctgcagccagtgaagagcttccctacccaggcgctcaggatcccacgatgggcagtcgtgtactgggcagctgctcatggccagtgctcctttgggccgggctctgggctgcccatggaagagccagtgacaaactggaccagcattgtccctgtcttcgtggggtgtcacttgttttcttttttcttgatgattatctgaagggaaaagggaggcaaagagtgaggaagggcctggcctgagggctcctacagtgagcagggtgcccagattgtgcccccaatcggcctctcccaggtccgagccctttccaccactggaactacagctggcgccttccttggcatgcacctggccaggactggcaggtgagggtcgaggagacaggcctgtgtgccctaccttgatcaccaagttccctttcaaagctcgaaatggctgcactgagtgcttttctgggtgtgagggtgatgcggcctcgcagagtggcccaggctccaggagggcacgttcatgggagaacctggggtagtggtggggtcctgtgaggaggtctgccaggatggggatcccagccaagaccctggtctgccaggcatgagtgggggcatgagtgggggccctgcctccctccctcgtggttcagacagtgggggaggcggggggtctggatgcccttctagggtccccagcagggtgctcattgccctgtcctctgcccctgcaatgggctggggctgggtccctgggtggggccatctggaatgggcctgcagcatccctgcccctgcagtcgctgtcttacttgctctgatctggcccatctcggacacctccttctcctgcttcccccgcccccctgctctctcctctgcagcctcccacgtctccctgtgccccacccccagggccatcaccttcctcctccttctaggcagaagcctgctgctgccggggatggggtgcaccactccccgtctcctccctctgcctctgcctgcctggccctcccttccctcttcccccttcccgtcagggctctgctccatctctctgcttacccttttgtctgtcttccaccgctctgctcctctccttgtcccccccagctgcccctgcctcacccttgagggccctgaggttgtgccctgtccagcagccactcagcacccttctgctggactctacgccttggggttgggcccagaccccccatgggggccttgtctgagtggaaggctgtatggggggtgcctggtgagcagcagccagacgagcactgggggaggtagcccgcccagcttgcctcttccccagatatcaacagggtctttgtggcttcctgaaggctgtggctggaaaaagagggaggagctggggagggtctggccgctgttctttctagaagcttttctttgtccagtggcccccagcccaggtccccgtgttcttcccaggttggaaagctgcagagggagtgcccagccactgtcagtcagcagctcctgctcatctctggcccttacacccagcaggggcagctgcgagggccaggggttgggtggggcaggagggtggcagcgtcctgggctccatgcacttggccaaagaggacttctgaacccgtccatcccagtgcgggtctgagagtggaacttgagggaaagggactgagtcccgggagcccctctgccccctgccctccagccaggcagacttcctatctgcatgtatggggtttgtgtctctgcttgtgtgtgtgtatttgtgtgtgtgtaacctccagtattcctgtttgtctgggtggggtcatatatttggttgcatgtgtgtgtgtgttcgtgaaccagcatgcacacacatattgtcatgaggccacgtgggtctcctcagatgccccaacagggcctgtgctgggaaggggtggggctgagggtggctgctgcagtggctggatggggacagagcctctggccaacccaggctgtgcttcagtggaggggggttccctgtggccctgtctcccagccatctgcgtctgtgttcatgacttaggaatgcccaagccctggggatcacagaggccccattgtccgcccccgggcttcctgtgtccccctctgccctttaacccctcgggagtggggcccctggagggggcccgtggggcctggcagtgtctgagctgtttccaggcacccccaccccgccccccgcaaaccaacacaggctaggtatcccaggactgctgtgggccagggcctctccctgccccaggctgggctccttccctgctctccttttcaggccacagccccaggaactggatgcagtctgttccttctggcctggccgctgaagccccctctagtgctagggtcatcctagctccctgaggaggcctggggcctgagaggagccctagttttgctgccacctcatttctctcgccttctaggggtctcggaggctgaagccttgccgcctgctgggcatcagtatctccttcgacacaagaatggggccactgctgtccctaaatgctgattggagaggggcctctttgggaggggttctggagcctctggttgcaagaaaggtatcagaacaagtccagattccagagagcagaagaggggaccaagaaaccagcctgtccccaagcccaaaagggaaaggagttggccttctcttggactgagtacctggatgggggacttgggggtttgtttggtgtcgggcttcagctctgtgctgagacgtgatgttgatcacatcctacttccgcatggcctccatcccaagatgtcactccctgcccccgacatttgcctgccatctgcctggcaagtaagccctccccacggggcaggatggcttggaggccatcctcgcccaggcccctggttccctgggaagcccagcaggcacacatgttgggatgccagagcctctgagaggcagcttagggagccaccacgccctctaaaaccccacccctgctgagacccagtgccagctctgtgatcttggacacagtttccagttttctgagcctccgtgtcctcatctgtaaaatggggatgatgatagcacctccctccctgaggcaaatctggggaggagatgagtggatgtgagtggaagtgctcatgaggctttctggtacgtggtaagtccacgctgtaagttgatttaatagaacagaccacagaggcatgtgattgtggggatggagtggggctcctccctcccttccccagtagtcaagaccgtcctccctgaaccccacaaagggttaacctccgtctcttttccccatcttttaaggagaatggtccattacaggtgagttgtagttgccttggagactgaagcctcaggcgagatgagggggctgagggctcactctctcctaagggtaccctcttagggaggggtgaggttgggagtgcagggactaagcagcagtcataaaggacttctgggcccccaggtacctgtgggggctccctggagcagccccctttatgtgctgtctacataacacataacaaggctttcctctggcttcccccacctctgggacttgggctgcatcaccatagaaacccgccagccacggcctggggagcggggcggggagggccagcgggagccttaaagggacacagtgcacagggtgtaggtgacacccacaccatcgtatacacaccaacaggcacagaagccccccaggctcccaggcctgcaagcacatgggcccagcaccacactctgaccctttcatgtgccctgtgctgagcccccagccccacccccactctggcccactgagtcaccaggcaccatgtccccaggagacaagggcaggagaagccggatagtctctgctgtgctgttgaagggctctcttgttgcttctcctttgagaggaactccaggcagaacctgagaactgacaggcaggtgtgcagggcacatgtgcagggcaccgctggaggttcccttctcaaggtgtgtggtggtggtggtgatggggtgtgtgtgtgtgttttcagggaggaggcagtcactccaggtctagccaggctccacaacctcccaggtccctccctggcaagctgcttcccatcagaccaaagcaggcactttggagcagaggacagaggactccctgagggacctgcgggtgtagtgggaggccaggtggggtgggatggggcaaggctcttctggggctgaacccctccctgtaggctgctgggcgtgacccttgcctccctggccctttcccaccggggaggatgggtttgggaccggacttactcaggaatggccccatcttcaactgccccagcacagcggccactgtccactcagtgcatggtcacgcaggctcactcttggcctaacacatgtgcgtctcctccagccaggtgaccacttactcccagccagcagcaatattggaaggcttccctgggattttctgggtgcttccccctccccccgttcctacccgcagcaggaatcccccgacccccacctgttccctggcatggcatgggtcagccagcagtgtgccattcatcctgtctcacggccgtcccttgcccagtgccacaagtgggcagggccttgatgctctgttgcgtggggctttgtaggcccctccggccccagctcacagctgctccaccctctgtctgtctctctaccctgctcccaggccagcgtgacgtccacgccgggaagcccctccactgacccaggcccatcttccctcctccccgccccttgcctggcacagcccccagggacaaggacgctgtgcaggcggcctgcgcgcacgcgcacgtgcacacgcccacccccacccctcactcttctcgctctttctgccatttctcagcggcgcactctgcagctgcctctcaccctttgtgctccggtttcctcttctctccctttctctgctgcctgggtctccgtttcggaatttccccaccccctaaccatctccatcgtggttagcgctgtcttcctacgtctgtctttgtctcctgctcccccctgcctcttctcactctgtctgtcacccttggcagacccggccttggctccatctgtggaacactcccccctccccgctcctttgcccttagtggtgctggtggggggtagagggcctgctgagctgacaaccctagctgcttgctctgtaattgcctgaggaatggtgagagatcagagacccagcagcagtgggaggagaggagggagcgccccctcccagctgttatatctcgcaaccttctggctgcttcctgcctgtctccgactgcccagggcggtggcaagctaggtggcaaatactgggagaccaaaaaagaagttggatatgagcctgtggggagatgggatggggctgggatggggcagggagcggggaccaggggtttggggatattgtatttcccctgagcgtacatgccaaacaccattccaggattctagatttggaggacaaatagaggaacttgcgtggcagaaattatcgacctccagagcacccaaaagcctctgacatgcaggagggtccttctttgagcttttccttgctccggtttcctcccctccccctcctaagaccagtgctcagagctcccaaggctgctgtttgatcatctgctctctgatccgagtctcctactgctcctacaggccttgaagttgaggccagtgctgcctggggcctcccctgatccactggctttgtagggagaggccggggtggaacagatccactgttgctcttcccttctgggcccaggtccagctcttgcaggctgggaatcactcttcttaccctccaagtcatctcttggcctccaggccatgcacgctgacccaccctgctgcttctccaccaccctctgcagcaagctcttgcccagagtccccacgggatctgccgcattcacagctcttcttgggtcactctgttacacaaaactgacaaggcccagagccttagcacagcatggctgacttctctaccatcctttcggtgttcctgctgaggctcggtgcccgctttgataaggtcctggctgggcagagggaggatgcacagtatggatttaatgaaggcgtctagtctgggacttcagcctccaagctctgtcacctaacaacaccctttcttgccttgcctgcactttaaccacttcctgtttggaattgaagtggtctggccacttgggagtctgtttcctcttgtcattgtcagaggagccccctctttcagacccttagtctttggctccccttacttgtaggtgaatatggacatggccggtgtggcttgggtttggggtggacacatgcagcagttgagctctgaagactcagacaaagacctagaaattgggactttgagacacacaagaagtgttagaaacactgtcacggaaaatgtcccagagcttgtcctgacccctgtcctgaccctaacctggagcatctggaagggaggaggcctcagtggcctctcttgacccccagggggctgaggagcagcagggggttgttttcctccttcctctcttctcccacaccagttctcaagggaaggcttccttccccattctttctctcttttttttgagatggagtttcgctcttgttgcccaggctggagtgcaatggtgcgatcttggctcactgcaacttccgcctcctgggttcaagagattctcctgcctcagcctcccaagtagctgggattacaggaatgcaccaccacgccaggctaactttttttttttttttgagacagagtcttgctctgtcacccaggctggagtacaatggcgcaatctccgctcaccgcaacctctgcctcctgggttcaagtgattctcctgcctcagcctcctgagtagctgggattacaggcatgagccaccacgcctggcttttttttttttttttttttttttttttgtatttttagtagagacaggatttcaccatgttggccaggctggtctcaaactgctgacctcatgatccgcctgcctcagcctcccaaagtgctgggattacaggcgtgagccaccacgcccagccctaattttgtatttttactagagacagggtttcaccatgttggcctggctggttttgaactcctgacttcaggtgatccacccacctcggcctcccaaagtgctgggattacaggcatgagccactgtgcctggccttttatttttatttttatttatttttttagacagagtctcactccatcacccaggctggggggcagtggcacgatcttggctcactgcaacctccgcctctcaggctcaagtgattctcatgcctcagcctcccaagtagctggcattacaggcgcccaccaccaaggctaattttttttctttttgtatttttagtagagacggggttccgccatgttggccaggctggtctcaaactcccaacctcaagagatccacccacctcagcctcccaaactactgggattacaggcgtgagccaccacgcctggccctttccccattctttcttcattttcctgaaactattttgtgaaatgctgccatcttgggcccctttcctcccttctctatcccacttcccaatccccccattagctttttaggtctgtacagcacccaggcatcagttggctctgaaagctatagcaatgtgactgcaagaagaattcttctctacatgtgtgtgcacacagagataatagatacagggattcatccccacagatacataaagacatacaagaagacacacgtagctagcagacttgtgtgttgattccctcaggcacacacactaacacacccactcatgagtgcaacccctcccagagaagacacaccacagaaataccagctcacatacagctcactccctgcttgcagatccacaaccacacacatgcccacggacacctgcacatgcagacacatacggggatgtgcatgccatgcacaggggagctgatggggcaacaagttggtgctgggaaggcagctggcaggaaaggtgcagacagagagtagagagggaataaaaggcaacctagaggcccagccagggctatctcttccagatttctccctccaaggtggggaggggtgcggatggggaggggagggctggagaagccggccagctgggggcggggctgagggcggggccaagagcccgggcttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatgtgagtagctgaagggagcctgggcgcctaccttcgccgctatgttgggcccctctttatcttctacctcctcaccttctccctgttccggaccctgactcctctccctggcctttcctgggcacagggtgggcaggagatagccaggacgttgggtacccccggagagaagggcagggtagaaggtgcggggcgtgtcaggaccatggacagggacaggcgcggccgccggggcgatttcagcaccagggacagcgaacctggagcagggccccgaggtcttgggcctcctccatgctctccttagcccgccccatctctgcccgccccactccgactcctccgcttccatcccccaccacaggggtgtggcagcaggagaatggggtcgtccccagccctcagctggcttgtgcaaaggcctgtgttcaagtcttgtccccatttctctttcccctcctgggcccttggtcaccctgtctctgaactgagacaggaaaaggtggcttgaaaaaccctggtcccagcccagcagccttctggacccttttttgtgtgtagttatttggtgggggtgggggcagggctgctggagcatgtgtctatggttgtaacatttgttgggggcacaagcaggtgagtggatgttggggagtgtggccgtagggttgtgattaagcatggatacactgtgtatgtctgtgtgttcttgtgattgactgagcgtagatattcgtgaatgtgattttgacttccttacatgggtgactgtgtgagtcactctgttacttactggccaggcttgtggaggtcgggaggtatttgaccacgacatttgattgcattgggtcatgtgtatgtgtgagtggggctgaatgtaagtacacacttgcgtgtggggggtgttaccgtgatggtgttttctcctgtaagtagctgtcaggccgtgtgaggggcatgtcacagggtatcatgtgtgagggcatttgtgtctcttgagctaccaggctccagtcccttcccagcctcaccttgacacctttgtctctgggcctggacaaggaggaggccagtgtcactgagagacgagttggcggataggggttgggaagactgtctgtgccagcagtgggacaggggctgcgagagagaggctggggaggcacctggcgttgggaggcagtgagggcttggaggaggtaaaggggctggccccttagacacatacatggagggccagggccaggcagactcccttggtacagatgcacatggacacatgcacacaggtgcatgaagacaaggcaggtgcagggatgaaggagcagagccgctgagaggccacacaggtggaaacacacaccagtgaggcttttagacccagaggacacagaggtggatacacaatataacactgtacagtggaatgcaagccgtgcattctctacagaaagatgggagtggggagagagaactaggccaaaaggccatggcagctccaaggctgccctggtcactgaccagcacttgttcttgaccctgatacgacacagtgggcagtggcaggcagccggccctccctgttggaacctgtcttccatctctccctccccagccactccagccccctttgtctcttttcctgcttcctccacctagttggctttctgcatcctgtcatccctgtcaccatctccctccccagctcagggccctctgcagtgtccccagggagccccctcctccctccctggaccttcacactgaggtcttctgcagagacaaagctttcagaggcagcctgctgctccctccctccctcttctcccttcctcgaggccgccctggccagtgctctgcagagtcctggggctgggacagcagctctggcctctgccccagagagcttggtggctgtctgggaggaaggagggagaagaggagggctggcgccaaccccgcaggctatggaaactcagaggcagcagggcctttgggatagttttcagggggagggggcagcagggctctgaaggctgggccctggtaattgaaaacactcagctgtgctaattggattaggagggaagcaggctggagcaggggacggtgccttccaaggcatcctgaatgggtggggtcagttctgcaggccctgccaggccctgccagggggctgcaaggacactccttgttaaaggcaagaatttctctctccctgtctgctagagctggaggcatggcctggctgcctctgggctacatgccctgtgtgtctatccagtggagctcctctccctgggcatctctctgtcccatctccctgggcttgacctgccactgctccagcccagcgtgtgcccccttgttgccactgccagggcctcctctcctgccattccctctccacgggggggctgcaggagcttactatgtcccctgccatctgccccactctggggctgcctgtcagtatttctctccattccctcccttgctgcctgcctggatttctcagatgaaggacaccatggtaagttggggaggggtgagagtgtttcccagaaggccaaggagaagggtaaggaggccctcagctgagcctgcacccccgccctcctgagtgccggggccctgctcggctctccctgagcaccatgtgcttctctcacctgtgtggggctggctttgttctgtctctgccccagcctgggtactctgtcaccctcactgttcctctctgccattctctctggtcccttctcccctgtctggggtttgtccttcttggtttctgtgtcttggcttttgttgcccccgcttctttctgtcataccctttttgtctttctcaggcatctctttgtaacttacgtggctgtcccctctctccctcttttcatgtcccacaagcctcttttgttcttcccctccgttcgtccccctgtggccatggggcctccaggggctctggaccctgcttccctcacgatgggacaggtgctgaggctatgacaccagccaggcagcaccctcaccaccgctctctccaccctgtcttcagtgatggagccacctgtcatcacggaacagtctccacggcgcctggttgtcttccccacagatgacatcagcctcaagtgtgaggccagtggcaagcccgaagtgcagtgagtgatctctgccgtctcagcccctgttgcctgccactgaccccggccttgtgcctccctggactgcctaacttctaagcccagaagccccaaaccttgctaatcaccccaagtcctcgccatctcccagtccatcccctgggggccctggctgcttgcacctgtccctccagcctgttccagcccccgttgggttccagggcctcaggcctctgggcctttttccgcccacaggttccgctggacgagggatggtgtccacttcaaacccaaggaagagctgggtgtgaccgtgtaccagtcgccccactctggctccttcaccatcacgggcaacaacagcaactttgctcagaggttccagggc

SEQ ID NO: 4082 - DNA, 13905 bp, human
acagccgctgctgccgcagcatcggcatcgcagacgcgctcgggcggcgggtccgaggccggcgtgcgcggaggctgggcgggcagcccgagcggtggccgcagcgcaggtaaggcgggctggcctccccgtgcgacccgggccgcggccgcgatcccccggcgacaccacaccgctctgcccggggtgcacggaccagggagtcccggcccggtccggcccgcggtaaccggcgttgctgccggagccccacccatgccgggcgtcgggctccgggcaccgcgggctgtaagcggggcgggggagggatgccgggtgcccgagcccgacaggtgaggggtaacctgcggggccccagatgctggcctgggcgggagaacagggcggggggcgtcaggcagggtctgtgtgggcaggcgggggctgaagttggcgggtccccgtgcgtgtgtgcgtgtctgagaaaggaagccagatcgggtcgagcgctcccccacaggccgccgtggggtgtggccctgggcgtggctgcccctcatccccagccgagagctcagtttggttgaaaatcccggctgacagcgtggtgaggggtagatcgggataagccgcccctgcaatggggggaggggagtgaacgggactgggcgctgcctgcccctccgccccaaggttgggggggctttgttctcctccttcttctttccaaatcccagcctgggctcctccgggctcacccgaaaacctgccgcagagccaggggctcctccccggaggcgtagggcgcctctggagcccgtttccacaggctctgtggccagtcagggctggagtgggtgaggtcggttcgggcacccactgctgtgcctcccgtgcatgggtgtccatcaggtagggtccatcaggtaggggtgagggaaggtgggcctcactggctcaggcggtccctgcgcactgcaggtcttttgcccactgccacatcttcctatctctgtgcggttatgggaggggtcagcgattcctattccctccattccaggtcagacttttggggcctcttggttggcagggattgcaaagaacacgcactacaatccattgcccccgacagggtatctggaccccccacctatcactgtccctctcaggaaggcaggcctagagccatctgcccccttctccagaaggagtgggggcctggcaccccccaggtagataccctgcccctgttaaccccaccctgagggcaggggcatcggggcagcccagtgccatctctgctgactcatgtggccctgacgtaaatcagtgcagtccgcccttcttcccctgggggctgctgcccagcatcatctttctggggcgggggcctccccagggcctctcccctcccgtcagctccttgctgcaggtggtgggacttggcccagcctggcctctcccctggcacagctcccatgcagtgcccacatgtgcacacctgagggctccagagcctttgaggactcggctgtcttggccacatgggaagtttggggcagggttgggcctgggaccttcccacctccttggctcctggtcatttctctctgctgcatctgagtctctctccatatttattgatgtttgtgtgtgtatgatcccgaaagtaatacatcttattgtaggacacttgaaatatacagaaaagaacaaaagaaattaagaatcgctagtgatctgatcaccaagagggaaacacgttcagcacgccccagcctccctggtttgctacaccgcgctcctaaaaggctcctccccaagttcccagctgccagctccctgctgagcatcaggaggacaatcagcgcttcaaggtggcggggtcccctgccctgcagccagtgaagagcttccctacccaggcgctcaggatcccacgatgggcagtcgtgtactgggcagctgctcatggccagtgctcctttgggccgggctctgggctgcccatggaagagccagtgacaaactggaccagcattgtccctgtcttcgtggggtgtcacttgttttcttttttcttgatgattatctgaagggaaaagggaggcaaagagtgaggaagggcctggcctgagggctcctacagtgagcagggtgcccagattgtgcccccaatcggcctctcccaggtccgagccctttccaccactggaactacagctggcgccttccttggcatgcacctggccaggactggcaggtgagggtcgaggagacaggcctgtgtgccctaccttgatcaccaagttccctttcaaagctcgaaatggctgcactgagtgcttttctgggtgtgagggtgatgcggcctcgcagagtggcccaggctccaggagggcacgttcatgggagaacctggggtagtggtggggtcctgtgaggaggtctgccaggatggggatcccagccaagaccctggtctgccaggcatgagtgggggcatgagtgggggccctgcctccctccctcgtggttcagacagtgggggaggcggggggtctggatgcccttctagggtccccagcagggtgctcattgccctgtcctctgcccctgcaatgggctggggctgggtccctgggtggggccatctggaatgggcctgcagcatccctgcccctgcagtcgctgtcttacttgctctgatctggcccatctcggacacctccttctcctgcttcccccgcccccctgctctctcctctgcagcctcccacgtctccctgtgccccacccccagggccatcaccttcctcctccttctaggcagaagcctgctgctgccggggatggggtgcaccactccccgtctcctccctctgcctctgcctgcctggccctcccttccctcttcccccttcccgtcagggctctgctccatctctctgcttacccttttgtctgtcttccaccgctctgctcctctccttgtcccccccagctgcccctgcctcacccttgagggccctgaggttgtgccctgtccagcagccactcagcacccttctgctggactctacgccttggggttgggcccagaccccccatgggggccttgtctgagtggaaggctgtatggggggtgcctggtgagcagcagccagacgagcactgggggaggtagcccgcccagcttgcctcttccccagatatcaacagggtctttgtggcttcctgaaggctgtggctggaaaaagagggaggagctggggagggtctggccgctgttctttctagaagcttttctttgtccagtggcccccagcccaggtccccgtgttcttcccaggttggaaagctgcagagggagtgcccagccactgtcagtcagcagctcctgctcatctctggcccttacacccagcaggggcagctgcgagggccaggggttgggtggggcaggagggtggcagcgtcctgggctccatgcacttggccaaagaggacttctgaacccgtccatcccagtgcgggtctgagagtggaacttgagggaaagggactgagtcccgggagcccctctgccccctgccctccagccaggcagacttcctatctgcatgtatggggtttgtgtctctgcttgtgtgtgtgtatttgtgtgtgtgtaacctccagtattcctgtttgtctgggtggggtcatatatttggttgcatgtgtgtgtgtgttcgtgaaccagcatgcacacacatattgtcatgaggccacgtgggtctcctcagatgccccaacagggcctgtgctgggaaggggtggggctgagggtggctgctgcagtggctggatggggacagagcctctggccaacccaggctgtgcttcagtggaggggggttccctgtggccctgtctcccagccatctgcgtctgtgttcatgacttaggaatgcccaagccctggggatcacagaggccccattgtccgcccccgggcttcctgtgtccccctctgccctttaacccctcgggagtggggcccctggagggggcccgtggggcctggcagtgtctgagctgtttccaggcacccccaccccgccccccgcaaaccaacacaggctaggtatcccaggactgctgtgggccagggcctctccctgccccaggctgggctccttccctgctctccttttcaggccacagccccaggaactggatgcagtctgttccttctggcctggccgctgaagccccctctagtgctagggtcatcctagctccctgaggaggcctggggcctgagaggagccctagttttgctgccacctcatttctctcgccttctaggggtctcggaggctgaagccttgccgcctgctgggcatcagtatctccttcgacacaagaatggggccactgctgtccctaaatgctgattggagaggggcctctttgggaggggttctggagcctctggttgcaagaaaggtatcagaacaagtccagattccagagagcagaagaggggaccaagaaaccagcctgtccccaagcccaaaagggaaaggagttggccttctcttggactgagtacctggatgggggacttgggggtttgtttggtgtcgggcttcagctctgtgctgagacgtgatgttgatcacatcctacttccgcatggcctccatcccaagatgtcactccctgcccccgacatttgcctgccatctgcctggcaagtaagccctccccacggggcaggatggcttggaggccatcctcgcccaggcccctggttccctgggaagcccagcaggcacacatgttgggatgccagagcctctgagaggcagcttagggagccaccacgccctctaaaaccccacccctgctgagacccagtgccagctctgtgatcttggacacagtttccagttttctgagcctccgtgtcctcatctgtaaaatggggatgatgatagcacctccctccctgaggcaaatctggggaggagatgagtggatgtgagtggaagtgctcatgaggctttctggtacgtggtaagtccacgctgtaagttgatttaatagaacagaccacagaggcatgtgattgtggggatggagtggggctcctccctcccttccccagtagtcaagaccgtcctccctgaaccccacaaagggttaacctccgtctcttttccccatcttttaaggagaatggtccattacaggtgagttgtagttgccttggagactgaagcctcaggcgagatgagggggctgagggctcactctctcctaagggtaccctcttagggaggggtgaggttgggagtgcagggactaagcagcagtcataaaggacttctgggcccccaggtacctgtgggggctccctggagcagccccctttatgtgctgtctacataacacataacaaggctttcctctggcttcccccacctctgggacttgggctgcatcaccatagaaacccgccagccacggcctggggagcggggcggggagggccagcgggagccttaaagggacacagtgcacagggtgtaggtgacacccacaccatcgtatacacaccaacaggcacagaagccccccaggctcccaggcctgcaagcacatgggcccagcaccacactctgaccctttcatgtgccctgtgctgagcccccagccccacccccactctggcccactgagtcaccaggcaccatgtccccaggagacaagggcaggagaagccggatagtctctgctgtgctgttgaagggctctcttgttgcttctcctttgagaggaactccaggcagaacctgagaactgacaggcaggtgtgcagggcacatgtgcagggcaccgctggaggttcccttctcaaggtgtgtggtggtggtggtgatggggtgtgtgtgtgtgttttcagggaggaggcagtcactccaggtctagccaggctccacaacctcccaggtccctccctggcaagctgcttcccatcagaccaaagcaggcactttggagcagaggacagaggactccctgagggacctgcgggtgtagtgggaggccaggtggggtgggatggggcaaggctcttctggggctgaacccctccctgtaggctgctgggcgtgacccttgcctccctggccctttcccaccggggaggatgggtttgggaccggacttactcaggaatggccccatcttcaactgccccagcacagcggccactgtccactcagtgcatggtcacgcaggctcactcttggcctaacacatgtgcgtctcctccagccaggtgaccacttactcccagccagcagcaatattggaaggcttccctgggattttctgggtgcttccccctccccccgttcctacccgcagcaggaatcccccgacccccacctgttccctggcatggcatgggtcagccagcagtgtgccattcatcctgtctcacggccgtcccttgcccagtgccacaagtgggcagggccttgatgctctgttgcgtggggctttgtaggcccctccggccccagctcacagctgctccaccctctgtctgtctctctaccctgctcccaggccagcgtgacgtccacgccgggaagcccctccactgacccaggcccatcttccctcctccccgccccttgcctggcacagcccccagggacaaggacgctgtgcaggcggcctgcgcgcacgcgcacgtgcacacgcccacccccacccctcactcttctcgctctttctgccatttctcagcggcgcactctgcagctgcctctcaccctttgtgctccggtttcctcttctctccctttctctgctgcctgggtctccgtttcggaatttccccaccccctaaccatctccatcgtggttagcgctgtcttcctacgtctgtctttgtctcctgctcccccctgcctcttctcactctgtctgtcacccttggcagacccggccttggctccatctgtggaacactcccccctccccgctcctttgcccttagtggtgctggtggggggtagagggcctgctgagctgacaaccctagctgcttgctctgtaattgcctgaggaatggtgagagatcagagacccagcagcagtgggaggagaggagggagcgccccctcccagctgttatatctcgcaaccttctggctgcttcctgcctgtctccgactgcccagggcggtggcaagctaggtggcaaatactgggagaccaaaaaagaagttggatatgagcctgtggggagatgggatggggctgggatggggcagggagcggggaccaggggtttggggatattgtatttcccctgagcgtacatgccaaacaccattccaggattctagatttggaggacaaatagaggaacttgcgtggcagaaattatcgacctccagagcacccaaaagcctctgacatgcaggagggtccttctttgagcttttccttgctccggtttcctcccctccccctcctaagaccagtgctcagagctcccaaggctgctgtttgatcatctgctctctgatccgagtctcctactgctcctacaggccttgaagttgaggccagtgctgcctggggcctcccctgatccactggctttgtagggagaggccggggtggaacagatccactgttgctcttcccttctgggcccaggtccagctcttgcaggctgggaatcactcttcttaccctccaagtcatctcttggcctccaggccatgcacgctgacccaccctgctgcttctccaccaccctctgcagcaagctcttgcccagagtccccacgggatctgccgcattcacagctcttcttgggtcactctgttacacaaaactgacaaggcccagagccttagcacagcatggctgacttctctaccatcctttcggtgttcctgctgaggctcggtgcccgctttgataaggtcctggctgggcagagggaggatgcacagtatggatttaatgaaggcgtctagtctgggacttcagcctccaagctctgtcacctaacaacaccctttcttgccttgcctgcactttaaccacttcctgtttggaattgaagtggtctggccacttgggagtctgtttcctcttgtcattgtcagaggagccccctctttcagacccttagtctttggctccccttacttgtaggtgaatatggacatggccggtgtggcttgggtttggggtggacacatgcagcagttgagctctgaagactcagacaaagacctagaaattgggactttgagacacacaagaagtgttagaaacactgtcacggaaaatgtcccagagcttgtcctgacccctgtcctgaccctaacctggagcatctggaagggaggaggcctcagtggcctctcttgacccccagggggctgaggagcagcagggggttgttttcctccttcctctcttctcccacaccagttctcaagggaaggcttccttccccattctttctctcttttttttgagatggagtttcgctcttgttgcccaggctggagtgcaatggtgcgatcttggctcactgcaacttccgcctcctgggttcaagagattctcctgcctcagcctcccaagtagctgggattacaggaatgcaccaccacgccaggctaactttttttttttttttgagacagagtcttgctctgtcacccaggctggagtacaatggcgcaatctccgctcaccgcaacctctgcctcctgggttcaagtgattctcctgcctcagcctcctgagtagctgggattacaggcatgagccaccacgcctggcttttttttttttttttttttttttttttgtatttttagtagagacaggatttcaccatgttggccaggctggtctcaaactgctgacctcatgatccgcctgcctcagcctcccaaagtgctgggattacaggcgtgagccaccacgcccagccctaattttgtatttttactagagacagggtttcaccatgttggcctggctggttttgaactcctgacttcaggtgatccacccacctcggcctcccaaagtgctgggattacaggcatgagccactgtgcctggccttttatttttatttttatttatttttttagacagagtctcactccatcacccaggctggggggcagtggcacgatcttggctcactgcaacctccgcctctcaggctcaagtgattctcatgcctcagcctcccaagtagctggcattacaggcgcccaccaccaaggctaattttttttctttttgtatttttagtagagacggggttccgccatgttggccaggctggtctcaaactcccaacctcaagagatccacccacctcagcctcccaaactactgggattacaggcgtgagccaccacgcctggccctttccccattctttcttcattttcctgaaactattttgtgaaatgctgccatcttgggcccctttcctcccttctctatcccacttcccaatccccccattagctttttaggtctgtacagcacccaggcatcagttggctctgaaagctatagcaatgtgactgcaagaagaattcttctctacatgtgtgtgcacacagagataatagatacagggattcatccccacagatacataaagacatacaagaagacacacgtagctagcagacttgtgtgttgattccctcaggcacacacactaacacacccactcatgagtgcaacccctcccagagaagacacaccacagaaataccagctcacatacagctcactccctgcttgcagatccacaaccacacacatgcccacggacacctgcacatgcagacacatacggggatgtgcatgccatgcacaggggagctgatggggcaacaagttggtgctgggaaggcagctggcaggaaaggtgcagacagagagtagagagggaataaaaggcaacctagaggcccagccagggctatctcttccagatttctccctccaaggtggggaggggtgcggatggggaggggagggctggagaagccggccagctgggggcggggctgagggcggggccaagagcccgggcttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatgtgagtagctgaagggagcctgggcgcctaccttcgccgctatgttgggcccctctttatcttctacctcctcaccttctccctgttccggaccctgactcctctccctggcctttcctgggcacagggtgggcaggagatagccaggacgttgggtacccccggagagaagggcagggtagaaggtgcggggcgtgtcaggaccatggacagggacaggcgcggccgccggggcgatttcagcaccagggacagcgaacctggagcagggccccgaggtcttgggcctcctccatgctctccttagcccgccccatctctgcccgccccactccgactcctccgcttccatcccccaccacaggggtgtggcagcaggagaatggggtcgtccccagccctcagctggcttgtgcaaaggcctgtgttcaagtcttgtccccatttctctttcccctcctgggcccttggtcaccctgtctctgaactgagacaggaaaaggtggcttgaaaaaccctggtcccagcccagcagccttctggacccttttttgtgtgtagttatttggtgggggtgggggcagggctgctggagcatgtgtctatggttgtaacatttgttgggggcacaagcaggtgagtggatgttggggagtgtggccgtagggttgtgattaagcatggatacactgtgtatgtctgtgtgttcttgtgattgactgagcgtagatattcgtgaatgtgattttgacttccttacatgggtgactgtgtgagtcactctgttacttactggccaggcttgtggaggtcgggaggtatttgaccacgacatttgattgcattgggtcatgtgtatgtgtgagtggggctgaatgtaagtacacacttgcgtgtggggggtgttaccgtgatggtgttttctcctgtaagtagctgtcaggccgtgtgaggggcatgtcacagggtatcatgtgtgagggcatttgtgtctcttgagctaccaggctccagtcccttcccagcctcaccttgacacctttgtctctgggcctggacaaggaggaggccagtgtcactgagagacgagttggcggataggggttgggaagactgtctgtgccagcagtgggacaggggctgcgagagagaggctggggaggcacctggcgttgggaggcagtgagggcttggaggaggtaaaggggctggccccttagacacatacatggagggccagggccaggcagactcccttggtacagatgcacatggacacatgcacacaggtgcatgaagacaaggcaggtgcagggatgaaggagcagagccgctgagaggccacacaggtggaaacacacaccagtgaggcttttagacccagaggacacagaggtggatacacaatataacactgtacagtggaatgcaagccgtgcattctctacagaaagatgggagtggggagagagaactaggccaaaaggccatggcagctccaaggctgccctggtcactgaccagcacttgttcttgaccctgatacgacacagtgggcagtggcaggcagccggccctccctgttggaacctgtcttccatctctccctccccagccactccagccccctttgtctcttttcctgcttcctccacctagttggctttctgcatcctgtcatccctgtcaccatctccctccccagctcagggccctctgcagtgtccccagggagccccctcctccctccctggaccttcacactgaggtcttctgcagagacaaagctttcagaggcagcctgctgctccctccctccctcttctcccttcctcgaggccgccctggccagtgctctgcagagtcctggggctgggacagcagctctggcctctgccccagagagcttggtggctgtctgggaggaaggagggagaagaggagggctggcgccaaccccgcaggctatggaaactcagaggcagcagggcctttgggatagttttcagggggagggggcagcagggctctgaaggctgggccctggtaattgaaaacactcagctgtgctaattggattaggagggaagcaggctggagcaggggacggtgccttccaaggcatcctgaatgggtggggtcagttctgcaggccctgccaggccctgccagggggctgcaaggacactccttgttaaaggcaagaatttctctctccctgtctgctagagctggaggcatggcctggctgcctctgggctacatgccctgtgtgtctatccagtggagctcctctccctgggcatctctctgtcccatctccctgggcttgacctgccactgctccagcccagcgtgtgcccccttgttgccactgccagggcctcctctcctgccattccctctccacgggggggctgcaggagcttactatgtcccctgccatctgccccactctggggctgcctgtcagtatttctctccattccctcccttgctgcctgcctggatttctcagatgaaggacaccatggtaagttggggaggggtgagagtgtttcccagaaggccaaggagaagggtaaggaggccctcagctgagcctgcacccccgccctcctgagtgccggggccctgctcggctctccctgagcaccatgtgcttctctcacctgtgtggggctggctttgttctgtctctgccccagcctgggtactctgtcaccctcactgttcctctctgccattctctctggtcccttctcccctgtctggggtttgtccttcttggtttctgtgtcttggcttttgttgcccccgcttctttctgtcataccctttttgtctttctcaggcatctctttgtaacttacgtggctgtcccctctctccctcttttcatgtcccacaagcctcttttgttcttcccctccgttcgtccccctgtggccatggggcctccaggggctctggaccctgcttccctcacgatgggacaggtgctgaggctatgacaccagccaggcagcaccctcaccaccgctctctccaccctgtcttcagtgatggagccacctgtcatcacggaacagtctccacggcgcctggttgtcttccccacagatgacatcagcctcaagtgtgaggccagtggcaagcccgaagtgcagtgagtgatctctgccgtctcagcccctgttgcctgccactgaccccggccttgtgcctccctggactgcctaacttctaagcccagaagccccaaaccttgctaatcaccccaagtcctcgccatctcccagtccatcccctgggggccctggctgcttgcacctgtccctccagcctgttccagcccccgttgggttccagggcctcaggcctctgggcctttttccgcccacaggttccgctggacgagggatggtgtccacttcaaacccaaggaagagctgggtgtgaccgtgtaccagtcgccccactctggctcctt

SEQ ID NO: 4083 - DNA, 24631 bp, human; identical to SEQ ID NO: 4073

SEQ ID NO: 4084 - DNA, 37001 bp, human; identical to SEQ ID NO: 4081

SEQ ID NO: 4085 - DNA, 37001 bp, human; identical to SEQ ID NO: 4081

SEQ ID NO: 4086 - DNA, 20952 bp, human
ttattctctcagtgtatcgaagatatcagtcaactatcttctggattgcattgatgctattgagaaggcagcctgccgtctaaaagtcatggttttaaaggtaatcagctttttttcctctggctgcttttaacatcttgtgtcggccgcgggcggtggctcatgcttgtaatcccagcactttgggaggcccaggtgggcggatcatttgaggtcaggagttccagaccagcctggccaacatggtgaaacactgtctctactaaaaatacaaaaattagctgggcatggtggcgggcgcctgtagtaccagctacttgggaggctgacgcaggagaatcgcttgaacccgggaggcagaggttgcagtgagccgagatcacgccactgtactccagcctgggcgacaagagcgaaacactgtttcaaaaaaaaaaaaaaaaaaaaaatctcgtgtctaggtgtggacctatttctgtcttccctgcttaggatttattgggcttcttgaatttgtgaatttgtgtctttcttcagttctggaaagttcttagggagttatctcttaaaatgttgctgctgtggccggtcgtagtggctcatgcctgtaatcccagcactttgggaggccgaggtgggtgggtcacctgatgttgagagttcgagaacagtcttgccaacatgatgaaaccccatctctactaaaaatacaaaagaattagctagctgtgatggcacgcgcctgtagtcccagctactcgggaggctgaggcacgagaagtgcttgaacccgggcagcagaggtcggccgtgagccgagattgtgccacggcactccgcctatgcaacagagtgtgactccatttcaatttaaaaaaaaaagaagaaaaatatgtatatattgctgctgcttcattctgtctgtcttctctctctggtgtgacaattggatttttgttagacctactcatgctaccttccatgtcttctatttttcaagttttctatttttttgtgcctctgtgctgcattctggatacttttttttctttctttcttttctctttctctctctctctctctctctctctctctctttctttcttgggatggagttttgctcttgttgcccaggttggagtgcagtggcgtgatctcggctcactgcaacctctgcctcctgggttcaagccattctcctgcctcagcctcccaagtagctgggattacaggtgcccaccaccatgcccagttaattttttgtattttttagtagagacagggtttcaccatgttggtcaggttagcctcaaactcctgacgtcaggtgatccacccgccttggcctcccaaaatgctgggattacaggcgtgtgagccaccgcgcccggcctggatactttctttagctcctctgtacaatttaccaacagtctctccagccatatcaaatctgccattaaatccatcaattgaacatattattatttattatttatttattttttgagacggagtctcactctaccacccaggctggagtgcagtggcacgatctcagctcactgcaacttctgcaccccgggttcaagcggttctcctgcctcagcctcccgagtagctgggactacaggcgtgtgccaccacgcctggctaattttgtatttctagtagagatggggtttctctgtgttggtcaggctggtcttgaactcccgacctcaggtgatccgcccgcctcggcctcccaaagtgctggaagtacaggtgtgaaccactgtgccaggcatttttttttttttttttgtattttgtatagacggggtttcaccatgttggccagactggtcttgacctcctgacctccgcccgcctcagcctcccaaagtgctgggattacaggcatgagccaccacacctggcctatattgaacatttaaatagtttgaaaactgtgaaatctggcatatgtatataaaggtgcagaaaacattgatgtatgttttaagaagtaacgataaggtgaacacacatttaaccactactcaggccaggcaccccagcctccacagtcaccccagtcataatccccttctcccgctctagtgggaaccaccatcctggggtttctgttgccaacatccatgctgctctttagctttcctgcctgtgtagtcatccctacacaatattgtttagttttgcctgctcttggaatttatgtaaatggaaccatatatagtatggattttctgtctggtttcttttgttcaacattatgcttgtgaaatgcattcatgtttttcaaggctgtagttcattctcattgctgtacagtagtatgttgttgcatatattacagtttacttacactttctgggcaggtggtttgttgctagttgttggatattgagaacatcagtgtacttgcctcctgggaatatcgcctatgaatgcagttgctggatcatttggtaggtatatcttcaactttgtgatactgtcaagtggttttctaaggtggctgtagtacaaatttgcttcccgccagtaatgattgagagttcctgttgcgctatatccttgccaactcttattgttgttagtctgtctgagtttgaccaatctactgggtacatagtggtatcactttgcattttaaaaattgaggtataggccagatgcagtggctcacaccggtaatcccagcactctttgggaggccgaggcgggaggatcacttgaggtcaggagttggaaaccagcctggtcaacatggtgaaaccctgtctctactaataatacacgaattagctgggtgtggtgatgcacacctgtaatcccagctactcgggaggctgagccatgagaattgcttaaacccgggaggcgaaggttgtagtgagccgagattgcaccactgcactccagcctgggtgacagagtgagactccgtctcaaaaaacaaaaaagtagaaacggaacagaggctgcacctgagctgccccccacctccctctcctagctccttgctctggtgggctgggttccagctatgctgctcttgccatctttattttagaggtaagaaaactgagcctcagagcagtttattaacttgctcaaggtctcagagtggtagagccaggatttgaactgggctcttcgtcaaaggcaatgttaatcccctcaccatgtgagagactcattcttttgtgttacagtagaattttctgccgtagactgtcagctgtatgagatcaaagaatgtatctggcttctgtaccacgtggtaggcactcagagaaagtatgtgttgaatgaatgattggatgaatgaatgaacctgttaggaggcaaatctctctgcctaacccttcctgtctccctgggagtagcaatacagcaagctgtaagagttgacggaaataagcttattccatactttacaagaacagttctttataaatgagacccacaattggtaatttttggaagagaaaataggagtgcagtgcaaaaacaggcagatgtagaagggagtctggccacctgtgggtcttagtgaggcacacatgtagagcaaggagtcagacgctgaaaaggaggggagaggggccctgaagatgagcatcacctcctcagtctgtgtcgggcccatcttgaatgcacaaatcttgcgtgtgtaagtatccatgcatatgtggaagtgttttatggagtcataacgtgtccaattctcccacactttgcggctcacagagcaccgtattgtgatttcttgtttcccaacgtaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggtgaggccttggctctggggactggaagcagaggaggaaccgctcccaggagccacctatgggagggtgaaagggagccaggacaggagcctggagagccagggtgaggggccagttggaagagcaggtccatgcttcttttagcgactgggccctgcagtggggcgagccagccctctccctgcagtcccacacctgccttgacccttgctagcgaaaatgctccagcttggcagcccctgccgggtggttgcagcggcatagcggctggccctgaccctgtggtggcaggggacaacatgggggtggcaagagtccggtagacacctggcactagttagggaggtggcgtcctttggtcccagtcggctgggaaggtgggagtcaggaccggagtcgcctcgccagctctggtctcttcacatgtgctcctagctgagctggggcacaggccgggtctcagatacttatttcaaaaatgactgccttctggtgaatgctttctccgcaccgtgcagtagctcgattttctttttcttttttttcttttgagatggagtctcactctgtcgccagactggagtgcagtggcacgatctcggcccactgcaacctccacctcccgggttcaagcgattctcctgcctcagcctcccgagtagctgggaatacaggcgtgcaccagcacatccggctattttttgtatttttagtacaggcggggtttcaccatgttgaccaggatggtctcaatctattgacctcgtgatccgcctgcctcagcctcccagagtgccgggattactggtgtgagccacctcaccctgccctagctcgattttctttccctctaagataaggctagggcctaccaattggaggaaaaaaaaaaaaaaaaaaaaaaaggcaaacccaatctctcaacggattctctccattcctattgggaccgttctctgggtttccatgggccctcagggggtgccacattctgtccccctcgctgcagtctgtggctaattaacgccagtccctccagcgtcctggctagggaggcagcgattcccttaggtgagccaagattctcagcatttgcatgaaaagaagaactccgcagtccttttagtgcctgatgcaggggaagcggcgtgtgggaatcatcctctttagtttccccagggaaatcttgccagcgtttacatggcctaagaatctgttaaaggacaatcaaagaatattacagggcaaccactgtcaatgagatgactagtcagagtcacaggcgtctcttgcagattattttcataggacatggcaaccaaatctaaaatcttgggagcatcaaagacccttttgtgaaaatcacacttacccggtcagctttctattaagcaacagcagaacttggtggcagttacaaacttccccgtatgtttccaagccacaggggccaatgagaatgctgtgctcaggtaaactcttaacccctgtcaaatccgagtctttcgccccctcttgatacagcggtgactaccggggagcagggcaatacctctgtctctccccctctcagacttttgctgcaaattctagaagcctgcacttctgacccggtaccccccattggactgtgacatgggatgtctggttgtttgctgcagcagcgagcctacccttactaatgttcatcgtgagcagaaaagcaggtctacagggcccaagcaggtctacaggaggagaaagggctgctgatgatttttcactgttgtcacgggctcgtaactgagctggggcaccaggttaagcagccttgttctttggccctcagacgcctactttatggttggggaagcagagtctcacagaggcacaagcaggctacgtggctgctaagtgcggacctgagagcatttcaccacaccctggctgtgtggctaagttagatgcaggggacacaggagttcatggcattttaaaaacatatacttccgtaaaatcttcttcaaaacttttacatgatctggacacagaagtgtttcaaccagccaggctccctgtgactgttgcgtcccctctggtgcatcacaaactgagaatccatactgcaagtcctgtgctgtttatcacagttaaatccgtttgctttcaggagggctgttgtggtttttatcattatggtttctttttaatttggtctcggcatgtctctactgagagtggccatagccgagatacccagtttctaggagatccctgacccgtgggaaagttaggttcggatgtgtgtgtcaggggagccacagtgaggaggcagacgaaaatgcatgaaacagcagaaatgggctgggcgtgggggctcacgcctgtaatcctagcactttgggaggttgaggtgggcagactgcttgagctcaggagtttgagaccagcctgggcaacatagtgagacccggtatctacaaaaacatcaaaaaattagctgggcgtgatggcgcgtgcctgtagtcacagctactcaggaggctgagcgggagcggggatcccttgagcccgggaggttgaggctgcagtgagtcatgattgcaccactgcactccattctgggtgacagagcaagaccctgtgtcaaaaaaaaaaaaaaaaaaaaaaaaaaagaaatgtatgactcagatcgaagagatgttaggtgtgctgatgggaggcagaggggaagtctggaggcagcagggagctgattgagctcatcagctgtgcaacagcgaagcccagaacggaagggcggggaagcttccggggctgtgcctgtattaaggtcacagggtgtgaagtgatcccacaggctttcctgcgggggttgtggattggctggtttaaagaaaacatgcacgaggaggaaactgatttacatgactctggtgttgagcattaggtcttatcgtggtcagcagccgtgggatgtgttgggttttgggtcagtgaggcgaggaccacgtgggctatgtcgcaaacaatcacatgacagggagggaggggtgttatctagggcaaaggtgacagggtacaactgctaaagttggatgctgaggcagcaactgtattaaacgcatttatgacaagggcttacttaaaaaaattgatgtagaattcacataatttcacgtaatgtgaaattaaccatttggaagcatgtaattcagtgcattaagtacatctgcagtgtggttcaaccatcacctctgtccggttgtctaacattctcatcaccccagaaggagacctccagactcactacacggtcactcctagcctcggctccaggcgttccctaatctgctttctgtctccgtgggtttgcctcttctggacttttcatataaatgggaccatacgatatgtgggcttttgtgtctagctcctttcactgttttcaaggttcactaatgttgtagcacgtatcagtacttcattctcttgacggctgactaatattccagtgcatgggtagaccacattttgtttatctgtccatcagcggatggagatttgagttgtttccaccttttggctattgtgagaagccctgcgctgaacactcagatacatgccagttgtttgaacaccagttttcaattctttggggtctataatcaggagtagaattgctggaccccgtggtgactccaggtgtagcgtttagaggagtcttcccacagcagccgcgcagctccatcttcccaccagcaatgcagaaggcttccagttgcctcacatccttgccaacatttgttgttatcctttttttttttttccaacagatgtaactgtgaagtggtatctcattatgagggctggctttcttttttatttttcctgagtctttggataggcaaaagttctttctttctttctttctttctttctttcttctttttctttttctctctttctttccatctctctctctctctttctttctttttctttctctctttctctttcttcctttctctctgtctctctctctctctctctatctctctttctttctttctttttcttcagggtctctgttgcccaggctgcatgcagtcatagttcactacagccttgaactcctgggctcaagcgatcttcctgcctcagcctcccgagtagctgggagtacaaagcatgtgccaccatgcctggctaactttttaaaaattattattatttgtagagatgggatcttgctatgttgcccaggctggtcttgaacacctggccacggcctccccaagtactggggttacagatgtgagccactgtgcctggacagttcttactttttaatgcattttttaattgattgtggtaaaaacaaaaaacccacaatatattctttttgattctgcgaagtgcagggtctctatcacagcaacaattagactcaggaggcttggggctggccctggggtctcctccttcatgaggtctgggtttgtaggtccttgcagaggacgttcctgggtcctggaaggactgtgactgcttccgctggagttgcttgaggcccctggtaactctcctctctgtgtgctgaggagaagcacgggcgtcgcgaacttgatgattctggatggaagggtctttgccaagcttccctttctttcttgtggaaataggaggagcttcagatctccgagaagatgcacagtgagcggccgacctcctcagcacaagccagtctcctgggggaccagaaggccccggtccctcagtttcttcgtgggtcaggaggaaagaaggcttgagaaactcagaaaacgttcattggtagaagagatggcacccaaggaaggcatggggagccttcaagtaaaagtctcgactggccaggtctcatctgggcaccttgcatgcagagttgcaggaggccccctctagcctcctaatgagccagggggctctgggagggtcttgggggtccttccccatctcttacaggatgcgcagctgacttctgcttgatggtgaaaggcagtcaggtttcagtcttggccccgtagacagggcatggacaagtcctggagttgggggtatggtgccagcaaaaccatctttactctctggggtccatagccagtcccagcctgcccagccccaccctcctccttcacctttgtagcccgagtggtcaatgcctggggtagatgggttgctgggacatctttgttctttgttggatgagtaaaatggtcctgggagaaaacccgactgtgaggagcacattgcttcttttttttgtcttttttatgagatggagtctcactctgtcccccaggctggagtgcagtggcacgatctcggcccactgcaacctccacctccccggttcaagcgattctcctgcctcagcctcccgagtagctgggattacaggcacacgccagcatgcctggctactttttgtatttttcagtagagatggggtttcgccatgttgaccaggggtctcgaactcctgacctgaagcgatccacccgcctcggcctcccaaagtgctggagttacaggtgtgagccaccacacctggctggaggacattgcttcttgccccatttctagttccctagacctgccttggcatcaactcattgaaggctccacttggtgacaaggaaccggcttatttggaaacagggtcgttgcggacgtgatgagttagatctggatgaggtcattctgcagaggggtgggccctaatgcagtgtgacctgtgtcctgacagaaaggggagacggagacacggacacacccagagggagagcgccgtgtggagacagaggctgaggccgacctgccgtggcagaagccaaggaagcccgcaggtgggcagcagagcagaagctgggacagaggccccgagtggaggcgccttctcggtcctcggcaggagcccgcccagcctgggccttcctctcggactgctggacccccagccaggagagaggccatctctgctgggaaagccactcaaagtttgtaacgctttgtgatggcagccagaggaaactcccacactcagcttgtcctttaggctctgctctgatgtcctctcctcaaagggacttcccaggctaccacgttcaaatggcctcttcttttattcttttggaagcggggttttttgaagtaaagtttttgtttttttgttttttttagatggagttttgctcttgttgcccagaccggagtgcaatggcgcaatctcggctcactgcaacctccgcctcctgagttcaagcgattctcctgcgtcagcctcccgagtagctgggattacaggcaggcaccaccacgcctggctaattttgtaattttagtagagatggggtttctccatgttggtcaggctggtctcgaactcctgtcctcaggcgatccacctgcctcggcctcccaaagtgctgggattacaggagtgagccaccgcgcctggcctttttgaggtaaattttatgcagtgaaattgcatttaagtttaggcatacagtttaacgagttttgacaaaggtttacacctgggcagctaaaatcccaataaagagctttgccaccaccccagaaagtaccctcataccctcttccagtgaatgcccgtctcccataattggccactgttccggtttctgtcactctagcttcatctccttttgaacttcacgtaagtggaatcgcacggcacgcagtgctttgtgtctggcggctttcgctccgtggaattgttttgagatccacccaagctgtgtgaagtgagtagctcatggcttcgtattgcttggcagccttccattgcatggagacgccgcaggttgcttatgccctggtccgctgccagttggggcgactgaataaagctgctatgaacgttctcgcacaagtctttctgtgaacatatgctttcatatatggaattgctagataacagggaagtgttatgtgtcttagtcccactttctgttgctgtaacagagtaccgcaggctgggtggtttataaagaaaggaagttcaatgtcaaggcgctggcagctggtgaggacctttgtacggcatcatcctatggcggaaggcagaagggcaagagggcgtgagagagcgagcgggggccaaactttcatgataacaatattaatattaatcgcctcttaccagtcccaccccttaacaccatcacatggccattaaatttcaacacgagttttgggggggacatgtaccccatagcagtatgcttaactttttaagaaagaggaaggccgggcgcggtggctcacccctgtaatcccagcactttgggaggctgaggcaggcggatcacctgaggtcgggagttcgagaccagcctgaacaacatggagtaaaccctgtctctactaaaaatacaaaattagcccggcgtggtggcacatgcctgtaatcccagctactcgggaggctgacgcaggagaatcgcttgaactcaggaggcggaggttgcggtgagccgagatcgtgccattgcactccagcctgggcaacgagtgaaactccatctcaaaaaaaaaaaaaagaggaactgttttccgacatggctataccattttacagtcccgctaggagtgtataagagttccagttgccaacgtttggcaagatcagtcttttaaatgtcagcctcttaagttcagccacaacttggtgaaattagactccaaaatttcatcaccctagcccatgttctctcgaccttggcactgtcgacattttggaccgaatgattctctgttgtgcggggctgtcctgtacattctaggatgatgagcagcatccctggtctccacttacttgatgccagtggtgccgtgaattaattgatgctgccgtgacaaattgcccccaacttcatggcttaaaataatagaaagttattctctcgcagtcctggaggctagaaggccgaaatccgtttcactgggctgaaatcaggcgaggaggacacacactcattggaggctctaggggacaaactgatctttgcctcttccagtttctggtggctgccaaattccttaattttgtggccacatcattcctgtcctgaaggccagcatcttcaaacctgtgttctgtcttcacatgacattctcgtctgtgtgtgtctaatgtccttctgcctctctctcatacatgtgattgcatttagggccaccaggataatctaggataatctttgcatctcaatacccttaaactcaccacttctggaaagcccccttttttggtcatagaaggtaacattcacagtttccaaggattatgacacagatatcttttgcggaggggctttttgtttttttcttttttagacagagtctctctctgtcacccaggctggagtgcagtggcacgatcttggctcactgcaacctccgcctcctgggttcaagcaattctcctgcctcagcctcccaagtagctgggactacaagcgcgtgccaccacacccagctaatttttttgtatttttcatagagacggggtttcaccctgttgctcagggtgttcttgaactcctgagcccaggtaatctgcccaccacagcctcacaaagtgctggggttacagatgtgagccaccgtgcccagcctaggggggcaattttagcctaccgtgccccacctatttgtaacaaccagaaatgtctgtccagagattgccaaatgtcccttgtttggggaggggggggccggcaaattgcccctggttgagaaccagtatcctagcccatgagactagtgggtgtgtgaccctgcctctgacgattaatgatgctgaaccccttttcatgtgcttatcagccaataagtctttggcttgttttcaacttggattgtctttttattgttgagttgtcagagctctttatatactccggaccagtctttgtcactcccctactttttcctttctcgcagcactcaccgcctaaactgctctcccttgtgtaggtattcatttgtgttgtattgttctcgtcaaaatatcagcacattcaggtcggccactgtgtctgagtgactgcccaaagacatgttggcacatgatggctgttctgtgagtacctgtttcatggatcagtctggatgctgcttttcctcccttcctgaagggacccagctcgccctctgggctgcctccctcctccatgtatgtcagaactctatctgctgtgtcttgggaacatcagggcagggccaggagggctgattctggatttaggcctggcccagcctcctctctgcaaggtatttactgaatgaccttggacgaggtgcttcaagtttgcaatcctcagtttccacatctgtaacatggaggtaaaaatgatcccactattgttggaactgttgtgagaattaattaatacttgtgtgtaagccccaagtagatgctgatggaactgaatttacaattcctttctgcttcctatgtgcaaactaagtccttgaaagatcgtaaagaaaaatggggccagatgtggtggcttatggctgtaatcccagtgctttgggaggtcgaggcaggaggattgcttcagcccaggagtctgagaccagcttgggtaacaaagtgagaccatatctctgcaaaaaattttaaaagtgttaaccggacttggtggcacatgcctgtagtccctgctacatgggaggctgagacaggaggatcgcttgagcccgagagttttatgttgcagtgaactatgattgtgccactgtgctccagcctgggtgatagaggacagagtgagaacttgtctcaaaaaaaaaaacagaaagagagagagagagagaggagagagagagagaggagagagagagagagagagagagagagagggagagagagagagagagagagagagagagagagagaaagaaaaagagaaagaaagaaagaaagaaagaaagaaagaaagaaagaaagttgttaatggcttttttttttttttgaggtggtgtcttgctctgctgcccaggctggagggagtgcagtggcttgatctcagctcactgcaacctctgcgtcccggattcaagtgattctcctgtctcagcctcctgagtagctgagattacaggcatgcaccaccacgcccagctaatttttgcatattttagtagagacggggtttcaccatgttggccaggatggtctcgatctcctgacctcgtgatccgcccgcctcggcctcccaaagtgctgggattacaggcatgactgcagccggccaatgtcttggaactattaatagccatggtggttgcacaacaccacatgtgctaaatgccgctgaattgttcaccttaaaataattcattttatgttacatgaaatttacctcaataaaaattgaataaaaaagaagctactcaggtgccgagtaggcaaaactttcactcttgctttgtatttctggctgtatccacaagtgggcagtcgtgaaattttcttatagcctcctgtcatattgaaaacgcccggaagtgaatatgccaggtctccatgtttttctttccctcctggacacgaggtccttgggggcatccagaccctagctcctctgtcccaagactgttctggtatgtttcgctttcagacgaggcttggagataacaggctatggttcctagaggcttcagtgttgctctgtgacctctcagccccagggatccagcctcgggctgactttcctcaaggtatctgcttagggctttgttgcaggctggggtcgtgttaacttccattttttccccgacttctcctccatgtcacagcatcctgcatcttgggatctctgaggaggtctgacctaaggtctgatctgctctctgaactggttcctctcatccctattgcgttgaagcaaagcacagacattatatcagttcatctgtaaatatttcagtgtgaacctgaaatatggatcattttgttaacatagcctaaataccataccaaaaatgttttaaaacaagtccacaatgttaaatatgcagtcactgtcaccttattgcctcacacatgccatcattcctttttatttctgaaggaattcttttttttttttttgtgagacagagcctcaccctgtcacccaggttggagtgcaatggtgagatctcggctcgctgcaacctctgcctcccaggttcaagcgattcccctgcctcagcctcctcagtagctgggattacaggcatgtgccaccacgcccggctagtttttgtatttttagtagagacggggtttcaccatgttggccaggctggtcttgaactcctgacctcgtgatctgcctgcctcggcctcccaaagtgctgggattacaggcgtgagccaccacacccggccctgaaggatattttttgctggacatagaattctaagttggcacttaatttttggaaataataagcattttgaacaaatcattcccttctgacttccatggtttctgttgaaaaggcagctgccagtcttcttgttgctcctcggatcacagttttgttttcctcaggctccttttaagatcttttgtttttctttgttgtttagtggttttgctatgatgatgtttggcgtgattttctttctctcttcttttttgtgccgctgactctccccttggtgtgattttctttgcattcatcctgcttgggcttcgcattgctacttgggtttatggcttgatgtcttttgtcagttttggacgttttcagccattatattttcaaatagtgactctgccctagtctctcatttttccccttctaaggccccagttacatgtatgttcaacctttccactgtatccctacatcctctgggttcctgtgtgagccgtcctggcgaatttcctcctgctttcgcttctgttttgttggctcttcccccagctccccagggccccttgctttggcacatttgctcagagtgagctcatccatcctggccacatgcaccgattgcacctgggctattgacccctcctacagctgtttctccgtctcagacttttcctccaagttgtgggccatgattaggctctagctcaatttgccaaaagcaaattctcagaaatgaccaagaatatactctttctggctgggcccaatggctcacacctgtaatcccagcactttgggaggccgaggcaggcgggtcacctgaggtcaggagttggagaccagcctggccaacatggtgaaaccctgtctctactaaaaatacaaaaaattagcccggcatgatggcgcatacctgtagtcccagctactcaggaggccgaggcaggaaaatcacttgaacccgggaggcggaggttgcagcaagccaagatcgtgccactgcactccagcctgggcaaatagaaggagatccgtctcaaaaaaaaaaaacaacaacactattttgaaaaaaacaataaagtttagaacactttgtgttggagagggtggtcttaacaccttcggtctgtcttgagggtgtctgggttgactggtcatcgttttgtgttcataagagcattctccagagttgtccatttgcttctgtgactgtaggaggtggagagaggggggtccttgaccaaggaagagaagggagcgcggctgccagagggccaggagatgggggccagagagaaggggagactgagagaatatccttatgaaaatattgtttactgacatctgaagagactcttcaagaatgcactgaagaatatcttcatgtatctttaccaatacattgatgaagattgacttcatattcctgaggacagttaaaatcttgaatgttctcacagctagatcattcatgtaaatggaaagacagtaatgaggaatctattttcggggtgaccatcctgccgacccactccccctctctgtgagcagtggcctagtccatgttgtccaccgactctcttcttaacagggacctggggcagagacaaatggaatattccttgaaatgctgcgaggaaccagcttttgacaaattggctttcaacaaatgagctgtcagcttattcagtgcccgggggatttctccgtgtgggtgttggtcaagtccttggagtgggaccgaatagaagtcgtcactgttttccccgtctctgtcagcaccaccgtttagacctcctgcacctgaggcctgccgccaccctcctgggcctcctggggcggcagccctgccagtctatgggttccatcacgctctggtgccttctctcttctacgtaagcggtggtgccagagccccctcactggccccctggcctctgtccttctggcccgttctttgtggtgccaaaaggggaacttcatagaagtttttaaattatgaagtatttcaagcaaagggaaaatgtaaggataacataattaacagccccagctttctgaaatcttaacatttgccatattcacttcaaatcttatttttttaggaaataaaactttaaaatattctgttgaagccctcattacccctttccagcaccatctcccttccttgctattctggccttgctatactggcctcaccattctcatttgggtgcttatcttttccatgcatggttttatacttttactacttatataattatatacacaacaggtagtgattgttttcttttagagatagggtctcactctgctgcccaggctggagtgcagtggcgtgatggcagctcactgcagcctcgaactcccggactcaagaggtcctcctgcctcagcctccagagtagctgagactacaggcgcgtgccaccacacccagataattaaaaattttttttgtagagacagggtctcactgtgttgcccaggctggtgttgaattcctcctggcctcaaacaatccccttgccttggcctcccaaagcgctgggattgcaactgtgaaccactgcgcctggcctgcttgtggttttttaacagctctattgagatataatttacatattataaaatgcaccattttaactacatttcaatggtttttagtaaatttactgagttgcgcaactattgccatgattcacttttctctttttgtttaaataacggctctattgagatataattcacatcccataaaattcaccaatttaaagtgtacaattcactggtttttcgtatagtcacagagttgttcaaccatcaccactatctaattccacaatattctcttttttttttttttgagacggagtctcgctctgtcgcccaggctggagtgcagtggtgtgaactctgctcaccgcaagctccgcctcccgggttcacgccattctcctgcctccgcctcccgagtagctgggactacaggcgtccgccaccacgcccggctaattttttttgtatttttagtacagacggggtttcaccgtgtcagccaggatggtctcgatctcctgacctcatgatccgcccgccttggcctcccaaagtgctgggattacaggcgtgagccaccgtgcccggtcctacaatattttcaccagccccaaagcaaccctgtactcattagcagccactgcccatcccccacccccagcccctggcacccactaatctgctttctgtctctatggatttgcctattctggacatttcgtaactaatggaattgtactggaatctgtggtcttttgtggcttttcaatccttatagtcaccatgtttctatagagtaactgcaggctaaactgcaggctagacttcgtgctcaacactggtcctgggggatttgcggaactgaagagcacacacagatagttcacactgtcatttctacaacttctagtctgtggctatttttgtaaagctgttacaaaagagtaactacatataaaatatatatgaatattggtgtgcgtgtggctggtgtgtgtttggggtgttcccaggcagacctggagtgggaggcaggctttccctagagcctggggagcggggaggaaggcagaagctgaacccgaatctagtctaggtcaggaccgctcgctgttggcatgagctctggatgaggtactgaaggaatctcactttctcttttgctcccaaggcaagcattgatggaagaacaggtgaatggtcgcctgcagggacagctgaatgagatttacaacctcaaacacaatctggcctgcagcgaagagagaatggcctatctatcctatgagagagccaaggaaatatgggtgagaacctcctgggggagccttgcaagaagactggagggatgagcgaatctattctgatacccccaaaccaaagcaagacacgggtcctcgagctgccccctcctgagggttcgatggccacacacatttgtttcagagctagcagcatctgatctttacactcacgctccgcttcccaccatctggcttagctgcttttgccactctggtgctgcagtgctcacccgtgagcctctgactcgggagatctggggtggagctgcttctgctgcggctgcaggtgtagggagcgccctctcagaacccctccttagacctggcttccctctcctcacttttccattcccatagcgcccacccccgtccctgggtagctgtgtcttgaccaggtcctcagcttcgggagacagtggatgggggagtgcagccgggtcagatgaagctttccctgttgctggagagcctgcgccctcccctctgccctgaatgtgctctaggctctctgcttccctcctcgaatacccactccacagtgctttctgctcacccctaagaactcaataaacgaccacaactctgtgctgacttctggtgcgtgcattttcgtctcctgcaggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcac

SEQ ID NO: 4087 - DNA, 6081 bp, human
acaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccgagttagcaccgtgcctgggccgggggtcctgggtcaccccaccctgcatcaggactggctgccggcccttctctccaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtaagccccccgattcctcctggcctcacccgcctcctgcccctaagctgctctgccctcaaatgagtccactgagactcctaaactatttttccaaaaatccttagagaagaggattttacccctataagaaaatattaagatccagcgatgagaatcaggtgattcctttgggactgtaccagtggctgcaggttcagccccagccccgttgtcctcagctctgtgagacgggaaagcactgccactccctccctggaggagtccactaagggaacagaggtgtgccttgccccgaccctggacagttctccccggggtggaaaggctgcctttcccacagagtagagtggagcagccacatcagcaaatgacacctgcaaatcaaggcgtgtttttatgaggctgccaccggagtacccttgtccttttcataggctgtggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccggctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatggtcctggcattctgcttctgctggggaccatacgccttcttcgcatgctttgctgctgccaaccctggctaccccttccaccctttgatggctgccctgccggccttctttgccaaaagtgccactatctacaaccccgttatctatgtctttatgaaccggcaggtaagcaacaccatcagcagatcccactcaaaataccgtgtgccctagaagggtgcagtgatggccccacctggaatcatgtctctgataagaagcccgcggagcatctgggggaccctccagggaaatgaccgggaaaggctcagcgtgtgacccagccccagccagagctccggctggcccttagcagaaggcttaggtgtgccctctggaatcctttatagtctcggcctgagggtggcatttcccaaagcgtctgtgtgccgtgtgctcttcccttccggtggccctagaactatggctgccgagcttcaggggctctcctggcgttcagacgctctaggagttggtgagccctaggtacatccaccctaggtgtgcccctcttctgttcagactcgacccttctcaaccttcatctctccattttcaaaccgtaacctctggaatttgtcttcctataagaacaaaagccggccctccttggctacactgaccaagagttcaagagctttcacgagttcgtgggttagttcaggggggacgtgctgtggtcctgcccagaggcagcctccttagctggcatattgggcctcagcagcaagctgctcacacacctaaatccccccacctcctgcaggttacaggcttcattaaagcgcagctgtgatgtgacttgatggtggccagaaaggtgtgcagaggcctcccatttcaccaggcccagtccatcccttccactgggctcttccttgcttctccatcttagagccactcaatggctccagcccctttggctcagctttgactcacacaagccaagtctgcagagttcattaagggttcattctctctggtaacttttaaacagtaagtaggaccaggcctgcagtggatttccgggaactcgctgtagcacactgatgcccagagtgtagttctatccctgacccctgtttcctgactttcatgaggatcttttttaggtttctggaatcctaaactatcttgccaagtactgtctttactggattatttccattctcctttccagaactccccctggacagggggagacagatgtctgcacttctggacctcaccaggcctcgaactttgcttttaccctttccacataattatcctgtcctgccacattctgagagaattttctggaacgcagttccatgaagacagcaaattttgctcaggacagagtctggcacacagtgggtgctcaagcagcagctgctgaatggattcctcagccctatctcccagctcttcagccgagctgattctgctgtttgtcccgtttcttatgttattaatttcaaccattatattttttatttttgagagttttgatgatagagggagttagagctagtcaagagtaggcctgaaatatttagaaaatgcctttggtctgggtcctcaaagcattgtggttacttcagtgatgacacaggacatgatttgagacattcatatggcccagatctctttggggtgaagcagcaaagacagacccctcctggtaccggaagacgcttggctggagagatgaggtaggggctagattgtcattacctaggcctcaccttgccccagatccatggactggaaaaaacatgacaaccacatgccttttcattaatattcctccgagccgctcaccagacagtctggggacaggtcaccactgccccttagctgtcactgtggatgagtgtcatggggctgccgtcacaaactaccacaaactcagtggcttcaaaccacagaaatggattctctcagggttctggaaatcttgagtctgaaatcagggtgttggcaaatggaaaggttccctatggaggccgggagggagaagcagctgcagggctgccggcagtctttggcgttccttgactccaaggtgtgtcaccccagtctctgccttcatcttcacgtggccttcttccctctgtctgcgtgtccgtgtccaagcgttccttttcttatcaggacaccagtcattcgattagggcccaccctgctccagtgtgacctcatcttaacctgaacacatcttttgggggacccacttcaacccagtgtagtcaccatcaactgctaagtcagatgacatccccgcgtgtgagggagaaataatccaagccttcctccatcccccatgggattcggaatgggtgaagggaaggctcgggcacgtacattcagcacagtgctccacccttccctgctctgctcaataacgctttctgtccttccagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgc

SEQ ID NO: 4088 - DNA, 10845 bp, human
tccatagccatggcccagcagtggagcctccaaaggctcgcaggccgccatccgcaggacagctatgaggacagcacccagtccagcatcttcacctacaccaacagcaactccaccagaggtgagccagcaggcccgtggaggctgggtggctgcactgggggccaccggccacccacctgccccgcccaagggaatctctcttctgcacgtccccaccagcagagaaggctttctcccatagcttttctgatgacatgaattggggggtcctctccaaatctagaaggacaccataatatcgaatatgcattctcaagccacacaggcttcccagcccctttgagaatccgaggccggggaagagtttatgtgctctttctttgtggcccgtagatgagtgtgttcactgctagcgaatgacctctcattccacggagtccctcagcttcctggggaagagctgggtctgtctttacatttgaagccgaaaggaggcaacatactgacacacccaagggaggcgggagggtggggaagacagcagcagagggcaagaaacttctagaacttcagggtcggcaaagcctgtagcagtcattttgtcaaactccatgatggggccacttggcttttggctgcacacctctgggggaagaggctgcattggcgcccagggccatctttccattcggagccgtcctgggagagagggctcaggcccaacagaaagctgaaagctctcatcagggcagcccgagtcctgccattgggagttgcccaatccgaaagttttgcacgcaggccctcaaagaagctgaagacaccagtgaccgccccactcctggccctctccccaggtccctcctccaaaccaaattcctttggtgccttcaagaacatcgtgcaggccgggcacagtggctcacgcctgtaatcccagcactttgggaggcagaggcgggcagatgacgaggtcaacagatagagatcatcctggccaacatactgaaacctcatgtctactaaaaatgcaaaaattagctgggcttggtggcgcatgcctgtagtcccagctactcaggaggctgaggcaggagaatcgcttgaacccgggaggtggaggttgcagtgagccgagatcacgccactatgctccagcctggccacagagtgagactcttgtctcaaaacaaaacaaaacaaaaaacaacaacatcgtgcaggctgtggtttccagaagccacgccagctccttgattgccaataaacatcccgctgtggggtggccaggaccgagtgccaattagtgacagagtgcccagaccaaaccggatgaggatcttgcagttgacctcaacatgactgtgcccagaatttccttggtggcaatgtcaacagtctcttcctagatgcccccagacttcatcaatgcatgatgcttcagtgcactcttttcaaatgtcggggtgggtttttttttttttccacaaaacttcaagcatctactaaagtagagggaggagtgtaatgaactccggtacccatcactcagcttccacggtttcatctcatttcatctgtgacccctccactaccctttcttcctgattcttggaagcaaatccaagacatcacacccttccctctgtaaatctttactatgttcctctaggagaaaagggctcttctcaatacataaccacaagtcatcatcacaccgacaagtgtaacagtatttcctgaatagcttcaaatatcctagtagtgttcaaaaaatgtcatacgtattttcagtctgcttgaatcagggctcaaataaggtccacacattcagattgactgatatgccttttgactacctttgaatctagaggttccctttctatctccctgcaatttatttgtggaagcaagcaagtcgttcatgacgtagcctaacaggcccctctgacgttgttcattatgatttttctgtaaattggtagttgatctgaggatctggccagaggcaggttggatttgttggtgtgttttggcaaggagagtgtctcttttctggggtgttggcagctactgaaactcaatgcccagaccaattaaaccactggggatggaaaatgacggcattcggacaccttaccctgccttcacctattggtgaccaaaaccttaacatcttcacaggtcttcttaccctgagggtatatgccactaggttgtgtagtaaaccggtgtgtttccagtcccttagaatagtccctctctaagtgatatgccactcagtggatatgcatttagcttcatttcttttgttgctgattttcagagattgctctgtaaatttaaacttttattttactttattttattttttcgagacagtcttactctgtcgcccaggctggagtgcagtggcgcgatctcagctcactgcaacttccgcctcctcggttcgagcgattctcctgcctcagcctcccgaggagctgggactacaggtgcccgccaccacgcccagctaattttttttatttttagtagagacagggtttcaccatgttggccaggctggtctccaactgctgacctcaagtcgtccgcccacctcggcttcccaaagtgctgggattacaggtgtgagccaccgcccccggccacttaaattttgttttataattatgtaataaaacagttaaaagtctcaaattaaaatctagaaaagaaggtgtatttgaagaagtctggcttctctgcgccaccaccgaccgccccttccctacctgcctgtatttcctcgaatcactttgcctgggagctgactttgattctcttgctcattgcttcatgaaattcagttccagaactttcaggagggaggggtaggccatgacaccagctctagttacactggtggcagctcctgtcccctcccccactgctgctgggacctgttctctcctttgcccccttgtccctgcactgcccaatttggaccgcaagggttgccagggaagggcactggctgccttgttttcagaggtcgtagcacctagattgctccagccccttgcacttgcctgcaggccagagtgtcccaaaccctcccagtctcagctgctcttccccagttcacccaaggtacttcccagggaagagctgccgacagtttgggggttctctgttcttaggtccatcagcaaccccattgctcccctctgcttccttctgcacggagactgacgccatgcaggtcttcaattgtcaatggtctgtccctgctgctcatactgggggttcctggggagccagtgccaggtatcgggattgcagacattgtctgtgggtttccagaagctccttgtgttaggaacatatggggcccgtgcacagagggcagcagaggccttgtgggatccagctgtgctaggggtgagatttatctgtctctcctggccatagccaggaaatccccatttttcttaagctagcttgagttgggcttttctaacacacagctaaagaatctcttgataaaccttgggactctccatgaggccttatatggcagcaggtctgtggcttgcaatcccttcaagtaatctgccaaaaacaatgttatgacgaaggtccttccaacacaaaaggtgtagagccctagcaaactcctacagaagaaaaaggagaaataattcgtttgtagtcccagctacttgggaggccaaggtgggaggatcacttgaagtcaggagttcgagaccagcctaggcaacatagccagaccccatctctacagaaataaaaaaaattgccattgtggtaatgcacggcttgtagtcccaggtactcgagaggctgaggcaggaggatcgcttgagcccaggaggatcgcttgagcccaggagttccacgttgcagtgagctatgattgtgccactgtactccagcctgggtgacagagcaagactttgtcccaaaaaaaaaaaaaaaagaaaagaaagaaaggaaaagaataaaagagaaattaccatagattgggtggcttttaaatgataaatttatttctcacagctctggaggctggaagtcagggtgctagcgtggtgggctctggcgaggaccctcttcctgactgcagattgccaacaactcattgtatcctcacatggaagaaagagagctagagagcactctagggactctttttcttgtttgttttaattaaaaaaaaattttttttacatgggcatgccatgttgcccaggttggatttgaactcctgggctcaagcaaccctccagcctcagcctcccaaagtgctgggattacaggcatgagccaccattcccagctaatttgggctgttcccaaaggctcaagtgatcctcccacgttggcctcctgagtagctggggctacaggcgtgagccaccatgcccagcttctaggacctcttttataagggcactaatcccattcatgagggccccactcactctgcacacatgacctaaatgacctgccaaaggccccacctcctaataccatcaccttgggggttgggatttcaacacagaaatttatggggggcacgtacattcagatcatcatgaacagtaactcctatgtgtgacagaaggtgacagaggtgggtagtggtcttcccctcaagggggtgagttgccactagctggggaatcttctggaaggcaaatgcatatgagctgggctttacaggaggcaagcgtttctctatggaagggcagaggactgtgggaggtaggaggtggggctggggcaaagggaagaggggagcagggaagtggggtgactgcacactgggagtggggaatcagatggaggagacgatgaggagttctgttaagttcaagatgccagtgccagtgaccagcgggcgatggtctctggcttgagggacaggatggaggggagactgtctgaggatggacaaagctggagggaaacagccaattgcaaaggcaggagggcggaagggggaggggagaggtgggatcagcactggtatagacaggcggtgctgcagcccagctcctctctctcctctgcctcctgccctcaggccccttcgaaggcccgaattaccacatcgctcccagatgggtgtaccacctcaccagtgtctggatgatctttgtggtcattgcatccgtcttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtggtaagccagtcggggcccaggctcggcggaaaccactcattcaccctgcaagcccctccggccacctcatgatgatcggggcccagctgctcctgtaggcctgtctccctccacatctgcgcctcacatccatatactgaagggttctggaggcttccatctgaacactcacattaaattcagctcccttgagtcaaacataccctgagttcctactcttgagtcaggctctgcccggggacagccagtttggagctgtggggctggtgtgggaggagacagatacagagctagacaaccccagaacagtaggggggcggggactctgggcaccctggacagaactcccctgcaattagggatgcctgctctttcagctcgccagcatctgcttttcccggaggagacacaattcccagatcctctccccatccccatcactaatatctctgtgggccactattccgctcaggtcaggagacagtggcggagaggtactagcgtgccaggctctgtgctaaggagggggccctatagccagacggcaaccacacagtaccatcatcagtcctctcagacaagaaggggcctggggcaggtggtggaggagcggctgggagcagtttgtggttcgagtggatagagtaccaccaagcagccgtggctgctggacacgaggtgggcaggcccaggtctcagaggcctcagacgtcatgcccaggagctgggactttctttcaggaggaggagaccccacatccagcagcagcagctcctgctcttgcctccccaccactcttagcagcctccccaaccccaccccgttaactgcctcaaattgtacccacgatggcccagaccagagagggtgcttgtccaagtcccggcactaccccgatagtgtagaaggggagccaagggaaggtcaggcagagaaggtccatccccgggtccgagtgctctctgcagcaggcatggcctcggtggtcacacgacccttcccgagtgcccccctgcatctccgcccacgtctgtctccgtttctgccatggtctcccgctcacccttgcctctgctcatggtctgttcttgggtcagtcaggtgccaagcagccagcacttccccaccacttttggtccacggatgcccttggccatctgggaagcctgtggaccccatctcaggagaatttttgcaaacgcataaaatgagacccataggattacaaaggcagcaaattatactgaaatacagttatcaaagtattaaacattcatcagtaacatagtctttagttaaaagcatttactggccaggctcatacctgtaatcccagcactttgggaggctgaggtgggaggactgcttgcctccaagagtttgagaccagcctgggcaacatagtgagacctcttctctacaacaaataaaaacagctgggcgtggtggcacaccagtagtcccagctactcaggaggctcaggcgggaggatcgcttgagctctggaggtcaaggctgcagtgagctatgatggcaccactgcactcagcctgggcaacagagtgagattctgtctcaaaaagtaaataaaaataaaagcatgtgttaaacgtattagtgacaccactcagtattaaggtattaaataacaggatcccgcctgacaaccactgttatttcagagtagtgatgaacataagtggtattcgaactctctgccacctctatgaattgacaggaaaacatctgtgacctctcttgctgaccgagtcacgggtactgctaatactgccacgttcataatggaaggaaatgtccagtgtctgttcgaggttggtggaaagaaagatgtcgttttttccacctcagtccgtggagccctgaattctgtgtgcagacgtttggggtctaagcaggacagtgggaagctttgcttcccacctttgctttggctcaaagccctcatctgtctgctctccccatagggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccgagttagcaccgtgcctgggccgggggtcctgggtcaccccaccctgcatcaggactggctgccggcccttctctccaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtaagccccccgattcctcctggcctcacccgcctcctgcccctaagctgctctgccctcaaatgagtccactgagactcctaaactatttttccaaaaatccttagagaagaggattttacccctataagaaaatattaagatccagcgatgagaatcaggtgattcctttgggactgtaccagtggctgcaggttcagccccagccccgttgtcctcagctctgtgagacgggaaagcactgccactccctccctggaggagtccactaagggaacagaggtgtgccttgccccgaccctggacagttctccccggggtggaaaggctgcctttcccacagagtagagtggagcagccacatcagcaaatgacacctgcaaatcaaggcgtgtttttatgaggctgccaccggagtacccttgtccttttcataggctgtggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccggctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatggtcctggcattctgcttctgctggggacc

SEQ ID NO: 4089 - DNA, 13526 bp, human
gtgaccctcaggtgacgcaccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggtgagccagcaggcccgtggaggctgggtggctgcactgggggccaccggccacccacctgccccgcccaagggaatctctcttctgcacgtccccaccagcagagaaggctttctcccatagcttttctgatgacatgaattggggggtcctctccaaatctagaaggacaccataatatcgaatatgcattctcaagccacacaggcttcccagcccctttgagaatccgaggccggggaagagtttatgtgctctttctttgtggcccgtagatgagtgtgttcactgctagcgaatgacctctcattccacggagtccctcagcttcctggggaagagctgggtctgtctttacatttgaagccgaaaggaggcaacatactgacacacccaagggaggcgggagggtggggaagacagcagcagagggcaagaaacttctagaacttcagggtcggcaaagcctgtagcagtcattttgtcaaactccatgatggggccacttggcttttggctgcacacctctgggggaagaggctgcattggcgcccagggccatctttccattcggagccgtcctgggagagagggctcaggcccaacagaaagctgaaagctctcatcagggcagcccgagtcctgccattgggagttgcccaatccgaaagttttgcacgcaggccctcaaagaagctgaagacaccagtgaccgccccactcctggccctctccccaggtccctcctccaaaccaaattcctttggtgccttcaagaacatcgtgcaggccgggcacagtggctcacgcctgtaatcccagcactttgggaggcagaggcgggcagatgacgaggtcaacagatagagatcatcctggccaacatactgaaacctcatgtctactaaaaatgcaaaaattagctgggcttggtggcgcatgcctgtagtcccagctactcaggaggctgaggcaggagaatcgcttgaacccgggaggtggaggttgcagtgagccgagatcacgccactatgctccagcctggccacagagtgagactcttgtctcaaaacaaaacaaaacaaaaaacaacaacatcgtgcaggctgtggtttccagaagccacgccagctccttgattgccaataaacatcccgctgtggggtggccaggaccgagtgccaattagtgacagagtgcccagaccaaaccggatgaggatcttgcagttgacctcaacatgactgtgcccagaatttccttggtggcaatgtcaacagtctcttcctagatgcccccagacttcatcaatgcatgatgcttcagtgcactcttttcaaatgtcggggtgggtttttttttttttccacaaaacttcaagcatctactaaagtagagggaggagtgtaatgaactccggtacccatcactcagcttccacggtttcatctcatttcatctgtgacccctccactaccctttcttcctgattcttggaagcaaatccaagacatcacacccttccctctgtaaatctttactatgttcctctaggagaaaagggctcttctcaatacataaccacaagtcatcatcacaccgacaagtgtaacagtatttcctgaatagcttcaaatatcctagtagtgttcaaaaaatgtcatacgtattttcagtctgcttgaatcagggctcaaataaggtccacacattcagattgactgatatgccttttgactacctttgaatctagaggttccctttctatctccctgcaatttatttgtggaagcaagcaagtcgttcatgacgtagcctaacaggcccctctgacgttgttcattatgatttttctgtaaattggtagttgatctgaggatctggccagaggcaggttggatttgttggtgtgttttggcaaggagagtgtctcttttctggggtgttggcagctactgaaactcaatgcccagaccaattaaaccactggggatggaaaatgacggcattcggacaccttaccctgccttcacctattggtgaccaaaaccttaacatcttcacaggtcttcttaccctgagggtatatgccactaggttgtgtagtaaaccggtgtgtttccagtcccttagaatagtccctctctaagtgatatgccactcagtggatatgcatttagcttcatttcttttgttgctgattttcagagattgctctgtaaatttaaacttttattttactttattttattttttcgagacagtcttactctgtcgcccaggctggagtgcagtggcgcgatctcagctcactgcaacttccgcctcctcggttcgagcgattctcctgcctcagcctcccgaggagctgggactacaggtgcccgccaccacgcccagctaattttttttatttttagtagagacagggtttcaccatgttggccaggctggtctccaactgctgacctcaagtcgtccgcccacctcggcttcccaaagtgctgggattacaggtgtgagccaccgcccccggccacttaaattttgttttataattatgtaataaaacagttaaaagtctcaaattaaaatctagaaaagaaggtgtatttgaagaagtctggcttctctgcgccaccaccgaccgccccttccctacctgcctgtatttcctcgaatcactttgcctgggagctgactttgattctcttgctcattgcttcatgaaattcagttccagaactttcaggagggaggggtaggccatgacaccagctctagttacactggtggcagctcctgtcccctcccccactgctgctgggacctgttctctcctttgcccccttgtccctgcactgcccaatttggaccgcaagggttgccagggaagggcactggctgccttgttttcagaggtcgtagcacctagattgctccagccccttgcacttgcctgcaggccagagtgtcccaaaccctcccagtctcagctgctcttccccagttcacccaaggtacttcccagggaagagctgccgacagtttgggggttctctgttcttaggtccatcagcaaccccattgctcccctctgcttccttctgcacggagactgacgccatgcaggtcttcaattgtcaatggtctgtccctgctgctcatactgggggttcctggggagccagtgccaggtatcgggattgcagacattgtctgtgggtttccagaagctccttgtgttaggaacatatggggcccgtgcacagagggcagcagaggccttgtgggatccagctgtgctaggggtgagatttatctgtctctcctggccatagccaggaaatccccatttttcttaagctagcttgagttgggcttttctaacacacagctaaagaatctcttgataaaccttgggactctccatgaggccttatatggcagcaggtctgtggcttgcaatcccttcaagtaatctgccaaaaacaatgttatgacgaaggtccttccaacacaaaaggtgtagagccctagcaaactcctacagaagaaaaaggagaaataattcgtttgtagtcccagctacttgggaggccaaggtgggaggatcacttgaagtcaggagttcgagaccagcctaggcaacatagccagaccccatctctacagaaataaaaaaaattgccattgtggtaatgcacggcttgtagtcccaggtactcgagaggctgaggcaggaggatcgcttgagcccaggaggatcgcttgagcccaggagttccacgttgcagtgagctatgattgtgccactgtactccagcctgggtgacagagcaagactttgtcccaaaaaaaaaaaaaaaagaaaagaaagaaaggaaaagaataaaagagaaattaccatagattgggtggcttttaaatgataaatttatttctcacagctctggaggctggaagtcagggtgctagcgtggtgggctctggcgaggaccctcttcctgactgcagattgccaacaactcattgtatcctcacatggaagaaagagagctagagagcactctagggactctttttcttgtttgttttaattaaaaaaaaattttttttacatgggcatgccatgttgcccaggttggatttgaactcctgggctcaagcaaccctccagcctcagcctcccaaagtgctgggattacaggcatgagccaccattcccagctaatttgggctgttcccaaaggctcaagtgatcctcccacgttggcctcctgagtagctggggctacaggcgtgagccaccatgcccagcttctaggacctcttttataagggcactaatcccattcatgagggccccactcactctgcacacatgacctaaatgacctgccaaaggccccacctcctaataccatcaccttgggggttgggatttcaacacagaaatttatggggggcacgtacattcagatcatcatgaacagtaactcctatgtgtgacagaaggtgacagaggtgggtagtggtcttcccctcaagggggtgagttgccactagctggggaatcttctggaaggcaaatgcatatgagctgggctttacaggaggcaagcgtttctctatggaagggcagaggactgtgggaggtaggaggtggggctggggcaaagggaagaggggagcagggaagtggggtgactgcacactgggagtggggaatcagatggaggagacgatgaggagttctgttaagttcaagatgccagtgccagtgaccagcgggcgatggtctctggcttgagggacaggatggaggggagactgtctgaggatggacaaagctggagggaaacagccaattgcaaaggcaggagggcggaagggggaggggagaggtgggatcagcactggtatagacaggcggtgctgcagcccagctcctctctctcctctgcctcctgccctcaggccccttcgaaggcccgaattaccacatcgctcccagatgggtgtaccacctcaccagtgtctggatgatctttgtggtcattgcatccgtcttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtggtaagccagtcggggcccaggctcggcggaaaccactcattcaccctgcaagcccctccggccacctcatgatgatcggggcccagctgctcctgtaggcctgtctccctccacatctgcgcctcacatccatatactgaagggttctggaggcttccatctgaacactcacattaaattcagctcccttgagtcaaacataccctgagttcctactcttgagtcaggctctgcccggggacagccagtttggagctgtggggctggtgtgggaggagacagatacagagctagacaaccccagaacagtaggggggcggggactctgggcaccctggacagaactcccctgcaattagggatgcctgctctttcagctcgccagcatctgcttttcccggaggagacacaattcccagatcctctccccatccccatcactaatatctctgtgggccactattccgctcaggtcaggagacagtggcggagaggtactagcgtgccaggctctgtgctaaggagggggccctatagccagacggcaaccacacagtaccatcatcagtcctctcagacaagaaggggcctggggcaggtggtggaggagcggctgggagcagtttgtggttcgagtggatagagtaccaccaagcagccgtggctgctggacacgaggtgggcaggcccaggtctcagaggcctcagacgtcatgcccaggagctgggactttctttcaggaggaggagaccccacatccagcagcagcagctcctgctcttgcctccccaccactcttagcagcctccccaaccccaccccgttaactgcctcaaattgtacccacgatggcccagaccagagagggtgcttgtccaagtcccggcactaccccgatagtgtagaaggggagccaagggaaggtcaggcagagaaggtccatccccgggtccgagtgctctctgcagcaggcatggcctcggtggtcacacgacccttcccgagtgcccccctgcatctccgcccacgtctgtctccgtttctgccatggtctcccgctcacccttgcctctgctcatggtctgttcttgggtcagtcaggtgccaagcagccagcacttccccaccacttttggtccacggatgcccttggccatctgggaagcctgtggaccccatctcaggagaatttttgcaaacgcataaaatgagacccataggattacaaaggcagcaaattatactgaaatacagttatcaaagtattaaacattcatcagtaacatagtctttagttaaaagcatttactggccaggctcatacctgtaatcccagcactttgggaggctgaggtgggaggactgcttgcctccaagagtttgagaccagcctgggcaacatagtgagacctcttctctacaacaaataaaaacagctgggcgtggtggcacaccagtagtcccagctactcaggaggctcaggcgggaggatcgcttgagctctggaggtcaaggctgcagtgagctatgatggcaccactgcactcagcctgggcaacagagtgagattctgtctcaaaaagtaaataaaaataaaagcatgtgttaaacgtattagtgacaccactcagtattaaggtattaaataacaggatcccgcctgacaaccactgttatttcagagtagtgatgaacataagtggtattcgaactctctgccacctctatgaattgacaggaaaacatctgtgacctctcttgctgaccgagtcacgggtactgctaatactgccacgttcataatggaaggaaatgtccagtgtctgttcgaggttggtggaaagaaagatgtcgttttttccacctcagtccgtggagccctgaattctgtgtgcagacgtttggggtctaagcaggacagtgggaagctttgcttcccacctttgctttggctcaaagccctcatctgtctgctctccccatagggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatgaatgtggctgcaacataggaaaggctctgtggtccccgaacctctggaaacatatttatcccaagcacgatcaggtcacaggcgcacacggagctcaggccatcagcacagctgtcagtgaacgcatagcgtgtttgcattccaggtctctttcttgcacacgctgccgcaccacgccccccacctttcagaggctgcttgggtcatagatccacctgggcctacagagcacatgtcctggccaggccaagcaagtggctcaaatgtttgattggagtggactgggtgggacagcatttcactgttttatcgacaagctcgtgaataagttctcgtggtgtttggagagggaatgttctttcctcgagaacgttccacaattctaggaaacaaaccttgtggaagcctgtctctgtctcccgccctcctcatgccgccatgccccacacagctgcccgttatcaaacatgtgtggtgagctgaccctggtggaggctctcccgcgggttatctcatttaatcctccaggccactaagtgagcagggccctttatttcagtcatggcctagctgacctcagataaaagactcagctcttcatgggtgttctcagaaggtcagggcaagaaggaacctcacaatccctttgtaaagaaggggagtgattgggaagatgaaaatgtcctggaagcagatagtggagatggttgcacagcattgtgaatgtaccaaaggtcacaatggtacttttttctttttttgagacagggtctcactctgtcactcaggctggcacagtgcagtggtgtaattatggctcactgcagcctccacctcctgggctcaagtgatcctcctacctcagcctcctgaggagctgggcctacaggtgcaccacttcacccagctaattttttttattttttgtagagacaagatctcactatgtgatccaggctagtcttgaactcctgggctcgagcaatcctcctacctctgcctccaaatgtgctgggactataggcgtgagccattgtgcctggcctataatggtacattttatgtgatgtgtattttaccacaattcaaaaagaagaaaggcatgacatctaaaaatggacaaggattaaccaaaatcctacccaacggttttgttttgggttgatgaaaatgttctggaagcagaggtggtgactgccacagaattgatcacttcaaattgggtaatctcatgcaacatgaatttcacctcaatttaaaaaaacaaaccccacccgagttagcaccgtgcctgggccgggggtcctgggtcaccccaccctgcatcaggactggctgccggcccttctctccaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtaagccccccgattcctcctggcctcacccgcctcctgcccctaagctgctctgccctcaaatgagtccactgagactcctaaactatttttccaaaaatccttagagaagaggattttacccctataagaaaatattaagatccagcgatgagaatcaggtgattcctttgggactgtaccagtggctgcaggttcagccccagccccgttgtcctcagctctgtgagacgggaaagcactgccactccctccctggaggagtccactaagggaacagaggtgtgccttgccccgaccctggacagttctccccggggtggaaaggctgcctttcccacagagtagagtggagcagccacatcagcaaatgacacctgcaaatcaaggcgtgtttttatgaggctgccaccggagtacccttgtccttttcataggctgtggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccggctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatggtcctggcattctgcttctgctggggaccatacgccttcttcgcatgctttgctgctgccaaccctggctaccccttccaccctttgatggctgccctgccggccttctttgccaaaagtgccactatctacaaccccgttatctatgtctttatgaaccggcaggtaagcaacaccatcagcagatcccactcaaaataccgtgtgccctagaagggtgcagtgatggccccacctggaatcatgtctctgataagaagcccgcggagcatctgggggaccctccagggaaatgaccgggaaaggctcagcgtgtgacccagccccagccagagctccggctggcccttagcagaaggcttaggtgtgccctctggaatcctttatagtctcggcctgagggtggcatttcccaaagcgtctgtgtgccgtgtgctcttcccttccggtggccctagaactatggctgccgagcttcaggggctctcctggcgttcagacgctctaggagttggtgagccctaggtacatccaccctaggtgtgcccctcttctgttcagactcgacccttctcaaccttcatctctccattttcaaaccgtaacctctggaatttgtcttcctataagaacaaaagccggccctccttggctacactgaccaagagttcaagagctttcacgagttcgtgggttagttcaggggggacgtgctgtggtcctgcccagaggcagcctccttagctggcatattgggcctcagcagcaagctgctcacacacctaaatccccccacctcctgcaggttacaggcttcattaaagcgcagctgtgatgtgacttgatggtggccagaaaggtgtgcagaggcctcccatttcaccaggcccagtccatcccttccactgggctcttccttgcttctccatcttagagccactcaatggctccagcccctttggctcagctttgactcacacaagccaagtctgcagagttcattaagggttcattctctctggtaacttttaaacagtaagtaggaccaggcctgcagtggatttccgggaactcgctgtagcacactgatgcccagagtgtagttctatccctgacccctgtttcctgactttcatgaggatcttttttaggtttctggaatcctaaactatcttgccaagtactgtctttactggattatttccattctcctttccagaactccccctggacagggggagacagatgtctgcacttctggacctcaccaggcctcgaactttgcttttaccctttccacataattatcctgtcctgccacattctgagagaattttctggaacgcagttccatgaagacagcaaattttgctcaggacagagtctggcacacagtgggtgctcaagcagcagctgctgaatggattcctcagccctatctcccagctcttcagccgagctgattctgctgtttgtcccgtttcttatgttattaatttcaaccattatattttttatttttgagagttttgatgatagagggagttagagctagtcaagagtaggcctgaaatatttagaaaatgcctttggtctgggtcctcaaagcattgtggttacttcagtgatgacacaggacatgatttgagacattcatatggcccagatctctttggggtgaagcagcaaagacagacccctcctggtaccggaagacgcttggctggagagatgaggtaggggctagattgtcattacctaggcctcaccttgccccagatccatggactggaaaaaacatgacaaccacatgccttttcattaatattcctccgagccgctcaccagacagtctggggacaggtcaccactgccccttagctgtcactgtggatgagtgtcatggggctgccgtcacaaactaccacaaactcagtggcttcaaaccacagaaatggattctctcagggttctggaaatcttgagtctgaaatcagggtgttggcaaatggaaaggttccctatggaggccgggagggagaagcagctgcagggctgccggcagtctttggcgttccttgactccaaggtgtgtcaccccagtctctgccttcatcttcacgtggccttcttccctctgtctgcgtgtccgtgtccaagcgttccttttcttatcaggacaccagtcattcgattagggcccaccctgctccagtgtgacctcatcttaacctgaacacatcttttgggggacccacttcaacccagtgtagtcaccatcaactgctaagtcagatgacatccccgcgtgtgagggagaaataatccaagccttcctccatcccccatgggattcggaatgggtgaagggaaggctcgggcacgtacattcagcacagtgctccacccttccctgctctgctcaataacgctttctgtccttccagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaa

SEQ ID NO: 4090 - DNA, 2316 bp, human
gcgtatccatgctccaggacagctggagcagtgtaatttcctatcaaaaagtatgtgtcctggcttgtaaatgcatctgatttttttagtagtgagttattaaggagtgaaattgttagaattgggggatagcggcatagcaaagtgccttccactttgacatgcattctgtgtgtagtaaccacggcattctgttttgctggcactataccaggtcctccgccactgtgtcagtgacaaggtcacagttattggagctggaattactgtgtatgaagccttagcagctgctgatgagctttcgaaacaaggtcagttggttgagtatgagcattgaagttcaagctgggaagaggtaggacttcagctacctcctgtgccctgagtgctctttttatttttatccctgcatgttattctgagtctctttcttgtaccaagctggtttttgctgttctgcagatatttttatccgtgtcatcgacctgtttaccattaaacctctggatgtcgccaccatcgtctccagtgcaaaagccacagagggccggatcattacagtggaggatcactacccgcaaggtgtgtgtgggcattgagaatgctttggaaggttttggtgtttttgtttccttgattggccacatggcatgctctcaggcatcacctatagtctacctctcacccagcatggctttgttatttgatgttcactaagcgtggggccatactcatacacatctgtgtgtccccaacagagtgcacagtgcccagtcaccagggcgggtcagtggcaacacagaggagtggctattgcaggcaagcgaggtgtcatgaaaagcatcgcagtttctttgggtttggaatgatgaatagtatgccccaggccaggcgtggtggcttacacctgtcatcccagcactttgggaggccgaggcaggtagagatcacttgaggccagaagctcaagaccagcctggtcaacatggtgaaaccccatctctactaaaaatacaaaaattagctgggtgtggtggtgcatgcctgtagtcccagctacttgggaggttgaggcaggagaatcacttgaacccaggaggtggaggttgcagtgagccaggatcataccattgcactccagcttgggaaacagagtgagactctgcctcaaaaaaaaaaaaaaaaaaaaaaaaaaaaaaaaaaaaaaaaaaaaaaaaaaagtgtgccccgacgaaagcaggtatagcagagaacacagcaaatgcagaaaacagtgtgtcagggagaatgggctgggcagtgtttgcgcctggaaaggttaggtgggacagatgatgtgatacaaggagcattgagtgttcatgcggcaggggccctctgagcctgcacaagcggtgcctgatctctcgaaggactcctgggacccagcacacagttgctctcacacctgaggttgatgacagggaaagggtgcagggggggatccaccagggcaggaaccatgggccaggtggagttgaaagaagtcctgccccagcctccccttggccccacaaggggcatactgagaagtgcctcccacgcaggctgtgttcctgcctaagggatgcctgctagagacttggcacctcaagtgtgtactgggggcaggtcctgttggcaccctctgccaggcaggtacccaaatccctggctcccagcaggaaagcaggtgctcatgtcaaccacattgttcctacagacagtccaggtgcatgaccgccctgtctagtggggaaagtgttagagtagcaagggaaccttcacgagccaagagctaaccttgccaaccaacagcctcaagccagctagtcacttttctgcactgttaattcattagttctaaccattttcaggtccccaacagctttgagaatcagagtgccacagacccccacactcaggcagcccttactgtaggttgaggcagagcagtttggaaactggcagtttagaatgagaactccgcaggcccatcggagtggctgttcacatgaatcagattttcccctgggaagctgcagattcaaaggcctctatgtggtgaggctttaaggctgacgagctgctttcacaaaagggcctaacatccttgtttccccaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaa

SEQ ID NO: 4091 - DNA, 715 bp, human
gctgcagaacggttgtgccactgaacagatcttacagggaggctgtgagggttctcagagttcaggcacacaagatcttagcactcagcgtgttgccaatgcccagaatgttctcattaacatgttagtcactggagtccaatctttgcatgccatagtgagctctcaaaccagactcctgatgggtatgtggcgtatccatgctccaggacagctggagcagtgtaatttcctatcaaaaagtatgtgtcctggcttgtaaatgcatctgatttttttagtagtgagttattaaggagtgaaattgttagaattgggggatagcggcatagcaaagtgccttccactttgacatgcattctgtgtgtagtaaccacggcattctgttttgctggcactataccaggtcctccgccactgtgtcagtgacaaggtcacagttattggagctggaattactgtgtatgaagccttagcagctgctgatgagctttcgaaacaaggtcagttggttgagtatgagcattgaagttcaagctgggaagaggtaggacttcagctacctcctgtgccctgagtgctctttttatttttatccctgcatgttattctgagtctctttcttgtaccaagctggtttttgctgttctgcagatatttttatccgtgtcatcgacctgtttaccattaaacctctggatgtcgccaccatcgt

SEQ ID NO: 4092 - DNA, 33924 bp, human
tcgctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccgggtaagttctcctcattgaagtctgggtcatgcagggccacgggcccggtggcttcaggcctggtggccatgaggccgtgtggtgaagggagagccttcagaggcacaatgggctgtgtcgtaatgccctgtcttgggctgttggggcccggtcgagcaccctagatggcagcgaggcactattcccgccaacccaagggtcggtcggttggttggtcagccgcgggttctggagcccgcccctcaatttacccacggccaaagttctggaggtcgccaagatctccagttgggagacaaaggatccagactggactgaggtggcgggagaatgtcactgggatcagattgggctagctgtggttttcattttagcggggagcagggcttccctggtaagcagttgtactggatcccgagggtgaatgagcgactctaacccaggatgtgaggataaaaagcaattaaaattccagcctgggcaacatggcgaaaccccgtctcttaccaaaaaataaaaataaaaaatgagtcgggcatgggggcgcacacctgcactcccagctattcgggaggcttgcttgtgctgttgggtttgctggtatgcagttgatggtttttgcatcagtttgagggatattggtctctagttgtattgtagtatttggttttggtatcaaagtgtaatgctggcttcataggatgtttcaaagtgttccatcttaaattttttggagtggctgggtgtagtggctgccacctgtaatcccaagcactttgggaggccgaggcagacggatcgtgtgagcctagaaactagttcgagatcagcctgggcaagatggcgaacctctgtacaaaatgttacaaaaattagctgggcgtggtggcacgtgcctgtagtcccagctacgcgggaggctgagaggctcaggttacagtgaactgagattgcgccaccgcactccagcctgggcaagagcgagaccgtgcctcaaagaaaaaaaagttaaacccagctgagggcggtggctcacgcctgcagtctcagtacgtggggcctgaggagggaggatcgcttgagcccaggagttcgcattcagcttggcaaacagtgagaccctgtctctaaaaaaataaagtaaaagaaaccgggaattgagtacgaattggaacaaaaatgagctgttgaatttgctagtatgcggttgatggtttttgcatcagtataagggatattggtctacaggttttttttgttttttttttctttttttgttttgagacgaagtatcactgtcgcccaggctggagtgcagtggcacgattttggctcactacaagctccgcctcctgggttcacgccattctcctgcctcagcctccggagtagctgggactgcaggcgcccgccaccacgcctggctaattttttctgttttttagtggagacggggtttccccgtgttagccaggatggtctcgatctcctgacctcgtgatccgcccgcctcggcctcccaaagtgctgggattacaggcgtgagccaccgcgcctggcctggtctatagttttgttgtagtatttgcttttggtatcaaaagtgtaatgctggcttcataggatgagtttcaaagtgttccaccttaaattttttggagaggtcgggcgtggtggctccaacctgtaatcccaggactttgagaggccaaagcaggcggatcgtgtgagcctagaaagttcgagatcagcctgggcaagatggcaatcccctgtgcagaatgttacaaaaattagctgggcgtggtggcacgtgcctgtagtcccagctacgcgggggacagagtttgcagtgaactaagattgtgccactacggcctggggaacagaggaagcgagaccttgtagagaaaaaaaaatttttttttgaggagtttgaagaagactgttgttaatttttctttaaatgtttggcagtaattacgaatgaggcttttatttattgggcgttttttttattactgctttagtctccttactagttagttgtaggtctattcagattttcttgtcctgattaagttttgtgaggctttctgtttctaggaatttatccatttcttgtaggttagtccatttgttggcatgcagttattcatagtacactgtcactctttttatttctgtagaagcggtattaatgactccactttaacttgattgtactttttttttttaagcagggtcttgctctttcacccaggctggagtgcagtggtgcaatcatagttcactgcagcctcgaactctcgtgggctcaagcgactctccttcctctcagcctcttgagtagctggaactacaggtgcacaccaccatgccctgcccatctattaatagctagttttgttgaccttttataaagaaccagctttggctaggggaggtggctcacgcctgtaacctcagcactttaggaggccgaggcagctggatcacttgagctcaagagttcaggacaagcctgggcaacatggggaaaccccgtctctgccaaaaatacaacaattagctagacatggcgagcacctgtagtctcagctactcggaaggctgaggcggaaggattgcttgaggctgcagtgagccatgtttgtgccctacactccagcctgggtgacaaactgagaccctgtctcaaaaagaaaaaaaaattggtttcattaaattttttctattttcttagtctctgttttatttgtgctttgatcttttttatttcctttctcctgctagctttgggtttagtccttacgttgtaaagttaggttgttgatttgaagggttatttatttattattattttttgagacagagtcttgctgtgtcgcccaggctagagatggggtttctccttgttggccaggttggtttcagacccctggcctcaagtgatctgcccgcttcggctcccaaagtgctgggattacaagtgtgagccaccgcacccggccagatgtgaggggttttaaaaaatgtgtttacagctagaaatgtcccacttggcactgcttttgctacatcacataggttttggtattttgtacttctgttttcatttgtctctaagggatttttcattttctttttctttcttttttttttttttttttttttgagacggagttttgcttttgttgcccaggctggagtgcagtggcacaatctaggcttaccacaacctctgcctcccaggttcaagcaattctcctgcctcggcctcccaagtagctgggattacacgcatgcacctccacgcccagctaattttgtgtttttagtagagacggtgtttctccatgttggtcaggctggtctcaaactcccgacctcaggtgatccgcccacctcggcttcccaaagtgctgggattacaggcatgagccaccgcacccagcctctcattttctttttttaattttaatagtgttaggggtataagttgtttttgcttatgtgaataaattctatattggtgaattctgagattttagtgtacccatcacccaagcagtgtacattgtccccaatatgtagtcttttatccctcacctccttcctaccttcccccttcattctcctccccaaagtccgttatatcactccaaaacttagctccacttacaagtgaaaacatacagtatttggttttctattcctgagttacttcgcttaaaataatgacctccagctccacccaagttgctgcaaaatacattgttttttatggctgagcagtattccatgttgtatatacaccaccttctttatccactcattggttgatggacacttaggttggttccttatctttgcaattgtgaattgtgctgcctataaacatgtgtgtgcatgtacctttttcatataatgactttttttcctttgggtagatagccagtagtggaatttctggattgaatggtagatagatggtaatctactacttttagtattttttttttttttttttgtcttgagacggagtcttgctctgtcgcccaggctggagggcagtggcgcaatgttggctcactgcaacctctgctgtccgggttcaagcgattctcgtgccttagcctcccgagtagctgggactacaggcacacgccaccactgccagctaatttttgtatttttagtagagacggggtttcaccatgttggccaggctgatctcggtctcttgacctggtgatcgcctgccttggcctcccaaagtgctgggattacaggcgtgagccaccgtgcccagcccgatggtgtattttgatgggaattgcattgaatctgtagattgctttgggcagtatggccattttcacaatattgattcttcctatccatgagcatgagatatctttgtttgtgtcatctgtgatgtctttcagtagtgttttgtagtttttcttgtagctgtctttcacctccttggttaagtatattcctagggtgggttttatttgttgtttttgctgtttacagctgttgtaaaagggattgagttcttgattctcaagcttggtcgttgttggtgtagtgctactgatttgtgtgcatttattttgtaacctgagactactgaatttgttcatcagatctaagagtcttttggatgagtctttaggattttgtttgtttgtgtttgtttgtttgcttgtttttgatggagtttctgtcacccaggctggagtgcagtggcatgatctcggctcgctgcaacctccacctcccgggttcaagcgattctcctgccttacccgagtagctgggactacaggtgtgtgccaccgcacccggcaaatttttgtatttttggtagagacaaagtttcaccagaccatggccaggctggtcttgaactcctaacctcaggtgatctgcccatctcggcctcccaaagtgctggaattacagatgtgagccaaccgcgcctggcctagggttttctagctgtatgatcgtatcatcagtgttacagcactagtttgacttcctcttctccaatttggatgccctttatttatttcgccattggcttttggttgtgtaagagtgtgttgcttaattttcacaaatttgtgaattttccagttttccatctattattgatttctaacctcatcccattgtggttagagaaaatacttagtgcaatatgtttttttaaatcttgttggccaggcgcggtggctcatgcctgtaatcccagcactttgggaggctgaggtggggtggatcacctgaggtcaggagtttgagaccagcttggccaacatggtgaaaccctgtctctactaaaaatgcaaaaattagccgggcgtggtggtgcacctctgtaatcccagatacttgggaggccgaggcaggaaaatcacttgaacccggaaggtggaggttgcagtgagccgagagagtgccactgtactccagcctgggcaacagagtgagactgtgtctcaaaaaataaataaataaatcttgctccagagcctgggctagatagtaagaggacagtgtggatgcagttaagaaccatatatgtctgaattttttgtacatgttcattttgttcccttcaccttcaaaattagtaacagatggctgcattttctcaagggatctgtgtggcttttaaatctaaatcatccacttacaggacatttgcaaagcaagaggttttagtccccattttctttctttttttttttttttttagtagagacggggtttctccatgttggtcaggctggtttcgaactcccgacctcaggtgatccgcccacctcggcctcccaagatgctgggattacaggcatgagccactgtgcccggcctaagtccccattttcttttttcttttttttttttaaatgagacaattatttattttaggcagatagtcaacttaaaaatcattcagcgtgggcactcctgaaactgtcaggatcatgttggtttcctcgctgtttgccggctattggcatttgtgtcatcacacacagtccgatgaggtgacaacagaaaagcatatctcacttctatcgtaggtttccattcactttcgggttctcaatcgccctgtgtttcctcagtgatactccagactttccagatgttctggttgacccattcctctttcttttttttttgcaaaacaaagcaaaaagcaagaagagaactttacattttgtccaatagtcctaagaaattttccctgtagagaatgtcatctaagtcaaaacaagggttgaataggggcacccaaatcagttatcacttagggctgttataagaaatgccaagactgggtggcttaaacagcagatattcgtctctcactgtctggaggctacaaatccaagatcaaggtgctagcatggtcagttctggcgaggacctgctactgggctcaagagcactaccttcccccccgtatcctcacatggtcggtctccagcctcttctcataaaggcgctgatcccattcatgagggctccactctcacagcgtaatcacctcccaaaggccctgcctccaaatactgtcacactggcattaggatttcagcataggaattctggggggacacattcagtccatggcctcccgtacctgtgaatgtgatcttatttggaaatagggttttgtaggtgaaattaagttaaggatcttgagataagatcatcctggacttagggtggaccctaaatccagtgactagtgtccttataagagaaagaaaagagagattggagacacacagacaccgtggagaaacgcaggagaaaaggtcctgtgaaggcagagaggcagggacgggagtgacccagctgcaagacgaagaacacctagggccagcagtagctggagaggcaggggcgagggcgatcctcccctaggacctagggagagagcgtggccctgctgccacctggattctggatttctgttttgagccatcacgtttgtggcaactcaccctggcaggcttaggaaacgaatgcgttaacccattgcattagcgcacaaaataacaccctgactcgtttcctgcgccagcctcctaccttgccttctacttattagaccctacctctcattccccattttttaaaatttttatttatttatttatttatttatttatttatttatttatttatttattttgaggcagggtttcactctgttgctcagcctagaggtgcagtggcgtgatcatggctcactacagccttgacctcctgggcttaagcaaccctcccacctcagcctcccaagtagcttgaactgcaggtgcatgccaccctgcccagctaattttttttttttttttttttttttttttttttggaaagacgaggtttcaccatgttgcccatgctggtctcaaactcctgggctcaagcaatcctcctgcatcatcctccagaagagccgggattacaggtgtgagcccccacgcctggcctctccctcctttttatcattccctcttccctcgtcttccttggctttcctcctcacacctcctgcgtttggcccccttccattttcttttctgcttctcttttcccaacttccccctcatcatgccagggggactcctgggctgcgtgccacccccctggaagtcccccataatgaagcaggatttatgcctcacacttcaccatgggagagcagaaacctctcacttgaagcaaaaggcactgaaaataagcaaatagttatgcatttgtcactaccgagtcctagctggcttccaccctaccccccgccccccaccatcttcttgctcattcaggtcatcgtgttctctgatacccagtaacttccatcattttctacatgcatttctgttggtcttctgagaattgtgattttccaaagtagaaagggcacatcgtctttttggagcctcaaaggtgcagacactgatgcgttgggggagatcacagtgtgacaaggatggggtgggagtgtgtcacccccctttctaccgaccctcagcagtggggagagagcagaggagatggaacctgagaggaagaagagatttccaattacttccttctcggtcccttctccactgaagcctgttactcctctgctgccggggcctcttgagttttctctcactgagccaggaaagagcttagtgaataaagaacaaggtatcccagcaatgcagggaagatgtccaggacagtgagtgtgaacgaggggtcctggagaatgtgcacgccagccctgcaggagaatgtccacgccagccctgcagcctggtgggctctgccatcagcaccccaaaaccattcatcagtcaccttcgacaattgcacgtgcaaaagccctctttttgtgtcctttgaagctttttttttatcaggctgggtgcgtggctcatgcctgtaatcccagcaccttgggaggccgaggcgggagaatcacttgagcccaggaggtcgaggctgcaatgagctatgatcatgccactgcactccagcctgggtgacagagtgagggcccatcccttcgcgggtccccattaagaaaatgggggagggacagtccccattttcttaatggggactttcttagtgaaatttgaaatgagagattattaatatgagctgggcctaacatctttttttacttgcagttggggcagagctccagggagttggttttgtcccctgctgtcttgtcccctccccctttttaattaattagggcctggctggactcacatgcaggccgctttctaagagcagcagttactttggcagcattcagaaagggcctcagttactctaccatgacaaatttctcagtctgtcaccgttcacttcctaaaagaaattcattgtagaaggtagaatgggatcttcatggcatttctgattcacaatgctcctgaaagttcctcggcatgtggaaaggccacagatgaatttaagcatgtgaaagaatactcatgtcagaggcacaaaggaaacttgccccgagtccacggtgctctgcggttaggagctggcctcactgtgcacagggggaggggtggtgagcttaccgggctttaaagcgcccttccaacctgtgagccctgcattccttacccttggttggattcttcccgggctgggagaaatgaccgcttctatgaggagaccatgtgccgaggtcgtgtgctaggaagccagttgctgtgagaaatgaccagtgtcatgtctgtctttcagccaccctacatcatgtagcagttcttctgagatcatgtctgtgctgttcttctacatcatgaggtacaagcagtcagatccagagaatccggacaacgaccgatttgtcctcgcaaaggtatgccggtggggagcccagggctgctgtggcgcctgctggttaagcccagtttgaacagccaccgtgtgggaacaaggcctgaaatgggcctcgtttattattttggttcttctttctttgcatcttaaagctcgagtgttctagtgagggccacttggagccctgtgatggcatggtaggaagggtggcttgggagagctgactgtccttcctttcctttggtcacaccctgcctcgccccacttagcacgaacgcttcccccatggcagggttatgctgctcccaccctctgtgctgcctgaggagaggcaggcagcctcagtgaatcccactcactgagcctgggggaacttgagtgtaaccgggagggacatcccacccctgtcagttagcttcctcttctatgtttctgcacatctgacctgaaactgatgggcacttctcatgagattgggcaaaataccagccacttcatgaagtatcatgggtgataggaaagaaaaagaaccttaaaaacaaggtcagtttgagaatgtgtggctggtttgatgccatctcaaagtacactgtgtcccgaagcaaattaaaacctggctaggggccgggtgcagtggctcacgcctgtactcccagcactttgggagactgaggtgggtggatcactggaggccaggagtccgagaccagcctggtcaacatagcaaaactccgtctccacttaaaaaaaaaaaaaattagctaggcatggtagcacatgcctctaatcccagcttttcgggaggctgaggcacaagaattgtttgaagctgggaggcagaggttacagtgagccgagatcgtgccactgcactccagcctgggcgatagagcaagactccatctcaaaagaaaaatctggctgggtagagtactgtgtccaaatagaaatgccagattagcacagtgggaagtgaagacaaaaactgggcatagctgaagtaagtgcctaaaggtcataattgtgacccttgtcttggtgtctgaaccataacatcaaatggtttggcaaaaaataaatagaatttacatgtgtacgcgcatgtgtggagagagggatgaagtaaatgccttccattgctttcagttggttattggaggtaagcagtatacaggaaggaaatcattgtgctaggctttaaacatgtctataaacttgaactttttttacatctttttttgttctttttttggggaggtagagtctcgctcttgcccaggcttgagtgcagtggctcggtctcagctcaatgcacccctgacctcctggcctcaagcgatcttcccatttcagcctcttgagtagatggcattacaggcatgtgccactacgaccggctaatttttgtattttttgtagagacatggtctcactatgttgcccaggctggcctcaaactcctgggcccaagcgcccacctctgcctcccaaagtgctgggattacaggcaacaagccaccgcttccagccctctttacaatgaaaattgaaaaaaaaatagatatataaacgcaatatgggtgtttagatttctggtttaaaataaggaaaggctgggtacagtggctcacaccagtgctttgggggctccagcaggaggatctcttgagaccagcctgggcaacatagcaagaccccagtgtctacaaaaaatacgaaaattagctgggcgtggtggtgcgtgcctgcagctactcaggaggctaaggtgggaggatcacttgagccttgggagatagagcaagaccctgtctcaaaaaaaaagaaaaatctagactgtcatataacagctgctatcagagccattggccttaggggatgaagaggctttctatcgggcagcagcacaccaggccctgttcggctgccagaatttgtgtgttcatcagatttagctggctgatgaaattggaacaaaagagaaaacacatgaagcatagtccattgtggtttgcctgggaacggggtaaacagctatactccaggcagagcagatctttattctagcctttcacctccctgaatcgtctgccccgcagcataagggttcttgagaaagacagcacccatgtgggagcacttctgccataacgggcatcatactgatgcctcaccattttctcaatctatcctcactttatccttgacctcctgtcacctaagggggctctggtctccattgcacccataaagtctttgagatgggcccactggcctcacacttcacagccagagggaagcagagttggtctgactgctgagcccaggctcggtccattatgttataggacttccaagggcatgcaaggcgactgggagccagagcttgttacgtgagtgtggtgggtgccatagggagggagatgtggctagaggcatagtcaaaagagacttgagttgagtggggcagttctgctgggctggaaatgcagaaccaaaagggagtctctggggggcacaaagcatgcagagaattccggggaaggtcaagagcaaccagagagtagcagagggtaggaagcaagaagcaggagatcagagaatcgtaaataccatccatccatctacagtagtgatgacctcgctcatctctgctcgaatggcgctgacgtttgagcagaggagggtgacaggcaggaaacaaacttttaagtcaatagatggagtgtcaggtggggccaagcatctggaatcaagtaaaagtggaggaggtaggaggcactggttgaaaaagagtggtccagaaagacctcagtgctgacgcttgagcagggatttggaagaggcaggagagtgagctgtgcccacatccacgcacaagcactccggtagtgggtgccatgagtgctaaggccctgaggcaggtgtatgcccactgtgttcaaggagcagcaaggaggccagggtgccagagcagtggaagggagaaatggaggtgatgggggctggggtgggcagacaggtgcaaacagttgagctctacttggtgggaggtcggaagaccttagaaagttgagcgatgtgatcagtcaacttcagttttaacaggctcccccttgtggctagattgagaatggctgtgggggaggctgggaggccactgcagtgacagaggcaagggatgtttaagaccaggtcgaaatggtggctgcagaagctgttgggtaaattcagtatgcttgcaagttgggcctctccagtcagtgcagcagctctttggcatgaccttgtggcccacagagggccacattttctgcttgggatagtgatgaccctgtgcctgcaaacaggatgttgggggtggggtagatgctagtagaaagggattcatttctagcgtgggcacttctagatgagcacgtgtaagatctcagttgacctgagttttataaaccagggaaccagagtattctctttctggtttctgttttaagaatccatatcctccataggattgaacatgtgatttgtgcatgaccgggaagggccatgggaaaatgtcaagaatcatactttacgttttctgctttgtacttgggctccccgtctctattcccaaagctccagccacccttgccatactgtatggattacctatgactccctgggcagggacagtggatgtcttcgtcaccttagtcacctgagtttccagcccaggctgagccctgggcttgacccattttccacttgtaacgttgatcggaagcttggggtgcatatgggtgtggggaagaggaattcacccagcagggcgggaggggctgttcggatgggacgctgctacagagctgacaggagcagcctgcactcagtgcgtgagtccacctgataccatgtcctgcagctgcgtctgggctcactgggtcccttctcttacagagactgtcgtttgtggatgtggcaacaggatggctcggacaaggactgggagttgcatgtggaatggcatatactggcaagtacttcgacagggccaggtgaggttcttccccagaagccatttaactgccctacatctacatccccttcctagagtctcggggggcagccacctatctccgtgatgtggagagccctgaagggccagtccccatcacatcccgtggtgacccctctggaaggccttccctgtgccttttccccacctcgggcggctgccccactttctctcccacaggtctgttgaaaggtttcagctgctgttgcctttccattcttatcctagggttgatagcttttttaaaacttccagcactttagtggggtctgggatgtgtggtttgtttttgagactgagtctcactctgtggccaggctggagtgcagtggcatgatctcggctcactgcaacctctgcctcccagtttcaagtgattctcctgcctcagcctcctgagtagctgggattacaggcatgcaccaccatgcccagctaatttttgtatttttggtagagatggggtttcgccatgttggccaggctggtttcaaactcctgacctcaggtgatccacctgccttggcctcccaaagtgctgggattacagatgtgagccactgtgcctggccagatgtgttttcttgatgcgaacactcacgtcgttggttgtggaggaatttacttcacagcagaacacgtttccaaggtggggtgttttgattgttgtgattattgtaaataagttgtaagaacagaactagcaggtggcggcgggaggcggtggctcacgcctgtaatcccagcactttgggaggccgaggtgggcggatcgcctgaggtcaggagttcgagaccagcctggccaacatggcgaaaccgcctctctactaaaaaatacaaaaactagctgggcatggtggcgtgggctgtaggcaggagaattgcttgaacccgggaggtggaggttgcagtgagccaagatcacgccactgcactccagcctgggtgatggaaactctgcctcaaacaaacaaacaaaaaaattagaaggtggcaatgctttaaaagggaacttaccagaaaaatgaatgtgtaaatgtttggggaacttaaggatgctgctttcttccccttcccctctggccctgtttgcttattgataaggaaatgtggcagaagaacctaaaagttgctttacagctagaacagaaaactagccagaggtaaagcctgcttgtgagcccccaggcttttcaagctcggctttcttagctgctgggctggggcagagttgatgagggagattgtgggaagcgaatggtctggagcagcagctccagttgcgtccgtttctcctcctgaaatgcatttgtttggttggcccagatgatcccccacagggtcctaaacctctcttgtcttgctccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtaactgtattctcttgtgcttgatttccattctgtcctgcccccttcatctcttgtaacccagcctgctcctctgttggcaggtggaacacttatgtggtggacggccgggacgtggaggcactgtgccaggtattctggcaggcttctcaggtgaagcacaagcccactgctgtggtggccaagaccttcaagggccggggcaccccaagtaagcaagcactttcctcctgctcctggttgttaaaagcatctgtccgctcagcagcagaggcgggagaggcttagaggggcctaggcagatgactcatttagtgaatagcagttctgcctggagtatatgttggaggctcctgctctcttattttcactagctagtgtctgcttaggataggagatatcaaaagccctagcaggtgaacagtgatgtgctgcctgcacaagggagtggctaggagtacagcccatcggaggactgacagggaacaatctctacggttagtagaatcagaaagcgtgctgtgtgtatgagcaggtgcaagaaataagagtgcatacctacacacgtgcctaggcccacactcttctggaagaaccctgggaattggggaagacgggagcttggaatcaccaactatcacatttcaaggctgacagctgaaattgtttatctcaggtttaactcatcacaaagagtgcggctcctggatttttttaaaagactatagacattttagaataaaactgttctgtgactcctaccgaaaatatagttttactctggtaccctccgttcagtaaattattttaccagtgtgctcctggcaggaccctgggtgttgtccttgcctctgcctccccctcatatgcccacacatagacccagtcccctagattacatcttggacccattcactcctccccatctctactaccatgactgttgccacacccatcatctctcccaaagttccagctggcctccctccacaccagtctctacactgctgccacagtgatctttctacagtggatctgatcagtcactttccccactccaaacccttcaatggtttccaatcttgctttggataaaactcaaacttctcatacccacaagacccaccctccatggtctgccctacctgtctctccagccttattctcattctcccttccactcaccagtggccctcaggggcatagctaggtgcaatggcttgcacctgtaatcccagctacttaggaggcggaggcgggaggatcactcgagcccgaggagttggaagctgtggtgagttatgatcacccactgcactccagcttggggaggagtcatagcgtgagacccctgtctcaaaacaaaaagcctcagggcctttgtccaagctgttctctctggctgcagcagcgtcccaggccctctgtgccaggtgttcctcctgtgagtcctagggtgacatctttttcatcggggtctgtttttcaggtgacctcataggcactcactaaatatttatggaatggatgtcttttgtttgtttcattacaggtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaaggtaggcagaaaggtggataattgaataaatcagatacgtcaactgctttgttctctaatgttgttcgtatgtacacaggattcttcatttattctggtctccatggacgaaccaattactagagtgacatgtaactaacagttcgtaggcaataaagagaggtttgccatttttaaaaaatacatttaggggtccaaagtgcagctgtgtcacgtggatagatactgtgtagtggtgaggtctgggctttcagtgcacccagcatcggagtagtggacattgcacccagtaggtacttgatctttcaccactcctggctccccttctcttttattaggtctgatttttatttttggctttcacatgtgtgtctgaattttctgattggtcaattgctatttattagctcctggtgtggtgtgcctttttctagcttcctaactttggtttgtgcatgaaactgccacgactctgtgtctccgctaagaagactggccccaggcgggctgaccttttgaacttactctctgaattacacagaggagcaggccaattcatcagaaacctcaaaaaggaatcaaatgatgcacaaaactcttgagtatcaagtccttttggtttttagcacctttacatcctgccttctggtatatcatagcagacctgacataggcaagttctttatggcctagaggaagtaaggcggcgagcctagggaggaaggacacactttctgatccttctttatttggagaaattttgagtgttgctcatgttttcttagcctggtaatgagggttaaaaataaatgaattttgaatacttgagaaatcaaaagacaaaaaccagaagaaaggagacggtatatcaacaaagggtgggcaggcacagtggctcactcctgtaatcccagcactatcaggaggccaagacaggaagaccacttgagcccaggagttcaacactagcctgggcaaagtagtgagaccccatctctacatagaatttaaaaattatccaggcatggtgccataatatggttccaggtactctggaggctgaggcaggagaatcacctgagtccaggagtttgaggggatagtgagctatgattgggccactgcactccagcctgggcaacggagcgagactctgtctcaaaaaaaaaaaaaaagtttgagaaaactatataactccatagttgcataattggtatgaaaatgtgtaaaaagcggggggaccatttttaggaatacataaaatatcaaaattgactaaaagaggtataaaaaccttaaatggatcaatagccctagaaaaaaatggagaaaattatccaagtgctatacccccaaagcaccaggctcaccaggttatataagactgactcatttttaacctttatgaaaagagtaatttctaaactgtttcaaatttttccaaatacggaggaagatgaaaatgtcatcccgatttacttatgaagcgaaaatgtgacaaagctagcctaaagaaaactgcagagcaactttctttatgaataccaatataaaaattctaaatagaacattagcccatctcaacttcattagtacattaaaaaaattaaatgaatcagtgagctcaaattagtaatgcagatgactcatgccaggagatgtaggaatagaattcagtgttctagtgttaggttaaaggaaggagggaagtgtgatcatcatcatacacactaaacaaaagcaattcataaaactcaacattttttttttgagatggagtctcgctcagtcacccaggctggagtgcagtggtgcaatctcggctcactgcaacctctgcccccggattcaagcgattctcctgcctcagcctcccaagtagctaggattacaggctcccgccatcatgcccagctaatttttgtatttttagtagagacggggtttcaccttgttagccaggctggtctcgaactcctgacctcaggtggtccacctgcctcagcctcccaaaatgctgggattacagatgtgagccagcacacctggccaagtaatttgaaaaatataatgagaaccattaatgtcggaaatctcactcttgagctgtggagtgtttacctgcttaggaagtgggggttgggggagcgggggatgttaactaaaaagagcacaatttgagaaaaacttgggtgccacatcagccatttagtatggatttaagattggctagcagtccatgtttatgacattaaaggaaatttttggtgagtcacgaatttactttcttcaagatagatgataatttgtcattctacaatatggtaccttccttctgtagtcgttccttctaaatgcatttgaagaaactctaccacctgattgtctctgtcttctagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagtgtgtagtgtctctcagggcttcttagaatcaatggcccactggacacaggaggcccagcctgtgctagtttttctttccatttatgaaagcaaaaggactggaaaaaaatttcctgggaagcaggaggcaagtagccaggtggagtctgagaggtggcttctaggtctgctaggagggccgtaatagactactcggcacttggagtctccaagttggctgagggcagcaggcaaggccacagacagtgggtcctctgagcctcgaaccatctgaacccagggctctgggcctgaagcatcccaggctccctagtagctccttctgcccaattctgcaaccacccagaggcacactggctgaggagtcacagggaatgcagagtttccttctctccactgtagaggggcctaatatagcacagaaatgcaaatgttgcacttacttcaatcacaagaatatcaatgcttagagctggtgccttaggcaaagccattctgcttatctatgcctcagtctctccccagagtgatattaatgcagggagtatctcaagcacatgcacacaagcgcacccctctggagaggaaggagttatggccagtaaaccctttgaactctaaagctctgcgcgtcatagaagatgatgcccagctcctgtcattaggccagaaaaccacaggccagcaggtcttatgtgaccaccagtgactttatttataacaagtagtatttttaaaaaaaatttttttagacgaagtctcgctctgtcgcccaggctggagtggagtgctcagctcactgcaagctccgcctcctgggttcacgacattctcctgcctcagcctcccaagtagctaggactacaggtgcccaccaccacacccggctaattttttgtattttttagtagagacggggtttcactgtgttagccagagtggtctcaatctcctgacctcgtgatccgtccgcctcggcctcccaaagtgctgggattacagacatgagccaccgcgcccagccagtattttaaattttttaaaaattagttgccagcatttaaaaatcagattataggtgtagtggcaccagcctgcagtcccagctactcgggactctaaggcaggaggatgcttgatcccaggacttaaacgctgcaatgtaccactgcattccagcctgtgaaacagcgagaccccatctcaaaaaagaaaaagaatcaggaggtcttatatagaatacatatttctggattcttttgaaaaatgggaagaactactaccatagggtggcattccctcctgacgccagttgactgaagccaaacagcacccctgttgagatgggtgtccccacagctccccatgctctgctgggccatttgggttttttgttgttttgtggtttttggtttttttttgggggttttttttttttgagatggagtctctctctctctctcaccgaggctggagtgcagtggcacgatcacagctcactgcaacctctgcctcccaggttcaagcgattcccttgcctcagcctcgcaggtagctgggattacagacatgcgccaccatgcctggctaatttttgtgtttttagtggagacagggtttcaccatgttggtcaggctggtctccaactcctgacctcaggtgatctgcctgcctcagcctcccaaagtgctgggattacaggtgtgagcccccgagcctggctcattaagctgttttcattttgaatagaaaacaatgcgatccgtaattttctggattaatgctcctgtcaaaaattttgctccccacctcactgattgcctcagcacgcagccatgtagtctactccgtccctgctgatatgttctcacagttggaaaaaagttgtaaagaaaaggcgagcaggtggtatttagtgccatgttgaaagaggtggctacaatgtagagcttgaccaggggcagtcagggacaacctctcagaaaaggtgatacttaagctgagtctcaggtgacgaggggtcagccgtgtacagatgtgggagacagcatttcaagcaaggggcatggccaactgtaggcaggcccaggcttggaatgtttggagagcagaggaagggccaagtggtaggagcatggtgaacgcagaaaactctccagggcccaggtcatacggggtcttataggcgcccttttcagtatctctggttctcttgcagtttgctgggaagccactggagggctttaagcaggaaagcaacagcctgcgttttccaaaactctgaagactggagaatggcttcacgtaggaaagggaggagaaggagagggtgacttggaccagggcagtagctgtggagtcggagggaagcagacttgtcacatattgccttggcaggagagccagcaggatccaacggcaggtgtcaggacaggacccaaggctggtgcttgagtgtgggtggcagcacctgggggaaggtggtgtcacctcttgagattgacaagactgggggagaagtggactggggggcaccatcaggagctctgtgtgggcctggggggttggggcacctgttagatgtacagaggggagacagtggtatcagatggctgggcagtagatcagtcagtcattttcacatgtggccgctccacaccactaaatgcagttttctaaactacatattcgttggcctagttttaagctaacatcttttttttatttttattttttgtagagatggagtcttgctctgtcacccaggctggaatgcagtggcacaatcatggctccctgcagcctcaaactcctgggctcagggggtcctctggcctcggcctcttgaggagctgggagccgccatgcttggccacatctacatttttaatcataaatttaagtcgttgcaaaggatgtagttgttcatatattgacatttttgatactttaatactcaaatcatgccattaatgatgacactggctgggcatagtggctcacacctgtaatcccggcactttgggaggctgaagctggaggattgctggagttcaagagttcaagaccaggccgggtgcggtggctcacgcctgtaatcccagcactttgggaggccgaggcggacggatcacgaggtcaggagatggagaccatcctggctaacatggtgaaaccccttctctactaaaaatacaaaaaaaaaaaaaattagccgggcgtggtggtgggtgcctgtagtcccagctactcgggaggctgaggcaggagaatggcgtgaacccgggaggcagagcttgcagtgagctgagattgcgccactgcagtccagcctgggcgacagagcgagcctccgtctcaaaaaaaaaaaaaaaaaaaaaagttcaagaccagcctgaacaacatagtgagacctggtctgtaattaaaaaaaaaaaattcatgccaagccacttttctttgtcagaaattaaaaccctttttctacttgatttccaatttccattccattcatttccccaatatatctttatgcatgaaagccttttattgattgtcctatcatttttctctgcaacaaaaatatgcatataaattgataggtttttaaaaaattataatataggcttctgagcattaggtttttttttctggactgagatagaattttgattattattagctggtatgttagtggatgagtatacttgtagtttgaatgtgatagcattgagaacagattctattcctgtttttcatcttcatgatgtgctatgaaaccttacttacatgaataagtagatgggaagggaagttttgttagaggaatgtcactcagttctttgaattccttcccagttgtaagtcaaaaaatcacatagtgatctttcatgtaaagttgtttataaaagttatttacagagttgacagtttcattaattaagttcttcactttctctccaccagcatagttatttcaaattgtcctctttacttgggtctggaggttctgcactccaggatgatccccctgtaagagtcaggtggctgagagcatgccctttggggatcaggttgctagaaggtgattgttaaaagagacagttgggagacccaggggcagtggctcacgcccgtaatcccagaactttgggaggccggccgaggtgggtggatcacctgtcagttcgagaccagcctgaccaatatggtgaaacctcgtccctactaaaaatacaaaaattagccagacgtggtggcgggtgcctgtaatcccagctactcgggaggcagagacaggagaatcgcttgaacccaggaggtggaggttgcagtgagccaagattgcaccagtgcaccccagcctgggcaacagagcaagaccctgtctaaaaaaaaaaaaaaagaccatgaggggagcacagaccctccttttggcagatgaatgtagacagagttgatctggagtttgggatcttgagtgtaacacccacagccacatcccctttggaaagcctgtgtgtatccgcagagaggtttgtattctagtttgaagccttctggggtatttgagcccggacttctggggaaggggggtaaggaatggcaatgtaaagtggggatcattaccagaatgcacatcaggggagcattgggccagatgcgacttcccgagggtgcacagggccctgaggacttgccccagcagcgcccatgaggcgacagcagtgggccactgccacactgcagaaaccgagaggaggaaatgccttgagatcaggggccaagtcaagtcacaggccacccaaggtcaggcagcctcttggttttgtggcttcgaggtcccttgtggggatggtggcctagatgaagtaggctgggaagagcgtggaaaatgagaaagcaggggcaatgactataggcaagttttgagaagtttgctgcgaaggagaacacagatgtaaaagcaggacaaggcggagatggggctgtgaagataaaaggtgctggcgcacacctgaatggaaatagaatgatccaagagaaagggaagtagcacaagaggggaggaggagctgcatggctggagacccctgtgagaaagcaggaacaggacagattcaggatgtcctgtcggggcatggaccctggaaagctgcggacaccaggagggcaggcaagagagtctcatctcttgctccctaggagctatgagttgagggcgccgtctgagcaggagggacggacgggtgcccagggtttgaggaaagaggggtgtgggaaggacgcatgctagaacttcagagcagttcagcaggtgcagaatgggagttatcatggggactgtgggagaaggggcggtgggggcaatgcccagggatgttctgattcatgttctctgtgctgcaggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtaagggttctaaatgccatcatcttggtagccttcctccttcacagagaaagattagcatgtgattggttaaaccacgaatttccttatggttccatgaagtttgattattcaagcctttttcttgaaaaagccatattgtactttaaaagtgtcagactctcagggcaacttttgaagtgcatctctcggtggtactgttgtttcagacagtgagaaacagttgcttatcccgagtgccccttgtgtgttgagctgcgtgcaggttatggacaggactggcagagtcatggagccttttctgccctcgctgtggttgcagtctaactgagggtgaacagcatcacagaggacgaggagcattctggctggctgcacagcctgctcaggtgggaggggggctgggaccaccatcaccaccttcctgcctggggcagcgagaaccctggagcgtgacacgaggcaggaactcttacaaacacacccttctcagagtagtagtcacctggcaggtgggctagaaggaaaccacaggaaacgggaagccagagaggggattgaaacaaggtgtgcaaggtggtgggggagaaaaccaggggggtggggggggacctgagagtgaagaaagaggtgagtgtgcctaacagatggagcactctgcaatggcgtgaagagcaaaacacacgagtctccgggattcctcacttgggaaacgtcagagagtcattttcgtgaatgacagaaatgacatgggaaagatgagccagctggcgtcctgtggcaggcagatgggcttactagatgtggctgcacacacttgcttctagaatgccagagatgcacgctggaaagccatctcagggactccctgggagaatgaggctggacgagatggctctagatggagctagagtcacggctgtctgggtgaagctggaggcacaggtggtggccagagagaggaggcgcggcagtgttgcaggggcagaggggcctaggaaagggtccttgagcccacctgtggctgtgctcagtttcagttttgaaatagtcacatggagaaagtgactctaggttccatccaaagaagaactggaaggctgggcgcagtggctcatgcctgtaatcccagcacttggtgaaaccccatctctactgaaaatagaaaaattagccaggtgtggtggcacgcacctgtattccagctactcaggacgctgagacaggagaattgcttgaacccaggaggcagaggctgcagtgagccaagatcacaccactgcactccagcctggcgacagagagaggctttgtcaaaaaaaaaaaaaaaaaaaaaagccagagcggtggctcacacctgtaatcccagcattttgggaggccgaggcaggtggatcatctgtggtcaggagtttgagaccagcctgaccaatatggtgaaaccccatctctactaaaaatacaaaacttagccagacatgttggcacatgactgtaatcccagctacttgggaggctgaggcaggagaattgcttgaacctgggaggtagaggctgcggtgagccaagatgacctagtgcgctcaagcctgggcaacagagcgagactctgtctcaaaataataatagttaatttttttaaaaaaagagctgggctgttgaggttagacagtggtcctaggcaaggcagtgtgcatggtgacaatccccttcctagctgagaaaagctaagctgcccagtgcacattaagatttctctttcacatttctggtgagaaactacgttcccagatacaccctaaagtaccctgtagcaccctcagcatgctttgaaggtgtgttaactacttggaaggcctggagaaatgaaaaagaccactttggtatgcaaaacccggtctctggatatagaaaagatagagcagaaaagggagaacaaagcctgaggaccttcctaaagagaacgggttcagagacttagcaggccaaactcaggccaccaatgctcagccatcgtggacagtaacttggagtgatccatctgaaaagtcagctgagacttttcagttgactaacccgaggtgtcacagtgtgatctcaagggagacaggcgtgcaagaacacaatgtaaatgagttgtgaggatgcagcgggaccatttatggggctctgctacagctcgggacaccccgtggcaataggaataattgcttcttcagagctagaagtgggtggagggcaggttcctaatggggttatgctcctgttttcatcgggctctggttctctcaggtgacgatggtgcttcccagatggccctggaggatatagccatgttccgaaccattcccaagtgcacgatcttctacccaactgatgccgtctccacggagcatgctgttgctctggcagccaatgccaaggtatttttaaggggacactagtttcagacagaaaatgcttctggactctgctagtttcatactgatgattggacttttttttctcaacataaaagtgatattcattatagaaaatttggtgatagaattctttacaaaaaaaacaggagattatgcacacaaacacatttgccttgtaaaagagtccaacagtacaggatactgaacaaaacctgacagcctgtctcagtcagggtttagcagaagaaacagggaccattctgggtgttgtaaacaggagaaggtgtttaacaaagggtgcttaagaagccgcaggagcaagcttcaggcagagtcccagactatagtgttagtctccagtggctgcagccagaggccaagaagctcctgctgtgtcctgacatccaggaagctggagagcgggtggtaggctaccactacaaacgaacccgggttccctggccctggcttgcctttggaacagcttagggcgccaagagtgtgtgggacctcatgcaagggcatcagatggacagaatcaaattcctgttcagaacctagctgcacgggagacgaggcagtgtggtcttgatctttccagcctttcccactaacgttcagcaggtttcccttgccaccctggacctcgcccatgcgccacacaggtaacccctggcacagtcgggatggggactgtatgttccctttccaagcactcatgggcgtttctttgatttttttttttataagtgggctcccgctttacatattattaggtacttttttgtgtggtttttgtgttttgttttttgggttttttttctttggagacagagtctcactctgtcgcccaggctggagtgcagtggcacaatctcggctcactgcagcctccgcctcccagattctcctgcctcagcctcctgagtagctgcgactagaggtgcactccaccacggccggctaatttttgtatttttggggagagacagggtttcgccatgttggccaggctagtcgcaaaactcctggcctcaagtgatccacccaccttggcctcccaaagtgcagggattataggcatgagccaccgcacctggccaattgtgtacttttaaaattagtttatcttggagattgttctgtgatttcacacgttatagggtttcatttctagaaaggtcaagagaggcgcaaaacaagattaggtgatagaaattagagtagaggttgcttcatagtggggggagactgactggaaggaggcacaagggaactctgctggcggaagcgctgctgggcttggatgagggctccacggcggatgcagcattcaggaagggctgaacttaggatgtatgcatttcactgcagctgagttatgcctcggtgaagacactgaataaagatggatcatagcgtatgaacgaacagtagcgacgtttcttgctatattcgtttataatgcatccattaatatgtatgtaaattaacaaatactttagacatacaagtgttcatttatactggtaaatgtttatgtgctcaaattggtcataaaaatgtatttacattttattgggaaaggggccagtcgtcttgtattcagatagatgtttatggtctttctaaggatgaagcattacaagttattgtggcaaaagttaatgttttaacattctattcgggctttctagtcaatgtgagtcagtgctcctgccgtgagttaatgttctgtctgcacagaacaagtcagtgagtattggggaatcttccaaggggattggtgtgatggcatgggggagcttgtccttcagggcagccccaaggtcctgctgggacctgtcgtccactggttgtagatgctcacccctttctccaaagcctgtgtttttagtagaaagagctgtcctcttcacacccctccttcacttctttcaacgtctgttgttggaaattcattgtttgcttttctaaaccatggctccatttatgccctaggggatgtgcttcattcggaccacccgaccagaaactatggttatttacaccccacaagaacgctttgagatcggacaggccaaggtaagggcttacgcgctcctgcgttattcagtatcatctcctgtaaaaagaacacttctgaatctatcaccagctatcttcagagttgagacatcatcctttctttgctctcatttttttaaaaaacagttgtgacctttacctgcttttccttgggaaggaacattctatgaatttcagcttagcctgaacttttctgctttccaaatggagtcttttgttgttgttgagttcaaagatagtaacatgaagccacttgagcggtcgtggctataatttatcttggccgcaagctaaacaaaacagaagccagcgctttgggaggccaaggcgggaagattgcttgaggccaggaattccagagcagcctgggaaacatagcgagattcccatctttacaaaaattttttaaactagccgggtgtggtggcatccacctgtggtctcagctactcaggaggctgaggaaggaggatagaggagcgcaggaattcaaggcagcagtgagctatgatggatcacaccactgtactccagcctgggtgacaagagtaagaccctatctctaaaaacaagacaaaaaataatagaaatcacttgaaatgaataatctgttaggttcagattttacagatctaaggccaggaataaaagggaacatgatctctggtattctcacaaaagccctgagaagttcagattatcagtcctatctgtagatgaggattggagaaagtaagtgtcttacttaagggtttacagcttgtgagtaccaagaccagaatccaggcctgagtagtgagcccagtctccccaggtctgcccaccacgctgaccatcccctgctcagcctgcctgtcagggccatgcatagagaaaagcagaaacgtctatggagaaaataagtgactctgctcatcacctagggagtggggcttgtagacattttggcatgcttccttcctgtctttgttctaggcatacatgtatattttacacagttgagatcatactgaatagaaaggtttgcccatagccactcttgaaagagcagcaggtaacatccaatttggttgctaaggactaggctgctccagaattcacagttgcaagtactcagaatggccagagtgctgccataaagcaggtgtttccagaactgtccactgtgtgccataacgtagctggaaaacgccaccaaatggaaaagttagtgttcacctttggtgttaactacaggttctgtttctatggggagggtctcttgacattcacatggtttgcagagcttgcttatttctgtcgtctcttttctaataattttcctgtcctgacaaaagcaagtaaatttactgatagtaaaggatgtgagataaatgtgtgtgataacatgcatggcatggatcgttaaagggctgggctttgaaaagaggacatggatatgtgtgcatgcgtgtataagtattttaagaggccaggacatccttaaagaatggggtggctcagaaaccctttctgtactatcagcaatggttcttaagctacagggaaacctatacagaggggaagtggagaataattccagatgcctccgatgggtagctttggaggcaacaatctatgaaagaagcccaggaactctgtctttgcttgcagaatagtacgttgtcgagagcgagggctttgatgtcagccccgcctggctgtgggtcccagccctgccctgggccacttcctcctgctctgagatttgctttcctcagctgcagaacggttgtgccactgaacagatcttacagggaggctgtgagggttctcagagttcaggcacacaagatcttagcactcagcgtgttgccaatgcccagaatgttctcattaacatgttagtcactggagtccaatctttgcatgccatagtgagctctcaaaccagactcctgatgggtatgtggcgtatccatgctccaggacagctggagcagtgtaatttcctatcaaaaagtatgtgtcctggcttgtaaatgcatctgatttttttagtagtgagttattaaggagtgaaattgttagaattgggggatagcggcatagcaaagtgccttccactttgacatgcattctgtgtgtagtaaccacggcattctgttttgctggcactataccaggtcctccgccactgtgtcagtgacaaggtcacagttattggagctggaattactgtgtatgaagccttagcagctgctgatgagctttcgaaacaaggtcagttggttgagtatgagcattgaagttcaagctgggaagaggtaggacttcagctacctcctgtgccctgagtgctctttttatttttatccctgcatgttattctgagtctctttcttgtaccaagctggtttttgctgttctgcagatatttttatccgtgtcatcgacctgtttaccattaaacctctggatgtcgccaccatcgtctccagtgcaaaagccacagagggccggatcattacagtggaggatcactacccgcaaggtgtgtgtgggcattgagaatgctttggaaggttttggtgtttttgtttccttgattggccacatggcatgctctcaggcatcacctatagtctacctctcacccagcatggctttgttatttgatgttcactaagcgtggggccatactcatacacatctgtgtgtccccaacagagtgcacagtgcccagtcaccagggcgggtcagtggcaacacagaggagtggctattgcaggcaagcgaggtgtcatgaaaagcatcgcagtttctttgggtttggaatgatgaatagtatgccccaggccaggcgtggtggcttacacctgtcatcccagcactttgggaggccgaggcaggtagagatcacttgaggccagaagctcaagaccagcctggtcaacatggtgaaaccccatctctactaaaaatacaaaaattagctgggtgtggtggtgcatgcctgtagtcccagctacttgggaggttgaggcaggagaatcacttgaacccaggaggtggaggttgcagtgagccaggatcataccattgcactccagcttgggaaacagagtgagactctgcctcaaaaaaaaaaaaaaaaaaaaaaaaaaaaaaaaaaaaaaaaaaaaaaaaaaagtgtgccccgacgaaagcaggtatagcagagaacacagcaaatgcagaaaacagtgtgtcagggagaatgggctgggcagtgtttgcgcctggaaaggttaggtgggacagatgatgtgatacaaggagcattgagtgttcatgcggcaggggccctctgagcctgcacaagcggtgcctgatctctcgaaggactcctgggacccagcacacagttgctctcacacctgaggttgatgacagggaaagggtgcagggggggatccaccagggcaggaaccatgggccaggtggagttgaaagaagtcctgccccagcctccccttggccccacaaggggcatactgagaagtgcctcccacgcaggctgtgttcctgcctaagggatgcctgctagagacttggcacctcaagtgtgtactgggggcaggtcctgttggcaccctctgccaggcaggtacccaaatccctggctcccagcaggaaagcaggtgctcatgtcaaccacattgttcctacagacagtccaggtgcatgaccgccctgtctagtggggaaagtgttagagtagcaagggaaccttcacgagccaagagctaaccttgccaaccaacagcctcaagccagctagtcacttttctgcactgttaattcattagttctaaccattttcaggtccccaacagctttgagaatcagagtgccacagacccccacactcaggcagcccttactgtaggttgaggcagagcagtttggaaactggcagtttagaatgagaactccgcaggcccatcggagtggctgttcacatgaatcagattttcccctgggaagctgcagattcaaaggcctctatgtggtgaggctttaaggctgacgagctgctttcacaaaagggcctaacatccttgtttccccaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccct

SEQ ID NO: 4093 - DNA, 34686 bp, human
cccttgacttgcttgcggagggagcggccggcggagggagcggcaggtggagggagtggcacgaggcatgcggagggagctgcaccgacatcacataaacgcactgggcagctcgcaggcgccattcgctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccgggtaagttctcctcattgaagtctgggtcatgcagggccacgggcccggtggcttcaggcctggtggccatgaggccgtgtggtgaagggagagccttcagaggcacaatgggctgtgtcgtaatgccctgtcttgggctgttggggcccggtcgagcaccctagatggcagcgaggcactattcccgccaacccaagggtcggtcggttggttggtcagccgcgggttctggagcccgcccctcaatttacccacggccaaagttctggaggtcgccaagatctccagttgggagacaaaggatccagactggactgaggtggcgggagaatgtcactgggatcagattgggctagctgtggttttcattttagcggggagcagggcttccctggtaagcagttgtactggatcccgagggtgaatgagcgactctaacccaggatgtgaggataaaaagcaattaaaattccagcctgggcaacatggcgaaaccccgtctcttaccaaaaaataaaaataaaaaatgagtcgggcatgggggcgcacacctgcactcccagctattcgggaggcttgcttgtgctgttgggtttgctggtatgcagttgatggtttttgcatcagtttgagggatattggtctctagttgtattgtagtatttggttttggtatcaaagtgtaatgctggcttcataggatgtttcaaagtgttccatcttaaattttttggagtggctgggtgtagtggctgccacctgtaatcccaagcactttgggaggccgaggcagacggatcgtgtgagcctagaaactagttcgagatcagcctgggcaagatggcgaacctctgtacaaaatgttacaaaaattagctgggcgtggtggcacgtgcctgtagtcccagctacgcgggaggctgagaggctcaggttacagtgaactgagattgcgccaccgcactccagcctgggcaagagcgagaccgtgcctcaaagaaaaaaaagttaaacccagctgagggcggtggctcacgcctgcagtctcagtacgtggggcctgaggagggaggatcgcttgagcccaggagttcgcattcagcttggcaaacagtgagaccctgtctctaaaaaaataaagtaaaagaaaccgggaattgagtacgaattggaacaaaaatgagctgttgaatttgctagtatgcggttgatggtttttgcatcagtataagggatattggtctacaggttttttttgttttttttttctttttttgttttgagacgaagtatcactgtcgcccaggctggagtgcagtggcacgattttggctcactacaagctccgcctcctgggttcacgccattctcctgcctcagcctccggagtagctgggactgcaggcgcccgccaccacgcctggctaattttttctgttttttagtggagacggggtttccccgtgttagccaggatggtctcgatctcctgacctcgtgatccgcccgcctcggcctcccaaagtgctgggattacaggcgtgagccaccgcgcctggcctggtctatagttttgttgtagtatttgcttttggtatcaaaagtgtaatgctggcttcataggatgagtttcaaagtgttccaccttaaattttttggagaggtcgggcgtggtggctccaacctgtaatcccaggactttgagaggccaaagcaggcggatcgtgtgagcctagaaagttcgagatcagcctgggcaagatggcaatcccctgtgcagaatgttacaaaaattagctgggcgtggtggcacgtgcctgtagtcccagctacgcgggggacagagtttgcagtgaactaagattgtgccactacggcctggggaacagaggaagcgagaccttgtagagaaaaaaaaatttttttttgaggagtttgaagaagactgttgttaatttttctttaaatgtttggcagtaattacgaatgaggcttttatttattgggcgttttttttattactgctttagtctccttactagttagttgtaggtctattcagattttcttgtcctgattaagttttgtgaggctttctgtttctaggaatttatccatttcttgtaggttagtccatttgttggcatgcagttattcatagtacactgtcactctttttatttctgtagaagcggtattaatgactccactttaacttgattgtactttttttttttaagcagggtcttgctctttcacccaggctggagtgcagtggtgcaatcatagttcactgcagcctcgaactctcgtgggctcaagcgactctccttcctctcagcctcttgagtagctggaactacaggtgcacaccaccatgccctgcccatctattaatagctagttttgttgaccttttataaagaaccagctttggctaggggaggtggctcacgcctgtaacctcagcactttaggaggccgaggcagctggatcacttgagctcaagagttcaggacaagcctgggcaacatggggaaaccccgtctctgccaaaaatacaacaattagctagacatggcgagcacctgtagtctcagctactcggaaggctgaggcggaaggattgcttgaggctgcagtgagccatgtttgtgccctacactccagcctgggtgacaaactgagaccctgtctcaaaaagaaaaaaaaattggtttcattaaattttttctattttcttagtctctgttttatttgtgctttgatcttttttatttcctttctcctgctagctttgggtttagtccttacgttgtaaagttaggttgttgatttgaagggttatttatttattattattttttgagacagagtcttgctgtgtcgcccaggctagagatggggtttctccttgttggccaggttggtttcagacccctggcctcaagtgatctgcccgcttcggctcccaaagtgctgggattacaagtgtgagccaccgcacccggccagatgtgaggggttttaaaaaatgtgtttacagctagaaatgtcccacttggcactgcttttgctacatcacataggttttggtattttgtacttctgttttcatttgtctctaagggatttttcattttctttttctttcttttttttttttttttttttttgagacggagttttgcttttgttgcccaggctggagtgcagtggcacaatctaggcttaccacaacctctgcctcccaggttcaagcaattctcctgcctcggcctcccaagtagctgggattacacgcatgcacctccacgcccagctaattttgtgtttttagtagagacggtgtttctccatgttggtcaggctggtctcaaactcccgacctcaggtgatccgcccacctcggcttcccaaagtgctgggattacaggcatgagccaccgcacccagcctctcattttctttttttaattttaatagtgttaggggtataagttgtttttgcttatgtgaataaattctatattggtgaattctgagattttagtgtacccatcacccaagcagtgtacattgtccccaatatgtagtcttttatccctcacctccttcctaccttcccccttcattctcctccccaaagtccgttatatcactccaaaacttagctccacttacaagtgaaaacatacagtatttggttttctattcctgagttacttcgcttaaaataatgacctccagctccacccaagttgctgcaaaatacattgttttttatggctgagcagtattccatgttgtatatacaccaccttctttatccactcattggttgatggacacttaggttggttccttatctttgcaattgtgaattgtgctgcctataaacatgtgtgtgcatgtacctttttcatataatgactttttttcctttgggtagatagccagtagtggaatttctggattgaatggtagatagatggtaatctactacttttagtattttttttttttttttttgtcttgagacggagtcttgctctgtcgcccaggctggagggcagtggcgcaatgttggctcactgcaacctctgctgtccgggttcaagcgattctcgtgccttagcctcccgagtagctgggactacaggcacacgccaccactgccagctaatttttgtatttttagtagagacggggtttcaccatgttggccaggctgatctcggtctcttgacctggtgatcgcctgccttggcctcccaaagtgctgggattacaggcgtgagccaccgtgcccagcccgatggtgtattttgatgggaattgcattgaatctgtagattgctttgggcagtatggccattttcacaatattgattcttcctatccatgagcatgagatatctttgtttgtgtcatctgtgatgtctttcagtagtgttttgtagtttttcttgtagctgtctttcacctccttggttaagtatattcctagggtgggttttatttgttgtttttgctgtttacagctgttgtaaaagggattgagttcttgattctcaagcttggtcgttgttggtgtagtgctactgatttgtgtgcatttattttgtaacctgagactactgaatttgttcatcagatctaagagtcttttggatgagtctttaggattttgtttgtttgtgtttgtttgtttgcttgtttttgatggagtttctgtcacccaggctggagtgcagtggcatgatctcggctcgctgcaacctccacctcccgggttcaagcgattctcctgccttacccgagtagctgggactacaggtgtgtgccaccgcacccggcaaatttttgtatttttggtagagacaaagtttcaccagaccatggccaggctggtcttgaactcctaacctcaggtgatctgcccatctcggcctcccaaagtgctggaattacagatgtgagccaaccgcgcctggcctagggttttctagctgtatgatcgtatcatcagtgttacagcactagtttgacttcctcttctccaatttggatgccctttatttatttcgccattggcttttggttgtgtaagagtgtgttgcttaattttcacaaatttgtgaattttccagttttccatctattattgatttctaacctcatcccattgtggttagagaaaatacttagtgcaatatgtttttttaaatcttgttggccaggcgcggtggctcatgcctgtaatcccagcactttgggaggctgaggtggggtggatcacctgaggtcaggagtttgagaccagcttggccaacatggtgaaaccctgtctctactaaaaatgcaaaaattagccgggcgtggtggtgcacctctgtaatcccagatacttgggaggccgaggcaggaaaatcacttgaacccggaaggtggaggttgcagtgagccgagagagtgccactgtactccagcctgggcaacagagtgagactgtgtctcaaaaaataaataaataaatcttgctccagagcctgggctagatagtaagaggacagtgtggatgcagttaagaaccatatatgtctgaattttttgtacatgttcattttgttcccttcaccttcaaaattagtaacagatggctgcattttctcaagggatctgtgtggcttttaaatctaaatcatccacttacaggacatttgcaaagcaagaggttttagtccccattttctttctttttttttttttttttagtagagacggggtttctccatgttggtcaggctggtttcgaactcccgacctcaggtgatccgcccacctcggcctcccaagatgctgggattacaggcatgagccactgtgcccggcctaagtccccattttcttttttcttttttttttttaaatgagacaattatttattttaggcagatagtcaacttaaaaatcattcagcgtgggcactcctgaaactgtcaggatcatgttggtttcctcgctgtttgccggctattggcatttgtgtcatcacacacagtccgatgaggtgacaacagaaaagcatatctcacttctatcgtaggtttccattcactttcgggttctcaatcgccctgtgtttcctcagtgatactccagactttccagatgttctggttgacccattcctctttcttttttttttgcaaaacaaagcaaaaagcaagaagagaactttacattttgtccaatagtcctaagaaattttccctgtagagaatgtcatctaagtcaaaacaagggttgaataggggcacccaaatcagttatcacttagggctgttataagaaatgccaagactgggtggcttaaacagcagatattcgtctctcactgtctggaggctacaaatccaagatcaaggtgctagcatggtcagttctggcgaggacctgctactgggctcaagagcactaccttcccccccgtatcctcacatggtcggtctccagcctcttctcataaaggcgctgatcccattcatgagggctccactctcacagcgtaatcacctcccaaaggccctgcctccaaatactgtcacactggcattaggatttcagcataggaattctggggggacacattcagtccatggcctcccgtacctgtgaatgtgatcttatttggaaatagggttttgtaggtgaaattaagttaaggatcttgagataagatcatcctggacttagggtggaccctaaatccagtgactagtgtccttataagagaaagaaaagagagattggagacacacagacaccgtggagaaacgcaggagaaaaggtcctgtgaaggcagagaggcagggacgggagtgacccagctgcaagacgaagaacacctagggccagcagtagctggagaggcaggggcgagggcgatcctcccctaggacctagggagagagcgtggccctgctgccacctggattctggatttctgttttgagccatcacgtttgtggcaactcaccctggcaggcttaggaaacgaatgcgttaacccattgcattagcgcacaaaataacaccctgactcgtttcctgcgccagcctcctaccttgccttctacttattagaccctacctctcattccccattttttaaaatttttatttatttatttatttatttatttatttatttatttatttatttattttgaggcagggtttcactctgttgctcagcctagaggtgcagtggcgtgatcatggctcactacagccttgacctcctgggcttaagcaaccctcccacctcagcctcccaagtagcttgaactgcaggtgcatgccaccctgcccagctaattttttttttttttttttttttttttttttttggaaagacgaggtttcaccatgttgcccatgctggtctcaaactcctgggctcaagcaatcctcctgcatcatcctccagaagagccgggattacaggtgtgagcccccacgcctggcctctccctcctttttatcattccctcttccctcgtcttccttggctttcctcctcacacctcctgcgtttggcccccttccattttcttttctgcttctcttttcccaacttccccctcatcatgccagggggactcctgggctgcgtgccacccccctggaagtcccccataatgaagcaggatttatgcctcacacttcaccatgggagagcagaaacctctcacttgaagcaaaaggcactgaaaataagcaaatagttatgcatttgtcactaccgagtcctagctggcttccaccctaccccccgccccccaccatcttcttgctcattcaggtcatcgtgttctctgatacccagtaacttccatcattttctacatgcatttctgttggtcttctgagaattgtgattttccaaagtagaaagggcacatcgtctttttggagcctcaaaggtgcagacactgatgcgttgggggagatcacagtgtgacaaggatggggtgggagtgtgtcacccccctttctaccgaccctcagcagtggggagagagcagaggagatggaacctgagaggaagaagagatttccaattacttccttctcggtcccttctccactgaagcctgttactcctctgctgccggggcctcttgagttttctctcactgagccaggaaagagcttagtgaataaagaacaaggtatcccagcaatgcagggaagatgtccaggacagtgagtgtgaacgaggggtcctggagaatgtgcacgccagccctgcaggagaatgtccacgccagccctgcagcctggtgggctctgccatcagcaccccaaaaccattcatcagtcaccttcgacaattgcacgtgcaaaagccctctttttgtgtcctttgaagctttttttttatcaggctgggtgcgtggctcatgcctgtaatcccagcaccttgggaggccgaggcgggagaatcacttgagcccaggaggtcgaggctgcaatgagctatgatcatgccactgcactccagcctgggtgacagagtgagggcccatcccttcgcgggtccccattaagaaaatgggggagggacagtccccattttcttaatggggactttcttagtgaaatttgaaatgagagattattaatatgagctgggcctaacatctttttttacttgcagttggggcagagctccagggagttggttttgtcccctgctgtcttgtcccctccccctttttaattaattagggcctggctggactcacatgcaggccgctttctaagagcagcagttactttggcagcattcagaaagggcctcagttactctaccatgacaaatttctcagtctgtcaccgttcacttcctaaaagaaattcattgtagaaggtagaatgggatcttcatggcatttctgattcacaatgctcctgaaagttcctcggcatgtggaaaggccacagatgaatttaagcatgtgaaagaatactcatgtcagaggcacaaaggaaacttgccccgagtccacggtgctctgcggttaggagctggcctcactgtgcacagggggaggggtggtgagcttaccgggctttaaagcgcccttccaacctgtgagccctgcattccttacccttggttggattcttcccgggctgggagaaatgaccgcttctatgaggagaccatgtgccgaggtcgtgtgctaggaagccagttgctgtgagaaatgaccagtgtcatgtctgtctttcagccaccctacatcatgtagcagttcttctgagatcatgtctgtgctgttcttctacatcatgaggtacaagcagtcagatccagagaatccggacaacgaccgatttgtcctcgcaaaggtatgccggtggggagcccagggctgctgtggcgcctgctggttaagcccagtttgaacagccaccgtgtgggaacaaggcctgaaatgggcctcgtttattattttggttcttctttctttgcatcttaaagctcgagtgttctagtgagggccacttggagccctgtgatggcatggtaggaagggtggcttgggagagctgactgtccttcctttcctttggtcacaccctgcctcgccccacttagcacgaacgcttcccccatggcagggttatgctgctcccaccctctgtgctgcctgaggagaggcaggcagcctcagtgaatcccactcactgagcctgggggaacttgagtgtaaccgggagggacatcccacccctgtcagttagcttcctcttctatgtttctgcacatctgacctgaaactgatgggcacttctcatgagattgggcaaaataccagccacttcatgaagtatcatgggtgataggaaagaaaaagaaccttaaaaacaaggtcagtttgagaatgtgtggctggtttgatgccatctcaaagtacactgtgtcccgaagcaaattaaaacctggctaggggccgggtgcagtggctcacgcctgtactcccagcactttgggagactgaggtgggtggatcactggaggccaggagtccgagaccagcctggtcaacatagcaaaactccgtctccacttaaaaaaaaaaaaaattagctaggcatggtagcacatgcctctaatcccagcttttcgggaggctgaggcacaagaattgtttgaagctgggaggcagaggttacagtgagccgagatcgtgccactgcactccagcctgggcgatagagcaagactccatctcaaaagaaaaatctggctgggtagagtactgtgtccaaatagaaatgccagattagcacagtgggaagtgaagacaaaaactgggcatagctgaagtaagtgcctaaaggtcataattgtgacccttgtcttggtgtctgaaccataacatcaaatggtttggcaaaaaataaatagaatttacatgtgtacgcgcatgtgtggagagagggatgaagtaaatgccttccattgctttcagttggttattggaggtaagcagtatacaggaaggaaatcattgtgctaggctttaaacatgtctataaacttgaactttttttacatctttttttgttctttttttggggaggtagagtctcgctcttgcccaggcttgagtgcagtggctcggtctcagctcaatgcacccctgacctcctggcctcaagcgatcttcccatttcagcctcttgagtagatggcattacaggcatgtgccactacgaccggctaatttttgtattttttgtagagacatggtctcactatgttgcccaggctggcctcaaactcctgggcccaagcgcccacctctgcctcccaaagtgctgggattacaggcaacaagccaccgcttccagccctctttacaatgaaaattgaaaaaaaaatagatatataaacgcaatatgggtgtttagatttctggtttaaaataaggaaaggctgggtacagtggctcacaccagtgctttgggggctccagcaggaggatctcttgagaccagcctgggcaacatagcaagaccccagtgtctacaaaaaatacgaaaattagctgggcgtggtggtgcgtgcctgcagctactcaggaggctaaggtgggaggatcacttgagccttgggagatagagcaagaccctgtctcaaaaaaaaagaaaaatctagactgtcatataacagctgctatcagagccattggccttaggggatgaagaggctttctatcgggcagcagcacaccaggccctgttcggctgccagaatttgtgtgttcatcagatttagctggctgatgaaattggaacaaaagagaaaacacatgaagcatagtccattgtggtttgcctgggaacggggtaaacagctatactccaggcagagcagatctttattctagcctttcacctccctgaatcgtctgccccgcagcataagggttcttgagaaagacagcacccatgtgggagcacttctgccataacgggcatcatactgatgcctcaccattttctcaatctatcctcactttatccttgacctcctgtcacctaagggggctctggtctccattgcacccataaagtctttgagatgggcccactggcctcacacttcacagccagagggaagcagagttggtctgactgctgagcccaggctcggtccattatgttataggacttccaagggcatgcaaggcgactgggagccagagcttgttacgtgagtgtggtgggtgccatagggagggagatgtggctagaggcatagtcaaaagagacttgagttgagtggggcagttctgctgggctggaaatgcagaaccaaaagggagtctctggggggcacaaagcatgcagagaattccggggaaggtcaagagcaaccagagagtagcagagggtaggaagcaagaagcaggagatcagagaatcgtaaataccatccatccatctacagtagtgatgacctcgctcatctctgctcgaatggcgctgacgtttgagcagaggagggtgacaggcaggaaacaaacttttaagtcaatagatggagtgtcaggtggggccaagcatctggaatcaagtaaaagtggaggaggtaggaggcactggttgaaaaagagtggtccagaaagacctcagtgctgacgcttgagcagggatttggaagaggcaggagagtgagctgtgcccacatccacgcacaagcactccggtagtgggtgccatgagtgctaaggccctgaggcaggtgtatgcccactgtgttcaaggagcagcaaggaggccagggtgccagagcagtggaagggagaaatggaggtgatgggggctggggtgggcagacaggtgcaaacagttgagctctacttggtgggaggtcggaagaccttagaaagttgagcgatgtgatcagtcaacttcagttttaacaggctcccccttgtggctagattgagaatggctgtgggggaggctgggaggccactgcagtgacagaggcaagggatgtttaagaccaggtcgaaatggtggctgcagaagctgttgggtaaattcagtatgcttgcaagttgggcctctccagtcagtgcagcagctctttggcatgaccttgtggcccacagagggccacattttctgcttgggatagtgatgaccctgtgcctgcaaacaggatgttgggggtggggtagatgctagtagaaagggattcatttctagcgtgggcacttctagatgagcacgtgtaagatctcagttgacctgagttttataaaccagggaaccagagtattctctttctggtttctgttttaagaatccatatcctccataggattgaacatgtgatttgtgcatgaccgggaagggccatgggaaaatgtcaagaatcatactttacgttttctgctttgtacttgggctccccgtctctattcccaaagctccagccacccttgccatactgtatggattacctatgactccctgggcagggacagtggatgtcttcgtcaccttagtcacctgagtttccagcccaggctgagccctgggcttgacccattttccacttgtaacgttgatcggaagcttggggtgcatatgggtgtggggaagaggaattcacccagcagggcgggaggggctgttcggatgggacgctgctacagagctgacaggagcagcctgcactcagtgcgtgagtccacctgataccatgtcctgcagctgcgtctgggctcactgggtcccttctcttacagagactgtcgtttgtggatgtggcaacaggatggctcggacaaggactgggagttgcatgtggaatggcatatactggcaagtacttcgacagggccaggtgaggttcttccccagaagccatttaactgccctacatctacatccccttcctagagtctcggggggcagccacctatctccgtgatgtggagagccctgaagggccagtccccatcacatcccgtggtgacccctctggaaggccttccctgtgccttttccccacctcgggcggctgccccactttctctcccacaggtctgttgaaaggtttcagctgctgttgcctttccattcttatcctagggttgatagcttttttaaaacttccagcactttagtggggtctgggatgtgtggtttgtttttgagactgagtctcactctgtggccaggctggagtgcagtggcatgatctcggctcactgcaacctctgcctcccagtttcaagtgattctcctgcctcagcctcctgagtagctgggattacaggcatgcaccaccatgcccagctaatttttgtatttttggtagagatggggtttcgccatgttggccaggctggtttcaaactcctgacctcaggtgatccacctgccttggcctcccaaagtgctgggattacagatgtgagccactgtgcctggccagatgtgttttcttgatgcgaacactcacgtcgttggttgtggaggaatttacttcacagcagaacacgtttccaaggtggggtgttttgattgttgtgattattgtaaataagttgtaagaacagaactagcaggtggcggcgggaggcggtggctcacgcctgtaatcccagcactttgggaggccgaggtgggcggatcgcctgaggtcaggagttcgagaccagcctggccaacatggcgaaaccgcctctctactaaaaaatacaaaaactagctgggcatggtggcgtgggctgtaggcaggagaattgcttgaacccgggaggtggaggttgcagtgagccaagatcacgccactgcactccagcctgggtgatggaaactctgcctcaaacaaacaaacaaaaaaattagaaggtggcaatgctttaaaagggaacttaccagaaaaatgaatgtgtaaatgtttggggaacttaaggatgctgctttcttccccttcccctctggccctgtttgcttattgataaggaaatgtggcagaagaacctaaaagttgctttacagctagaacagaaaactagccagaggtaaagcctgcttgtgagcccccaggcttttcaagctcggctttcttagctgctgggctggggcagagttgatgagggagattgtgggaagcgaatggtctggagcagcagctccagttgcgtccgtttctcctcctgaaatgcatttgtttggttggcccagatgatcccccacagggtcctaaacctctcttgtcttgctccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtaactgtattctcttgtgcttgatttccattctgtcctgcccccttcatctcttgtaacccagcctgctcctctgttggcaggtggaacacttatgtggtggacggccgggacgtggaggcactgtgccaggtattctggcaggcttctcaggtgaagcacaagcccactgctgtggtggccaagaccttcaagggccggggcaccccaagtaagcaagcactttcctcctgctcctggttgttaaaagcatctgtccgctcagcagcagaggcgggagaggcttagaggggcctaggcagatgactcatttagtgaatagcagttctgcctggagtatatgttggaggctcctgctctcttattttcactagctagtgtctgcttaggataggagatatcaaaagccctagcaggtgaacagtgatgtgctgcctgcacaagggagtggctaggagtacagcccatcggaggactgacagggaacaatctctacggttagtagaatcagaaagcgtgctgtgtgtatgagcaggtgcaagaaataagagtgcatacctacacacgtgcctaggcccacactcttctggaagaaccctgggaattggggaagacgggagcttggaatcaccaactatcacatttcaaggctgacagctgaaattgtttatctcaggtttaactcatcacaaagagtgcggctcctggatttttttaaaagactatagacattttagaataaaactgttctgtgactcctaccgaaaatatagttttactctggtaccctccgttcagtaaattattttaccagtgtgctcctggcaggaccctgggtgttgtccttgcctctgcctccccctcatatgcccacacatagacccagtcccctagattacatcttggacccattcactcctccccatctctactaccatgactgttgccacacccatcatctctcccaaagttccagctggcctccctccacaccagtctctacactgctgccacagtgatctttctacagtggatctgatcagtcactttccccactccaaacccttcaatggtttccaatcttgctttggataaaactcaaacttctcatacccacaagacccaccctccatggtctgccctacctgtctctccagccttattctcattctcccttccactcaccagtggccctcaggggcatagctaggtgcaatggcttgcacctgtaatcccagctacttaggaggcggaggcgggaggatcactcgagcccgaggagttggaagctgtggtgagttatgatcacccactgcactccagcttggggaggagtcatagcgtgagacccctgtctcaaaacaaaaagcctcagggcctttgtccaagctgttctctctggctgcagcagcgtcccaggccctctgtgccaggtgttcctcctgtgagtcctagggtgacatctttttcatcggggtctgtttttcaggtgacctcataggcactcactaaatatttatggaatggatgtcttttgtttgtttcattacaggtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaaggtaggcagaaaggtggataattgaataaatcagatacgtcaactgctttgttctctaatgttgttcgtatgtacacaggattcttcatttattctggtctccatggacgaaccaattactagagtgacatgtaactaacagttcgtaggcaataaagagaggtttgccatttttaaaaaatacatttaggggtccaaagtgcagctgtgtcacgtggatagatactgtgtagtggtgaggtctgggctttcagtgcacccagcatcggagtagtggacattgcacccagtaggtacttgatctttcaccactcctggctccccttctcttttattaggtctgatttttatttttggctttcacatgtgtgtctgaattttctgattggtcaattgctatttattagctcctggtgtggtgtgcctttttctagcttcctaactttggtttgtgcatgaaactgccacgactctgtgtctccgctaagaagactggccccaggcgggctgaccttttgaacttactctctgaattacacagaggagcaggccaattcatcagaaacctcaaaaaggaatcaaatgatgcacaaaactcttgagtatcaagtccttttggtttttagcacctttacatcctgccttctggtatatcatagcagacctgacataggcaagttctttatggcctagaggaagtaaggcggcgagcctagggaggaaggacacactttctgatccttctttatttggagaaattttgagtgttgctcatgttttcttagcctggtaatgagggttaaaaataaatgaattttgaatacttgagaaatcaaaagacaaaaaccagaagaaaggagacggtatatcaacaaagggtgggcaggcacagtggctcactcctgtaatcccagcactatcaggaggccaagacaggaagaccacttgagcccaggagttcaacactagcctgggcaaagtagtgagaccccatctctacatagaatttaaaaattatccaggcatggtgccataatatggttccaggtactctggaggctgaggcaggagaatcacctgagtccaggagtttgaggggatagtgagctatgattgggccactgcactccagcctgggcaacggagcgagactctgtctcaaaaaaaaaaaaaaagtttgagaaaactatataactccatagttgcataattggtatgaaaatgtgtaaaaagcggggggaccatttttaggaatacataaaatatcaaaattgactaaaagaggtataaaaaccttaaatggatcaatagccctagaaaaaaatggagaaaattatccaagtgctatacccccaaagcaccaggctcaccaggttatataagactgactcatttttaacctttatgaaaagagtaatttctaaactgtttcaaatttttccaaatacggaggaagatgaaaatgtcatcccgatttacttatgaagcgaaaatgtgacaaagctagcctaaagaaaactgcagagcaactttctttatgaataccaatataaaaattctaaatagaacattagcccatctcaacttcattagtacattaaaaaaattaaatgaatcagtgagctcaaattagtaatgcagatgactcatgccaggagatgtaggaatagaattcagtgttctagtgttaggttaaaggaaggagggaagtgtgatcatcatcatacacactaaacaaaagcaattcataaaactcaacattttttttttgagatggagtctcgctcagtcacccaggctggagtgcagtggtgcaatctcggctcactgcaacctctgcccccggattcaagcgattctcctgcctcagcctcccaagtagctaggattacaggctcccgccatcatgcccagctaatttttgtatttttagtagagacggggtttcaccttgttagccaggctggtctcgaactcctgacctcaggtggtccacctgcctcagcctcccaaaatgctgggattacagatgtgagccagcacacctggccaagtaatttgaaaaatataatgagaaccattaatgtcggaaatctcactcttgagctgtggagtgtttacctgcttaggaagtgggggttgggggagcgggggatgttaactaaaaagagcacaatttgagaaaaacttgggtgccacatcagccatttagtatggatttaagattggctagcagtccatgtttatgacattaaaggaaatttttggtgagtcacgaatttactttcttcaagatagatgataatttgtcattctacaatatggtaccttccttctgtagtcgttccttctaaatgcatttgaagaaactctaccacctgattgtctctgtcttctagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagtgtgtagtgtctctcagggcttcttagaatcaatggcccactggacacaggaggcccagcctgtgctagtttttctttccatttatgaaagcaaaaggactggaaaaaaatttcctgggaagcaggaggcaagtagccaggtggagtctgagaggtggcttctaggtctgctaggagggccgtaatagactactcggcacttggagtctccaagttggctgagggcagcaggcaaggccacagacagtgggtcctctgagcctcgaaccatctgaacccagggctctgggcctgaagcatcccaggctccctagtagctccttctgcccaattctgcaaccacccagaggcacactggctgaggagtcacagggaatgcagagtttccttctctccactgtagaggggcctaatatagcacagaaatgcaaatgttgcacttacttcaatcacaagaatatcaatgcttagagctggtgccttaggcaaagccattctgcttatctatgcctcagtctctccccagagtgatattaatgcagggagtatctcaagcacatgcacacaagcgcacccctctggagaggaaggagttatggccagtaaaccctttgaactctaaagctctgcgcgtcatagaagatgatgcccagctcctgtcattaggccagaaaaccacaggccagcaggtcttatgtgaccaccagtgactttatttataacaagtagtatttttaaaaaaaatttttttagacgaagtctcgctctgtcgcccaggctggagtggagtgctcagctcactgcaagctccgcctcctgggttcacgacattctcctgcctcagcctcccaagtagctaggactacaggtgcccaccaccacacccggctaattttttgtattttttagtagagacggggtttcactgtgttagccagagtggtctcaatctcctgacctcgtgatccgtccgcctcggcctcccaaagtgctgggattacagacatgagccaccgcgcccagccagtattttaaattttttaaaaattagttgccagcatttaaaaatcagattataggtgtagtggcaccagcctgcagtcccagctactcgggactctaaggcaggaggatgcttgatcccaggacttaaacgctgcaatgtaccactgcattccagcctgtgaaacagcgagaccccatctcaaaaaagaaaaagaatcaggaggtcttatatagaatacatatttctggattcttttgaaaaatgggaagaactactaccatagggtggcattccctcctgacgccagttgactgaagccaaacagcacccctgttgagatgggtgtccccacagctccccatgctctgctgggccatttgggttttttgttgttttgtggtttttggtttttttttgggggttttttttttttgagatggagtctctctctctctctcaccgaggctggagtgcagtggcacgatcacagctcactgcaacctctgcctcccaggttcaagcgattcccttgcctcagcctcgcaggtagctgggattacagacatgcgccaccatgcctggctaatttttgtgtttttagtggagacagggtttcaccatgttggtcaggctggtctccaactcctgacctcaggtgatctgcctgcctcagcctcccaaagtgctgggattacaggtgtgagcccccgagcctggctcattaagctgttttcattttgaatagaaaacaatgcgatccgtaattttctggattaatgctcctgtcaaaaattttgctccccacctcactgattgcctcagcacgcagccatgtagtctactccgtccctgctgatatgttctcacagttggaaaaaagttgtaaagaaaaggcgagcaggtggtatttagtgccatgttgaaagaggtggctacaatgtagagcttgaccaggggcagtcagggacaacctctcagaaaaggtgatacttaagctgagtctcaggtgacgaggggtcagccgtgtacagatgtgggagacagcatttcaagcaaggggcatggccaactgtaggcaggcccaggcttggaatgtttggagagcagaggaagggccaagtggtaggagcatggtgaacgcagaaaactctccagggcccaggtcatacggggtcttataggcgcccttttcagtatctctggttctcttgcagtttgctgggaagccactggagggctttaagcaggaaagcaacagcctgcgttttccaaaactctgaagactggagaatggcttcacgtaggaaagggaggagaaggagagggtgacttggaccagggcagtagctgtggagtcggagggaagcagacttgtcacatattgccttggcaggagagccagcaggatccaacggcaggtgtcaggacaggacccaaggctggtgcttgagtgtgggtggcagcacctgggggaaggtggtgtcacctcttgagattgacaagactgggggagaagtggactggggggcaccatcaggagctctgtgtgggcctggggggttggggcacctgttagatgtacagaggggagacagtggtatcagatggctgggcagtagatcagtcagtcattttcacatgtggccgctccacaccactaaatgcagttttctaaactacatattcgttggcctagttttaagctaacatcttttttttatttttattttttgtagagatggagtcttgctctgtcacccaggctggaatgcagtggcacaatcatggctccctgcagcctcaaactcctgggctcagggggtcctctggcctcggcctcttgaggagctgggagccgccatgcttggccacatctacatttttaatcataaatttaagtcgttgcaaaggatgtagttgttcatatattgacatttttgatactttaatactcaaatcatgccattaatgatgacactggctgggcatagtggctcacacctgtaatcccggcactttgggaggctgaagctggaggattgctggagttcaagagttcaagaccaggccgggtgcggtggctcacgcctgtaatcccagcactttgggaggccgaggcggacggatcacgaggtcaggagatggagaccatcctggctaacatggtgaaaccccttctctactaaaaatacaaaaaaaaaaaaaattagccgggcgtggtggtgggtgcctgtagtcccagctactcgggaggctgaggcaggagaatggcgtgaacccgggaggcagagcttgcagtgagctgagattgcgccactgcagtccagcctgggcgacagagcgagcctccgtctcaaaaaaaaaaaaaaaaaaaaaagttcaagaccagcctgaacaacatagtgagacctggtctgtaattaaaaaaaaaaaattcatgccaagccacttttctttgtcagaaattaaaaccctttttctacttgatttccaatttccattccattcatttccccaatatatctttatgcatgaaagccttttattgattgtcctatcatttttctctgcaacaaaaatatgcatataaattgataggtttttaaaaaattataatataggcttctgagcattaggtttttttttctggactgagatagaattttgattattattagctggtatgttagtggatgagtatacttgtagtttgaatgtgatagcattgagaacagattctattcctgtttttcatcttcatgatgtgctatgaaaccttacttacatgaataagtagatgggaagggaagttttgttagaggaatgtcactcagttctttgaattccttcccagttgtaagtcaaaaaatcacatagtgatctttcatgtaaagttgtttataaaagttatttacagagttgacagtttcattaattaagttcttcactttctctccaccagcatagttatttcaaattgtcctctttacttgggtctggaggttctgcactccaggatgatccccctgtaagagtcaggtggctgagagcatgccctttggggatcaggttgctagaaggtgattgttaaaagagacagttgggagacccaggggcagtggctcacgcccgtaatcccagaactttgggaggccggccgaggtgggtggatcacctgtcagttcgagaccagcctgaccaatatggtgaaacctcgtccctactaaaaatacaaaaattagccagacgtggtggcgggtgcctgtaatcccagctactcgggaggcagagacaggagaatcgcttgaacccaggaggtggaggttgcagtgagccaagattgcaccagtgcaccccagcctgggcaacagagcaagaccctgtctaaaaaaaaaaaaaaagaccatgaggggagcacagaccctccttttggcagatgaatgtagacagagttgatctggagtttgggatcttgagtgtaacacccacagccacatcccctttggaaagcctgtgtgtatccgcagagaggtttgtattctagtttgaagccttctggggtatttgagcccggacttctggggaaggggggtaaggaatggcaatgtaaagtggggatcattaccagaatgcacatcaggggagcattgggccagatgcgacttcccgagggtgcacagggccctgaggacttgccccagcagcgcccatgaggcgacagcagtgggccactgccacactgcagaaaccgagaggaggaaatgccttgagatcaggggccaagtcaagtcacaggccacccaaggtcaggcagcctcttggttttgtggcttcgaggtcccttgtggggatggtggcctagatgaagtaggctgggaagagcgtggaaaatgagaaagcaggggcaatgactataggcaagttttgagaagtttgctgcgaaggagaacacagatgtaaaagcaggacaaggcggagatggggctgtgaagataaaaggtgctggcgcacacctgaatggaaatagaatgatccaagagaaagggaagtagcacaagaggggaggaggagctgcatggctggagacccctgtgagaaagcaggaacaggacagattcaggatgtcctgtcggggcatggaccctggaaagctgcggacaccaggagggcaggcaagagagtctcatctcttgctccctaggagctatgagttgagggcgccgtctgagcaggagggacggacgggtgcccagggtttgaggaaagaggggtgtgggaaggacgcatgctagaacttcagagcagttcagcaggtgcagaatgggagttatcatggggactgtgggagaaggggcggtgggggcaatgcccagggatgttctgattcatgttctctgtgctgcaggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtaagggttctaaatgccatcatcttggtagccttcctccttcacagagaaagattagcatgtgattggttaaaccacgaatttccttatggttccatgaagtttgattattcaagcctttttcttgaaaaagccatattgtactttaaaagtgtcagactctcagggcaacttttgaagtgcatctctcggtggtactgttgtttcagacagtgagaaacagttgcttatcccgagtgccccttgtgtgttgagctgcgtgcaggttatggacaggactggcagagtcatggagccttttctgccctcgctgtggttgcagtctaactgagggtgaacagcatcacagaggacgaggagcattctggctggctgcacagcctgctcaggtgggaggggggctgggaccaccatcaccaccttcctgcctggggcagcgagaaccctggagcgtgacacgaggcaggaactcttacaaacacacccttctcagagtagtagtcacctggcaggtgggctagaaggaaaccacaggaaacgggaagccagagaggggattgaaacaaggtgtgcaaggtggtgggggagaaaaccaggggggtggggggggacctgagagtgaagaaagaggtgagtgtgcctaacagatggagcactctgcaatggcgtgaagagcaaaacacacgagtctccgggattcctcacttgggaaacgtcagagagtcattttcgtgaatgacagaaatgacatgggaaagatgagccagctggcgtcctgtggcaggcagatgggcttactagatgtggctgcacacacttgcttctagaatgccagagatgcacgctggaaagccatctcagggactccctgggagaatgaggctggacgagatggctctagatggagctagagtcacggctgtctgggtgaagctggaggcacaggtggtggccagagagaggaggcgcggcagtgttgcaggggcagaggggcctaggaaagggtccttgagcccacctgtggctgtgctcagtttcagttttgaaatagtcacatggagaaagtgactctaggttccatccaaagaagaactggaaggctgggcgcagtggctcatgcctgtaatcccagcacttggtgaaaccccatctctactgaaaatagaaaaattagccaggtgtggtggcacgcacctgtattccagctactcaggacgctgagacaggagaattgcttgaacccaggaggcagaggctgcagtgagccaagatcacaccactgcactccagcctggcgacagagagaggctttgtcaaaaaaaaaaaaaaaaaaaaaagccagagcggtggctcacacctgtaatcccagcattttgggaggccgaggcaggtggatcatctgtggtcaggagtttgagaccagcctgaccaatatggtgaaaccccatctctactaaaaatacaaaacttagccagacatgttggcacatgactgtaatcccagctacttgggaggctgaggcaggagaattgcttgaacctgggaggtagaggctgcggtgagccaagatgacctagtgcgctcaagcctgggcaacagagcgagactctgtctcaaaataataatagttaatttttttaaaaaaagagctgggctgttgaggttagacagtggtcctaggcaaggcagtgtgcatggtgacaatccccttcctagctgagaaaagctaagctgcccagtgcacattaagatttctctttcacatttctggtgagaaactacgttcccagatacaccctaaagtaccctgtagcaccctcagcatgctttgaaggtgtgttaactacttggaaggcctggagaaatgaaaaagaccactttggtatgcaaaacccggtctctggatatagaaaagatagagcagaaaagggagaacaaagcctgaggaccttcctaaagagaacgggttcagagacttagcaggccaaactcaggccaccaatgctcagccatcgtggacagtaacttggagtgatccatctgaaaagtcagctgagacttttcagttgactaacccgaggtgtcacagtgtgatctcaagggagacaggcgtgcaagaacacaatgtaaatgagttgtgaggatgcagcgggaccatttatggggctctgctacagctcgggacaccccgtggcaataggaataattgcttcttcagagctagaagtgggtggagggcaggttcctaatggggttatgctcctgttttcatcgggctctggttctctcaggtgacgatggtgcttcccagatggccctggaggatatagccatgttccgaaccattcccaagtgcacgatcttctacccaactgatgccgtctccacggagcatgctgttgctctggcagccaatgccaaggtatttttaaggggacactagtttcagacagaaaatgcttctggactctgctagtttcatactgatgattggacttttttttctcaacataaaagtgatattcattatagaaaatttggtgatagaattctttacaaaaaaaacaggagattatgcacacaaacacatttgccttgtaaaagagtccaacagtacaggatactgaacaaaacctgacagcctgtctcagtcagggtttagcagaagaaacagggaccattctgggtgttgtaaacaggagaaggtgtttaacaaagggtgcttaagaagccgcaggagcaagcttcaggcagagtcccagactatagtgttagtctccagtggctgcagccagaggccaagaagctcctgctgtgtcctgacatccaggaagctggagagcgggtggtaggctaccactacaaacgaacccgggttccctggccctggcttgcctttggaacagcttagggcgccaagagtgtgtgggacctcatgcaagggcatcagatggacagaatcaaattcctgttcagaacctagctgcacgggagacgaggcagtgtggtcttgatctttccagcctttcccactaacgttcagcaggtttcccttgccaccctggacctcgcccatgcgccacacaggtaacccctggcacagtcgggatggggactgtatgttccctttccaagcactcatgggcgtttctttgatttttttttttataagtgggctcccgctttacatattattaggtacttttttgtgtggtttttgtgttttgttttttgggttttttttctttggagacagagtctcactctgtcgcccaggctggagtgcagtggcacaatctcggctcactgcagcctccgcctcccagattctcctgcctcagcctcctgagtagctgcgactagaggtgcactccaccacggccggctaatttttgtatttttggggagagacagggtttcgccatgttggccaggctagtcgcaaaactcctggcctcaagtgatccacccaccttggcctcccaaagtgcagggattataggcatgagccaccgcacctggccaattgtgtacttttaaaattagtttatcttggagattgttctgtgatttcacacgttatagggtttcatttctagaaaggtcaagagaggcgcaaaacaagattaggtgatagaaattagagtagaggttgcttcatagtggggggagactgactggaaggaggcacaagggaactctgctggcggaagcgctgctgggcttggatgagggctccacggcggatgcagcattcaggaagggctgaacttaggatgtatgcatttcactgcagctgagttatgcctcggtgaagacactgaataaagatggatcatagcgtatgaacgaacagtagcgacgtttcttgctatattcgtttataatgcatccattaatatgtatgtaaattaacaaatactttagacatacaagtgttcatttatactggtaaatgtttatgtgctcaaattggtcataaaaatgtatttacattttattgggaaaggggccagtcgtcttgtattcagatagatgtttatggtctttctaaggatgaagcattacaagttattgtggcaaaagttaatgttttaacattctattcgggctttctagtcaatgtgagtcagtgctcctgccgtgagttaatgttctgtctgcacagaacaagtcagtgagtattggggaatcttccaaggggattggtgtgatggcatgggggagcttgtccttcagggcagccccaaggtcctgctgggacctgtcgtccactggttgtagatgctcacccctttctccaaagcctgtgtttttagtagaaagagctgtcctcttcacacccctccttcacttctttcaacgtctgttgttggaaattcattgtttgcttttctaaaccatggctccatttatgccctaggggatgtgcttcattcggaccacccgaccagaaactatggttatttacaccccacaagaacgctttgagatcggacaggccaaggtaagggcttacgcgctcctgcgttattcagtatcatctcctgtaaaaagaacacttctgaatctatcaccagctatcttcagagttgagacatcatcctttctttgctctcatttttttaaaaaacagttgtgacctttacctgcttttccttgggaaggaacattctatgaatttcagcttagcctgaacttttctgctttccaaatggagtcttttgttgttgttgagttcaaagatagtaacatgaagccacttgagcggtcgtggctataatttatcttggccgcaagctaaacaaaacagaagccagcgctttgggaggccaaggcgggaagattgcttgaggccaggaattccagagcagcctgggaaacatagcgagattcccatctttacaaaaattttttaaactagccgggtgtggtggcatccacctgtggtctcagctactcaggaggctgaggaaggaggatagaggagcgcaggaattcaaggcagcagtgagctatgatggatcacaccactgtactccagcctgggtgacaagagtaagaccctatctctaaaaacaagacaaaaaataatagaaatcacttgaaatgaataatctgttaggttcagattttacagatctaaggccaggaataaaagggaacatgatctctggtattctcacaaaagccctgagaagttcagattatcagtcctatctgtagatgaggattggagaaagtaagtgtcttacttaagggtttacagcttgtgagtaccaagaccagaatccaggcctgagtagtgagcccagtctccccaggtctgcccaccacgctgaccatcccctgctcagcctgcctgtcagggccatgcatagagaaaagcagaaacgtctatggagaaaataagtgactctgctcatcacctagggagtggggcttgtagacattttggcatgcttccttcctgtctttgttctaggcatacatgtatattttacacagttgagatcatactgaatagaaaggtttgcccatagccactcttgaaagagcagcaggtaacatccaatttggttgctaaggactaggctgctccagaattcacagttgcaagtactcagaatggccagagtgctgccataaagcaggtgtttccagaactgtccactgtgtgccataacgtagctggaaaacgccaccaaatggaaaagttagtgttcacctttggtgttaactacaggttctgtttctatggggagggtctcttgacattcacatggtttgcagagcttgcttatttctgtcgtctcttttctaataattttcctgtcctgacaaaagcaagtaaatttactgatagtaaaggatgtgagataaatgtgtgtgataacatgcatggcatggatcgttaaagggctgggctttgaaaagaggacatggatatgtgtgcatgcgtgtataagtattttaagaggccaggacatccttaaagaatggggtggctcagaaaccctttctgtactatcagcaatggttcttaagctacagggaaacctatacagaggggaagtggagaataattccagatgcctccgatgggtagctttggaggcaacaatctatgaaagaagcccaggaactctgtctttgcttgcagaatagtacgttgtcgagagcgagggctttgatgtcagccccgcctggctgtgggtcccagccctgccctgggccacttcctcctgctctgagatttgctttcctcagctgcagaacggttgtgccactgaacagatcttacagggaggctgtgagggttctcagagttcaggcacacaagatcttagcactcagcgtgttgccaatgcccagaatgttctcattaacatgttagtcactggagtccaatctttgcatgccatagtgagctctcaaaccagactcctgatgggtatgtggcgtatccatgctccaggacagctggagcagtgtaatttcctatcaaaaagtatgtgtcctggcttgtaaatgcatctgatttttttagtagtgagttattaaggagtgaaattgttagaattgggggatagcggcatagcaaagtgccttccactttgacatgcattctgtgtgtagtaaccacggcattctgttttgctggcactataccaggtcctccgccactgtgtcagtgacaaggtcacagttattggagctggaattactgtgtatgaagccttagcagctgctgatgagctttcgaaacaaggtcagttggttgagtatgagcattgaagttcaagctgggaagaggtaggacttcagctacctcctgtgccctgagtgctctttttatttttatccctgcatgttattctgagtctctttcttgtaccaagctggtttttgctgttctgcagatatttttatccgtgtcatcgacctgtttaccattaaacctctggatgtcgccaccatcgtctccagtgcaaaagccacagagggccggatcattacagtggaggatcactacccgcaaggtgtgtgtgggcattgagaatgctttggaaggttttggtgtttttgtttccttgattggccacatggcatgctctcaggcatcacctatagtctacctctcacccagcatggctttgttatttgatgttcactaagcgtggggccatactcatacacatctgtgtgtccccaacagagtgcacagtgcccagtcaccagggcgggtcagtggcaacacagaggagtggctattgcaggcaagcgaggtgtcatgaaaagcatcgcagtttctttgggtttggaatgatgaatagtatgccccaggccaggcgtggtggcttacacctgtcatcccagcactttgggaggccgaggcaggtagagatcacttgaggccagaagctcaagaccagcctggtcaacatggtgaaaccccatctctactaaaaatacaaaaattagctgggtgtggtggtgcatgcctgtagtcccagctacttgggaggttgaggcaggagaatcacttgaacccaggaggtggaggttgcagtgagccaggatcataccattgcactccagcttgggaaacagagtgagactctgcctcaaaaaaaaaaaaaaaaaaaaaaaaaaaaaaaaaaaaaaaaaaaaaaaaaaagtgtgccccgacgaaagcaggtatagcagagaacacagcaaatgcagaaaacagtgtgtcagggagaatgggctgggcagtgtttgcgcctggaaaggttaggtgggacagatgatgtgatacaaggagcattgagtgttcatgcggcaggggccctctgagcctgcacaagcggtgcctgatctctcgaaggactcctgggacccagcacacagttgctctcacacctgaggttgatgacagggaaagggtgcagggggggatccaccagggcaggaaccatgggccaggtggagttgaaagaagtcctgccccagcctccccttggccccacaaggggcatactgagaagtgcctcccacgcaggctgtgttcctgcctaagggatgcctgctagagacttggcacctcaagtgtgtactgggggcaggtcctgttggcaccctctgccaggcaggtacccaaatccctggctcccagcaggaaagcaggtgctcatgtcaaccacattgttcctacagacagtccaggtgcatgaccgccctgtctagtggggaaagtgttagagtagcaagggaaccttcacgagccaagagctaaccttgccaaccaacagcctcaagccagctagtcacttttctgcactgttaattcattagttctaaccattttcaggtccccaacagctttgagaatcagagtgccacagacccccacactcaggcagcccttactgtaggttgaggcagagcagtttggaaactggcagtttagaatgagaactccgcaggcccatcggagtggctgttcacatgaatcagattttcccctgggaagctgcagattcaaaggcctctatgtggtgaggctttaaggctgacgagctgctttcacaaaagggcctaacatccttgtttccccaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccagctgctttattca

SEQ ID NO: 4094 - DNA, 34676 bp, human
gatcccttgacttgcttgcggagggagcggccggcggagggagcggcaggtggagggagtggcacgaggcatgcggagggagctgcaccgacatcacataaacgcactgggcagctcgcaggcgccattcgctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccgggtaagttctcctcattgaagtctgggtcatgcagggccacgggcccggtggcttcaggcctggtggccatgaggccgtgtggtgaagggagagccttcagaggcacaatgggctgtgtcgtaatgccctgtcttgggctgttggggcccggtcgagcaccctagatggcagcgaggcactattcccgccaacccaagggtcggtcggttggttggtcagccgcgggttctggagcccgcccctcaatttacccacggccaaagttctggaggtcgccaagatctccagttgggagacaaaggatccagactggactgaggtggcgggagaatgtcactgggatcagattgggctagctgtggttttcattttagcggggagcagggcttccctggtaagcagttgtactggatcccgagggtgaatgagcgactctaacccaggatgtgaggataaaaagcaattaaaattccagcctgggcaacatggcgaaaccccgtctcttaccaaaaaataaaaataaaaaatgagtcgggcatgggggcgcacacctgcactcccagctattcgggaggcttgcttgtgctgttgggtttgctggtatgcagttgatggtttttgcatcagtttgagggatattggtctctagttgtattgtagtatttggttttggtatcaaagtgtaatgctggcttcataggatgtttcaaagtgttccatcttaaattttttggagtggctgggtgtagtggctgccacctgtaatcccaagcactttgggaggccgaggcagacggatcgtgtgagcctagaaactagttcgagatcagcctgggcaagatggcgaacctctgtacaaaatgttacaaaaattagctgggcgtggtggcacgtgcctgtagtcccagctacgcgggaggctgagaggctcaggttacagtgaactgagattgcgccaccgcactccagcctgggcaagagcgagaccgtgcctcaaagaaaaaaaagttaaacccagctgagggcggtggctcacgcctgcagtctcagtacgtggggcctgaggagggaggatcgcttgagcccaggagttcgcattcagcttggcaaacagtgagaccctgtctctaaaaaaataaagtaaaagaaaccgggaattgagtacgaattggaacaaaaatgagctgttgaatttgctagtatgcggttgatggtttttgcatcagtataagggatattggtctacaggttttttttgttttttttttctttttttgttttgagacgaagtatcactgtcgcccaggctggagtgcagtggcacgattttggctcactacaagctccgcctcctgggttcacgccattctcctgcctcagcctccggagtagctgggactgcaggcgcccgccaccacgcctggctaattttttctgttttttagtggagacggggtttccccgtgttagccaggatggtctcgatctcctgacctcgtgatccgcccgcctcggcctcccaaagtgctgggattacaggcgtgagccaccgcgcctggcctggtctatagttttgttgtagtatttgcttttggtatcaaaagtgtaatgctggcttcataggatgagtttcaaagtgttccaccttaaattttttggagaggtcgggcgtggtggctccaacctgtaatcccaggactttgagaggccaaagcaggcggatcgtgtgagcctagaaagttcgagatcagcctgggcaagatggcaatcccctgtgcagaatgttacaaaaattagctgggcgtggtggcacgtgcctgtagtcccagctacgcgggggacagagtttgcagtgaactaagattgtgccactacggcctggggaacagaggaagcgagaccttgtagagaaaaaaaaatttttttttgaggagtttgaagaagactgttgttaatttttctttaaatgtttggcagtaattacgaatgaggcttttatttattgggcgttttttttattactgctttagtctccttactagttagttgtaggtctattcagattttcttgtcctgattaagttttgtgaggctttctgtttctaggaatttatccatttcttgtaggttagtccatttgttggcatgcagttattcatagtacactgtcactctttttatttctgtagaagcggtattaatgactccactttaacttgattgtactttttttttttaagcagggtcttgctctttcacccaggctggagtgcagtggtgcaatcatagttcactgcagcctcgaactctcgtgggctcaagcgactctccttcctctcagcctcttgagtagctggaactacaggtgcacaccaccatgccctgcccatctattaatagctagttttgttgaccttttataaagaaccagctttggctaggggaggtggctcacgcctgtaacctcagcactttaggaggccgaggcagctggatcacttgagctcaagagttcaggacaagcctgggcaacatggggaaaccccgtctctgccaaaaatacaacaattagctagacatggcgagcacctgtagtctcagctactcggaaggctgaggcggaaggattgcttgaggctgcagtgagccatgtttgtgccctacactccagcctgggtgacaaactgagaccctgtctcaaaaagaaaaaaaaattggtttcattaaattttttctattttcttagtctctgttttatttgtgctttgatcttttttatttcctttctcctgctagctttgggtttagtccttacgttgtaaagttaggttgttgatttgaagggttatttatttattattattttttgagacagagtcttgctgtgtcgcccaggctagagatggggtttctccttgttggccaggttggtttcagacccctggcctcaagtgatctgcccgcttcggctcccaaagtgctgggattacaagtgtgagccaccgcacccggccagatgtgaggggttttaaaaaatgtgtttacagctagaaatgtcccacttggcactgcttttgctacatcacataggttttggtattttgtacttctgttttcatttgtctctaagggatttttcattttctttttctttcttttttttttttttttttttttgagacggagttttgcttttgttgcccaggctggagtgcagtggcacaatctaggcttaccacaacctctgcctcccaggttcaagcaattctcctgcctcggcctcccaagtagctgggattacacgcatgcacctccacgcccagctaattttgtgtttttagtagagacggtgtttctccatgttggtcaggctggtctcaaactcccgacctcaggtgatccgcccacctcggcttcccaaagtgctgggattacaggcatgagccaccgcacccagcctctcattttctttttttaattttaatagtgttaggggtataagttgtttttgcttatgtgaataaattctatattggtgaattctgagattttagtgtacccatcacccaagcagtgtacattgtccccaatatgtagtcttttatccctcacctccttcctaccttcccccttcattctcctccccaaagtccgttatatcactccaaaacttagctccacttacaagtgaaaacatacagtatttggttttctattcctgagttacttcgcttaaaataatgacctccagctccacccaagttgctgcaaaatacattgttttttatggctgagcagtattccatgttgtatatacaccaccttctttatccactcattggttgatggacacttaggttggttccttatctttgcaattgtgaattgtgctgcctataaacatgtgtgtgcatgtacctttttcatataatgactttttttcctttgggtagatagccagtagtggaatttctggattgaatggtagatagatggtaatctactacttttagtattttttttttttttttttgtcttgagacggagtcttgctctgtcgcccaggctggagggcagtggcgcaatgttggctcactgcaacctctgctgtccgggttcaagcgattctcgtgccttagcctcccgagtagctgggactacaggcacacgccaccactgccagctaatttttgtatttttagtagagacggggtttcaccatgttggccaggctgatctcggtctcttgacctggtgatcgcctgccttggcctcccaaagtgctgggattacaggcgtgagccaccgtgcccagcccgatggtgtattttgatgggaattgcattgaatctgtagattgctttgggcagtatggccattttcacaatattgattcttcctatccatgagcatgagatatctttgtttgtgtcatctgtgatgtctttcagtagtgttttgtagtttttcttgtagctgtctttcacctccttggttaagtatattcctagggtgggttttatttgttgtttttgctgtttacagctgttgtaaaagggattgagttcttgattctcaagcttggtcgttgttggtgtagtgctactgatttgtgtgcatttattttgtaacctgagactactgaatttgttcatcagatctaagagtcttttggatgagtctttaggattttgtttgtttgtgtttgtttgtttgcttgtttttgatggagtttctgtcacccaggctggagtgcagtggcatgatctcggctcgctgcaacctccacctcccgggttcaagcgattctcctgccttacccgagtagctgggactacaggtgtgtgccaccgcacccggcaaatttttgtatttttggtagagacaaagtttcaccagaccatggccaggctggtcttgaactcctaacctcaggtgatctgcccatctcggcctcccaaagtgctggaattacagatgtgagccaaccgcgcctggcctagggttttctagctgtatgatcgtatcatcagtgttacagcactagtttgacttcctcttctccaatttggatgccctttatttatttcgccattggcttttggttgtgtaagagtgtgttgcttaattttcacaaatttgtgaattttccagttttccatctattattgatttctaacctcatcccattgtggttagagaaaatacttagtgcaatatgtttttttaaatcttgttggccaggcgcggtggctcatgcctgtaatcccagcactttgggaggctgaggtggggtggatcacctgaggtcaggagtttgagaccagcttggccaacatggtgaaaccctgtctctactaaaaatgcaaaaattagccgggcgtggtggtgcacctctgtaatcccagatacttgggaggccgaggcaggaaaatcacttgaacccggaaggtggaggttgcagtgagccgagagagtgccactgtactccagcctgggcaacagagtgagactgtgtctcaaaaaataaataaataaatcttgctccagagcctgggctagatagtaagaggacagtgtggatgcagttaagaaccatatatgtctgaattttttgtacatgttcattttgttcccttcaccttcaaaattagtaacagatggctgcattttctcaagggatctgtgtggcttttaaatctaaatcatccacttacaggacatttgcaaagcaagaggttttagtccccattttctttctttttttttttttttttagtagagacggggtttctccatgttggtcaggctggtttcgaactcccgacctcaggtgatccgcccacctcggcctcccaagatgctgggattacaggcatgagccactgtgcccggcctaagtccccattttcttttttcttttttttttttaaatgagacaattatttattttaggcagatagtcaacttaaaaatcattcagcgtgggcactcctgaaactgtcaggatcatgttggtttcctcgctgtttgccggctattggcatttgtgtcatcacacacagtccgatgaggtgacaacagaaaagcatatctcacttctatcgtaggtttccattcactttcgggttctcaatcgccctgtgtttcctcagtgatactccagactttccagatgttctggttgacccattcctctttcttttttttttgcaaaacaaagcaaaaagcaagaagagaactttacattttgtccaatagtcctaagaaattttccctgtagagaatgtcatctaagtcaaaacaagggttgaataggggcacccaaatcagttatcacttagggctgttataagaaatgccaagactgggtggcttaaacagcagatattcgtctctcactgtctggaggctacaaatccaagatcaaggtgctagcatggtcagttctggcgaggacctgctactgggctcaagagcactaccttcccccccgtatcctcacatggtcggtctccagcctcttctcataaaggcgctgatcccattcatgagggctccactctcacagcgtaatcacctcccaaaggccctgcctccaaatactgtcacactggcattaggatttcagcataggaattctggggggacacattcagtccatggcctcccgtacctgtgaatgtgatcttatttggaaatagggttttgtaggtgaaattaagttaaggatcttgagataagatcatcctggacttagggtggaccctaaatccagtgactagtgtccttataagagaaagaaaagagagattggagacacacagacaccgtggagaaacgcaggagaaaaggtcctgtgaaggcagagaggcagggacgggagtgacccagctgcaagacgaagaacacctagggccagcagtagctggagaggcaggggcgagggcgatcctcccctaggacctagggagagagcgtggccctgctgccacctggattctggatttctgttttgagccatcacgtttgtggcaactcaccctggcaggcttaggaaacgaatgcgttaacccattgcattagcgcacaaaataacaccctgactcgtttcctgcgccagcctcctaccttgccttctacttattagaccctacctctcattccccattttttaaaatttttatttatttatttatttatttatttatttatttatttatttatttattttgaggcagggtttcactctgttgctcagcctagaggtgcagtggcgtgatcatggctcactacagccttgacctcctgggcttaagcaaccctcccacctcagcctcccaagtagcttgaactgcaggtgcatgccaccctgcccagctaattttttttttttttttttttttttttttttttggaaagacgaggtttcaccatgttgcccatgctggtctcaaactcctgggctcaagcaatcctcctgcatcatcctccagaagagccgggattacaggtgtgagcccccacgcctggcctctccctcctttttatcattccctcttccctcgtcttccttggctttcctcctcacacctcctgcgtttggcccccttccattttcttttctgcttctcttttcccaacttccccctcatcatgccagggggactcctgggctgcgtgccacccccctggaagtcccccataatgaagcaggatttatgcctcacacttcaccatgggagagcagaaacctctcacttgaagcaaaaggcactgaaaataagcaaatagttatgcatttgtcactaccgagtcctagctggcttccaccctaccccccgccccccaccatcttcttgctcattcaggtcatcgtgttctctgatacccagtaacttccatcattttctacatgcatttctgttggtcttctgagaattgtgattttccaaagtagaaagggcacatcgtctttttggagcctcaaaggtgcagacactgatgcgttgggggagatcacagtgtgacaaggatggggtgggagtgtgtcacccccctttctaccgaccctcagcagtggggagagagcagaggagatggaacctgagaggaagaagagatttccaattacttccttctcggtcccttctccactgaagcctgttactcctctgctgccggggcctcttgagttttctctcactgagccaggaaagagcttagtgaataaagaacaaggtatcccagcaatgcagggaagatgtccaggacagtgagtgtgaacgaggggtcctggagaatgtgcacgccagccctgcaggagaatgtccacgccagccctgcagcctggtgggctctgccatcagcaccccaaaaccattcatcagtcaccttcgacaattgcacgtgcaaaagccctctttttgtgtcctttgaagctttttttttatcaggctgggtgcgtggctcatgcctgtaatcccagcaccttgggaggccgaggcgggagaatcacttgagcccaggaggtcgaggctgcaatgagctatgatcatgccactgcactccagcctgggtgacagagtgagggcccatcccttcgcgggtccccattaagaaaatgggggagggacagtccccattttcttaatggggactttcttagtgaaatttgaaatgagagattattaatatgagctgggcctaacatctttttttacttgcagttggggcagagctccagggagttggttttgtcccctgctgtcttgtcccctccccctttttaattaattagggcctggctggactcacatgcaggccgctttctaagagcagcagttactttggcagcattcagaaagggcctcagttactctaccatgacaaatttctcagtctgtcaccgttcacttcctaaaagaaattcattgtagaaggtagaatgggatcttcatggcatttctgattcacaatgctcctgaaagttcctcggcatgtggaaaggccacagatgaatttaagcatgtgaaagaatactcatgtcagaggcacaaaggaaacttgccccgagtccacggtgctctgcggttaggagctggcctcactgtgcacagggggaggggtggtgagcttaccgggctttaaagcgcccttccaacctgtgagccctgcattccttacccttggttggattcttcccgggctgggagaaatgaccgcttctatgaggagaccatgtgccgaggtcgtgtgctaggaagccagttgctgtgagaaatgaccagtgtcatgtctgtctttcagccaccctacatcatgtagcagttcttctgagatcatgtctgtgctgttcttctacatcatgaggtacaagcagtcagatccagagaatccggacaacgaccgatttgtcctcgcaaaggtatgccggtggggagcccagggctgctgtggcgcctgctggttaagcccagtttgaacagccaccgtgtgggaacaaggcctgaaatgggcctcgtttattattttggttcttctttctttgcatcttaaagctcgagtgttctagtgagggccacttggagccctgtgatggcatggtaggaagggtggcttgggagagctgactgtccttcctttcctttggtcacaccctgcctcgccccacttagcacgaacgcttcccccatggcagggttatgctgctcccaccctctgtgctgcctgaggagaggcaggcagcctcagtgaatcccactcactgagcctgggggaacttgagtgtaaccgggagggacatcccacccctgtcagttagcttcctcttctatgtttctgcacatctgacctgaaactgatgggcacttctcatgagattgggcaaaataccagccacttcatgaagtatcatgggtgataggaaagaaaaagaaccttaaaaacaaggtcagtttgagaatgtgtggctggtttgatgccatctcaaagtacactgtgtcccgaagcaaattaaaacctggctaggggccgggtgcagtggctcacgcctgtactcccagcactttgggagactgaggtgggtggatcactggaggccaggagtccgagaccagcctggtcaacatagcaaaactccgtctccacttaaaaaaaaaaaaaattagctaggcatggtagcacatgcctctaatcccagcttttcgggaggctgaggcacaagaattgtttgaagctgggaggcagaggttacagtgagccgagatcgtgccactgcactccagcctgggcgatagagcaagactccatctcaaaagaaaaatctggctgggtagagtactgtgtccaaatagaaatgccagattagcacagtgggaagtgaagacaaaaactgggcatagctgaagtaagtgcctaaaggtcataattgtgacccttgtcttggtgtctgaaccataacatcaaatggtttggcaaaaaataaatagaatttacatgtgtacgcgcatgtgtggagagagggatgaagtaaatgccttccattgctttcagttggttattggaggtaagcagtatacaggaaggaaatcattgtgctaggctttaaacatgtctataaacttgaactttttttacatctttttttgttctttttttggggaggtagagtctcgctcttgcccaggcttgagtgcagtggctcggtctcagctcaatgcacccctgacctcctggcctcaagcgatcttcccatttcagcctcttgagtagatggcattacaggcatgtgccactacgaccggctaatttttgtattttttgtagagacatggtctcactatgttgcccaggctggcctcaaactcctgggcccaagcgcccacctctgcctcccaaagtgctgggattacaggcaacaagccaccgcttccagccctctttacaatgaaaattgaaaaaaaaatagatatataaacgcaatatgggtgtttagatttctggtttaaaataaggaaaggctgggtacagtggctcacaccagtgctttgggggctccagcaggaggatctcttgagaccagcctgggcaacatagcaagaccccagtgtctacaaaaaatacgaaaattagctgggcgtggtggtgcgtgcctgcagctactcaggaggctaaggtgggaggatcacttgagccttgggagatagagcaagaccctgtctcaaaaaaaaagaaaaatctagactgtcatataacagctgctatcagagccattggccttaggggatgaagaggctttctatcgggcagcagcacaccaggccctgttcggctgccagaatttgtgtgttcatcagatttagctggctgatgaaattggaacaaaagagaaaacacatgaagcatagtccattgtggtttgcctgggaacggggtaaacagctatactccaggcagagcagatctttattctagcctttcacctccctgaatcgtctgccccgcagcataagggttcttgagaaagacagcacccatgtgggagcacttctgccataacgggcatcatactgatgcctcaccattttctcaatctatcctcactttatccttgacctcctgtcacctaagggggctctggtctccattgcacccataaagtctttgagatgggcccactggcctcacacttcacagccagagggaagcagagttggtctgactgctgagcccaggctcggtccattatgttataggacttccaagggcatgcaaggcgactgggagccagagcttgttacgtgagtgtggtgggtgccatagggagggagatgtggctagaggcatagtcaaaagagacttgagttgagtggggcagttctgctgggctggaaatgcagaaccaaaagggagtctctggggggcacaaagcatgcagagaattccggggaaggtcaagagcaaccagagagtagcagagggtaggaagcaagaagcaggagatcagagaatcgtaaataccatccatccatctacagtagtgatgacctcgctcatctctgctcgaatggcgctgacgtttgagcagaggagggtgacaggcaggaaacaaacttttaagtcaatagatggagtgtcaggtggggccaagcatctggaatcaagtaaaagtggaggaggtaggaggcactggttgaaaaagagtggtccagaaagacctcagtgctgacgcttgagcagggatttggaagaggcaggagagtgagctgtgcccacatccacgcacaagcactccggtagtgggtgccatgagtgctaaggccctgaggcaggtgtatgcccactgtgttcaaggagcagcaaggaggccagggtgccagagcagtggaagggagaaatggaggtgatgggggctggggtgggcagacaggtgcaaacagttgagctctacttggtgggaggtcggaagaccttagaaagttgagcgatgtgatcagtcaacttcagttttaacaggctcccccttgtggctagattgagaatggctgtgggggaggctgggaggccactgcagtgacagaggcaagggatgtttaagaccaggtcgaaatggtggctgcagaagctgttgggtaaattcagtatgcttgcaagttgggcctctccagtcagtgcagcagctctttggcatgaccttgtggcccacagagggccacattttctgcttgggatagtgatgaccctgtgcctgcaaacaggatgttgggggtggggtagatgctagtagaaagggattcatttctagcgtgggcacttctagatgagcacgtgtaagatctcagttgacctgagttttataaaccagggaaccagagtattctctttctggtttctgttttaagaatccatatcctccataggattgaacatgtgatttgtgcatgaccgggaagggccatgggaaaatgtcaagaatcatactttacgttttctgctttgtacttgggctccccgtctctattcccaaagctccagccacccttgccatactgtatggattacctatgactccctgggcagggacagtggatgtcttcgtcaccttagtcacctgagtttccagcccaggctgagccctgggcttgacccattttccacttgtaacgttgatcggaagcttggggtgcatatgggtgtggggaagaggaattcacccagcagggcgggaggggctgttcggatgggacgctgctacagagctgacaggagcagcctgcactcagtgcgtgagtccacctgataccatgtcctgcagctgcgtctgggctcactgggtcccttctcttacagagactgtcgtttgtggatgtggcaacaggatggctcggacaaggactgggagttgcatgtggaatggcatatactggcaagtacttcgacagggccaggtgaggttcttccccagaagccatttaactgccctacatctacatccccttcctagagtctcggggggcagccacctatctccgtgatgtggagagccctgaagggccagtccccatcacatcccgtggtgacccctctggaaggccttccctgtgccttttccccacctcgggcggctgccccactttctctcccacaggtctgttgaaaggtttcagctgctgttgcctttccattcttatcctagggttgatagcttttttaaaacttccagcactttagtggggtctgggatgtgtggtttgtttttgagactgagtctcactctgtggccaggctggagtgcagtggcatgatctcggctcactgcaacctctgcctcccagtttcaagtgattctcctgcctcagcctcctgagtagctgggattacaggcatgcaccaccatgcccagctaatttttgtatttttggtagagatggggtttcgccatgttggccaggctggtttcaaactcctgacctcaggtgatccacctgccttggcctcccaaagtgctgggattacagatgtgagccactgtgcctggccagatgtgttttcttgatgcgaacactcacgtcgttggttgtggaggaatttacttcacagcagaacacgtttccaaggtggggtgttttgattgttgtgattattgtaaataagttgtaagaacagaactagcaggtggcggcgggaggcggtggctcacgcctgtaatcccagcactttgggaggccgaggtgggcggatcgcctgaggtcaggagttcgagaccagcctggccaacatggcgaaaccgcctctctactaaaaaatacaaaaactagctgggcatggtggcgtgggctgtaggcaggagaattgcttgaacccgggaggtggaggttgcagtgagccaagatcacgccactgcactccagcctgggtgatggaaactctgcctcaaacaaacaaacaaaaaaattagaaggtggcaatgctttaaaagggaacttaccagaaaaatgaatgtgtaaatgtttggggaacttaaggatgctgctttcttccccttcccctctggccctgtttgcttattgataaggaaatgtggcagaagaacctaaaagttgctttacagctagaacagaaaactagccagaggtaaagcctgcttgtgagcccccaggcttttcaagctcggctttcttagctgctgggctggggcagagttgatgagggagattgtgggaagcgaatggtctggagcagcagctccagttgcgtccgtttctcctcctgaaatgcatttgtttggttggcccagatgatcccccacagggtcctaaacctctcttgtcttgctccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtaactgtattctcttgtgcttgatttccattctgtcctgcccccttcatctcttgtaacccagcctgctcctctgttggcaggtggaacacttatgtggtggacggccgggacgtggaggcactgtgccaggtattctggcaggcttctcaggtgaagcacaagcccactgctgtggtggccaagaccttcaagggccggggcaccccaagtaagcaagcactttcctcctgctcctggttgttaaaagcatctgtccgctcagcagcagaggcgggagaggcttagaggggcctaggcagatgactcatttagtgaatagcagttctgcctggagtatatgttggaggctcctgctctcttattttcactagctagtgtctgcttaggataggagatatcaaaagccctagcaggtgaacagtgatgtgctgcctgcacaagggagtggctaggagtacagcccatcggaggactgacagggaacaatctctacggttagtagaatcagaaagcgtgctgtgtgtatgagcaggtgcaagaaataagagtgcatacctacacacgtgcctaggcccacactcttctggaagaaccctgggaattggggaagacgggagcttggaatcaccaactatcacatttcaaggctgacagctgaaattgtttatctcaggtttaactcatcacaaagagtgcggctcctggatttttttaaaagactatagacattttagaataaaactgttctgtgactcctaccgaaaatatagttttactctggtaccctccgttcagtaaattattttaccagtgtgctcctggcaggaccctgggtgttgtccttgcctctgcctccccctcatatgcccacacatagacccagtcccctagattacatcttggacccattcactcctccccatctctactaccatgactgttgccacacccatcatctctcccaaagttccagctggcctccctccacaccagtctctacactgctgccacagtgatctttctacagtggatctgatcagtcactttccccactccaaacccttcaatggtttccaatcttgctttggataaaactcaaacttctcatacccacaagacccaccctccatggtctgccctacctgtctctccagccttattctcattctcccttccactcaccagtggccctcaggggcatagctaggtgcaatggcttgcacctgtaatcccagctacttaggaggcggaggcgggaggatcactcgagcccgaggagttggaagctgtggtgagttatgatcacccactgcactccagcttggggaggagtcatagcgtgagacccctgtctcaaaacaaaaagcctcagggcctttgtccaagctgttctctctggctgcagcagcgtcccaggccctctgtgccaggtgttcctcctgtgagtcctagggtgacatctttttcatcggggtctgtttttcaggtgacctcataggcactcactaaatatttatggaatggatgtcttttgtttgtttcattacaggtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaaggtaggcagaaaggtggataattgaataaatcagatacgtcaactgctttgttctctaatgttgttcgtatgtacacaggattcttcatttattctggtctccatggacgaaccaattactagagtgacatgtaactaacagttcgtaggcaataaagagaggtttgccatttttaaaaaatacatttaggggtccaaagtgcagctgtgtcacgtggatagatactgtgtagtggtgaggtctgggctttcagtgcacccagcatcggagtagtggacattgcacccagtaggtacttgatctttcaccactcctggctccccttctcttttattaggtctgatttttatttttggctttcacatgtgtgtctgaattttctgattggtcaattgctatttattagctcctggtgtggtgtgcctttttctagcttcctaactttggtttgtgcatgaaactgccacgactctgtgtctccgctaagaagactggccccaggcgggctgaccttttgaacttactctctgaattacacagaggagcaggccaattcatcagaaacctcaaaaaggaatcaaatgatgcacaaaactcttgagtatcaagtccttttggtttttagcacctttacatcctgccttctggtatatcatagcagacctgacataggcaagttctttatggcctagaggaagtaaggcggcgagcctagggaggaaggacacactttctgatccttctttatttggagaaattttgagtgttgctcatgttttcttagcctggtaatgagggttaaaaataaatgaattttgaatacttgagaaatcaaaagacaaaaaccagaagaaaggagacggtatatcaacaaagggtgggcaggcacagtggctcactcctgtaatcccagcactatcaggaggccaagacaggaagaccacttgagcccaggagttcaacactagcctgggcaaagtagtgagaccccatctctacatagaatttaaaaattatccaggcatggtgccataatatggttccaggtactctggaggctgaggcaggagaatcacctgagtccaggagtttgaggggatagtgagctatgattgggccactgcactccagcctgggcaacggagcgagactctgtctcaaaaaaaaaaaaaaagtttgagaaaactatataactccatagttgcataattggtatgaaaatgtgtaaaaagcggggggaccatttttaggaatacataaaatatcaaaattgactaaaagaggtataaaaaccttaaatggatcaatagccctagaaaaaaatggagaaaattatccaagtgctatacccccaaagcaccaggctcaccaggttatataagactgactcatttttaacctttatgaaaagagtaatttctaaactgtttcaaatttttccaaatacggaggaagatgaaaatgtcatcccgatttacttatgaagcgaaaatgtgacaaagctagcctaaagaaaactgcagagcaactttctttatgaataccaatataaaaattctaaatagaacattagcccatctcaacttcattagtacattaaaaaaattaaatgaatcagtgagctcaaattagtaatgcagatgactcatgccaggagatgtaggaatagaattcagtgttctagtgttaggttaaaggaaggagggaagtgtgatcatcatcatacacactaaacaaaagcaattcataaaactcaacattttttttttgagatggagtctcgctcagtcacccaggctggagtgcagtggtgcaatctcggctcactgcaacctctgcccccggattcaagcgattctcctgcctcagcctcccaagtagctaggattacaggctcccgccatcatgcccagctaatttttgtatttttagtagagacggggtttcaccttgttagccaggctggtctcgaactcctgacctcaggtggtccacctgcctcagcctcccaaaatgctgggattacagatgtgagccagcacacctggccaagtaatttgaaaaatataatgagaaccattaatgtcggaaatctcactcttgagctgtggagtgtttacctgcttaggaagtgggggttgggggagcgggggatgttaactaaaaagagcacaatttgagaaaaacttgggtgccacatcagccatttagtatggatttaagattggctagcagtccatgtttatgacattaaaggaaatttttggtgagtcacgaatttactttcttcaagatagatgataatttgtcattctacaatatggtaccttccttctgtagtcgttccttctaaatgcatttgaagaaactctaccacctgattgtctctgtcttctagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagtgtgtagtgtctctcagggcttcttagaatcaatggcccactggacacaggaggcccagcctgtgctagtttttctttccatttatgaaagcaaaaggactggaaaaaaatttcctgggaagcaggaggcaagtagccaggtggagtctgagaggtggcttctaggtctgctaggagggccgtaatagactactcggcacttggagtctccaagttggctgagggcagcaggcaaggccacagacagtgggtcctctgagcctcgaaccatctgaacccagggctctgggcctgaagcatcccaggctccctagtagctccttctgcccaattctgcaaccacccagaggcacactggctgaggagtcacagggaatgcagagtttccttctctccactgtagaggggcctaatatagcacagaaatgcaaatgttgcacttacttcaatcacaagaatatcaatgcttagagctggtgccttaggcaaagccattctgcttatctatgcctcagtctctccccagagtgatattaatgcagggagtatctcaagcacatgcacacaagcgcacccctctggagaggaaggagttatggccagtaaaccctttgaactctaaagctctgcgcgtcatagaagatgatgcccagctcctgtcattaggccagaaaaccacaggccagcaggtcttatgtgaccaccagtgactttatttataacaagtagtatttttaaaaaaaatttttttagacgaagtctcgctctgtcgcccaggctggagtggagtgctcagctcactgcaagctccgcctcctgggttcacgacattctcctgcctcagcctcccaagtagctaggactacaggtgcccaccaccacacccggctaattttttgtattttttagtagagacggggtttcactgtgttagccagagtggtctcaatctcctgacctcgtgatccgtccgcctcggcctcccaaagtgctgggattacagacatgagccaccgcgcccagccagtattttaaattttttaaaaattagttgccagcatttaaaaatcagattataggtgtagtggcaccagcctgcagtcccagctactcgggactctaaggcaggaggatgcttgatcccaggacttaaacgctgcaatgtaccactgcattccagcctgtgaaacagcgagaccccatctcaaaaaagaaaaagaatcaggaggtcttatatagaatacatatttctggattcttttgaaaaatgggaagaactactaccatagggtggcattccctcctgacgccagttgactgaagccaaacagcacccctgttgagatgggtgtccccacagctccccatgctctgctgggccatttgggttttttgttgttttgtggtttttggtttttttttgggggttttttttttttgagatggagtctctctctctctctcaccgaggctggagtgcagtggcacgatcacagctcactgcaacctctgcctcccaggttcaagcgattcccttgcctcagcctcgcaggtagctgggattacagacatgcgccaccatgcctggctaatttttgtgtttttagtggagacagggtttcaccatgttggtcaggctggtctccaactcctgacctcaggtgatctgcctgcctcagcctcccaaagtgctgggattacaggtgtgagcccccgagcctggctcattaagctgttttcattttgaatagaaaacaatgcgatccgtaattttctggattaatgctcctgtcaaaaattttgctccccacctcactgattgcctcagcacgcagccatgtagtctactccgtccctgctgatatgttctcacagttggaaaaaagttgtaaagaaaaggcgagcaggtggtatttagtgccatgttgaaagaggtggctacaatgtagagcttgaccaggggcagtcagggacaacctctcagaaaaggtgatacttaagctgagtctcaggtgacgaggggtcagccgtgtacagatgtgggagacagcatttcaagcaaggggcatggccaactgtaggcaggcccaggcttggaatgtttggagagcagaggaagggccaagtggtaggagcatggtgaacgcagaaaactctccagggcccaggtcatacggggtcttataggcgcccttttcagtatctctggttctcttgcagtttgctgggaagccactggagggctttaagcaggaaagcaacagcctgcgttttccaaaactctgaagactggagaatggcttcacgtaggaaagggaggagaaggagagggtgacttggaccagggcagtagctgtggagtcggagggaagcagacttgtcacatattgccttggcaggagagccagcaggatccaacggcaggtgtcaggacaggacccaaggctggtgcttgagtgtgggtggcagcacctgggggaaggtggtgtcacctcttgagattgacaagactgggggagaagtggactggggggcaccatcaggagctctgtgtgggcctggggggttggggcacctgttagatgtacagaggggagacagtggtatcagatggctgggcagtagatcagtcagtcattttcacatgtggccgctccacaccactaaatgcagttttctaaactacatattcgttggcctagttttaagctaacatcttttttttatttttattttttgtagagatggagtcttgctctgtcacccaggctggaatgcagtggcacaatcatggctccctgcagcctcaaactcctgggctcagggggtcctctggcctcggcctcttgaggagctgggagccgccatgcttggccacatctacatttttaatcataaatttaagtcgttgcaaaggatgtagttgttcatatattgacatttttgatactttaatactcaaatcatgccattaatgatgacactggctgggcatagtggctcacacctgtaatcccggcactttgggaggctgaagctggaggattgctggagttcaagagttcaagaccaggccgggtgcggtggctcacgcctgtaatcccagcactttgggaggccgaggcggacggatcacgaggtcaggagatggagaccatcctggctaacatggtgaaaccccttctctactaaaaatacaaaaaaaaaaaaaattagccgggcgtggtggtgggtgcctgtagtcccagctactcgggaggctgaggcaggagaatggcgtgaacccgggaggcagagcttgcagtgagctgagattgcgccactgcagtccagcctgggcgacagagcgagcctccgtctcaaaaaaaaaaaaaaaaaaaaaagttcaagaccagcctgaacaacatagtgagacctggtctgtaattaaaaaaaaaaaattcatgccaagccacttttctttgtcagaaattaaaaccctttttctacttgatttccaatttccattccattcatttccccaatatatctttatgcatgaaagccttttattgattgtcctatcatttttctctgcaacaaaaatatgcatataaattgataggtttttaaaaaattataatataggcttctgagcattaggtttttttttctggactgagatagaattttgattattattagctggtatgttagtggatgagtatacttgtagtttgaatgtgatagcattgagaacagattctattcctgtttttcatcttcatgatgtgctatgaaaccttacttacatgaataagtagatgggaagggaagttttgttagaggaatgtcactcagttctttgaattccttcccagttgtaagtcaaaaaatcacatagtgatctttcatgtaaagttgtttataaaagttatttacagagttgacagtttcattaattaagttcttcactttctctccaccagcatagttatttcaaattgtcctctttacttgggtctggaggttctgcactccaggatgatccccctgtaagagtcaggtggctgagagcatgccctttggggatcaggttgctagaaggtgattgttaaaagagacagttgggagacccaggggcagtggctcacgcccgtaatcccagaactttgggaggccggccgaggtgggtggatcacctgtcagttcgagaccagcctgaccaatatggtgaaacctcgtccctactaaaaatacaaaaattagccagacgtggtggcgggtgcctgtaatcccagctactcgggaggcagagacaggagaatcgcttgaacccaggaggtggaggttgcagtgagccaagattgcaccagtgcaccccagcctgggcaacagagcaagaccctgtctaaaaaaaaaaaaaaagaccatgaggggagcacagaccctccttttggcagatgaatgtagacagagttgatctggagtttgggatcttgagtgtaacacccacagccacatcccctttggaaagcctgtgtgtatccgcagagaggtttgtattctagtttgaagccttctggggtatttgagcccggacttctggggaaggggggtaaggaatggcaatgtaaagtggggatcattaccagaatgcacatcaggggagcattgggccagatgcgacttcccgagggtgcacagggccctgaggacttgccccagcagcgcccatgaggcgacagcagtgggccactgccacactgcagaaaccgagaggaggaaatgccttgagatcaggggccaagtcaagtcacaggccacccaaggtcaggcagcctcttggttttgtggcttcgaggtcccttgtggggatggtggcctagatgaagtaggctgggaagagcgtggaaaatgagaaagcaggggcaatgactataggcaagttttgagaagtttgctgcgaaggagaacacagatgtaaaagcaggacaaggcggagatggggctgtgaagataaaaggtgctggcgcacacctgaatggaaatagaatgatccaagagaaagggaagtagcacaagaggggaggaggagctgcatggctggagacccctgtgagaaagcaggaacaggacagattcaggatgtcctgtcggggcatggaccctggaaagctgcggacaccaggagggcaggcaagagagtctcatctcttgctccctaggagctatgagttgagggcgccgtctgagcaggagggacggacgggtgcccagggtttgaggaaagaggggtgtgggaaggacgcatgctagaacttcagagcagttcagcaggtgcagaatgggagttatcatggggactgtgggagaaggggcggtgggggcaatgcccagggatgttctgattcatgttctctgtgctgcaggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtaagggttctaaatgccatcatcttggtagccttcctccttcacagagaaagattagcatgtgattggttaaaccacgaatttccttatggttccatgaagtttgattattcaagcctttttcttgaaaaagccatattgtactttaaaagtgtcagactctcagggcaacttttgaagtgcatctctcggtggtactgttgtttcagacagtgagaaacagttgcttatcccgagtgccccttgtgtgttgagctgcgtgcaggttatggacaggactggcagagtcatggagccttttctgccctcgctgtggttgcagtctaactgagggtgaacagcatcacagaggacgaggagcattctggctggctgcacagcctgctcaggtgggaggggggctgggaccaccatcaccaccttcctgcctggggcagcgagaaccctggagcgtgacacgaggcaggaactcttacaaacacacccttctcagagtagtagtcacctggcaggtgggctagaaggaaaccacaggaaacgggaagccagagaggggattgaaacaaggtgtgcaaggtggtgggggagaaaaccaggggggtggggggggacctgagagtgaagaaagaggtgagtgtgcctaacagatggagcactctgcaatggcgtgaagagcaaaacacacgagtctccgggattcctcacttgggaaacgtcagagagtcattttcgtgaatgacagaaatgacatgggaaagatgagccagctggcgtcctgtggcaggcagatgggcttactagatgtggctgcacacacttgcttctagaatgccagagatgcacgctggaaagccatctcagggactccctgggagaatgaggctggacgagatggctctagatggagctagagtcacggctgtctgggtgaagctggaggcacaggtggtggccagagagaggaggcgcggcagtgttgcaggggcagaggggcctaggaaagggtccttgagcccacctgtggctgtgctcagtttcagttttgaaatagtcacatggagaaagtgactctaggttccatccaaagaagaactggaaggctgggcgcagtggctcatgcctgtaatcccagcacttggtgaaaccccatctctactgaaaatagaaaaattagccaggtgtggtggcacgcacctgtattccagctactcaggacgctgagacaggagaattgcttgaacccaggaggcagaggctgcagtgagccaagatcacaccactgcactccagcctggcgacagagagaggctttgtcaaaaaaaaaaaaaaaaaaaaaagccagagcggtggctcacacctgtaatcccagcattttgggaggccgaggcaggtggatcatctgtggtcaggagtttgagaccagcctgaccaatatggtgaaaccccatctctactaaaaatacaaaacttagccagacatgttggcacatgactgtaatcccagctacttgggaggctgaggcaggagaattgcttgaacctgggaggtagaggctgcggtgagccaagatgacctagtgcgctcaagcctgggcaacagagcgagactctgtctcaaaataataatagttaatttttttaaaaaaagagctgggctgttgaggttagacagtggtcctaggcaaggcagtgtgcatggtgacaatccccttcctagctgagaaaagctaagctgcccagtgcacattaagatttctctttcacatttctggtgagaaactacgttcccagatacaccctaaagtaccctgtagcaccctcagcatgctttgaaggtgtgttaactacttggaaggcctggagaaatgaaaaagaccactttggtatgcaaaacccggtctctggatatagaaaagatagagcagaaaagggagaacaaagcctgaggaccttcctaaagagaacgggttcagagacttagcaggccaaactcaggccaccaatgctcagccatcgtggacagtaacttggagtgatccatctgaaaagtcagctgagacttttcagttgactaacccgaggtgtcacagtgtgatctcaagggagacaggcgtgcaagaacacaatgtaaatgagttgtgaggatgcagcgggaccatttatggggctctgctacagctcgggacaccccgtggcaataggaataattgcttcttcagagctagaagtgggtggagggcaggttcctaatggggttatgctcctgttttcatcgggctctggttctctcaggtgacgatggtgcttcccagatggccctggaggatatagccatgttccgaaccattcccaagtgcacgatcttctacccaactgatgccgtctccacggagcatgctgttgctctggcagccaatgccaaggtatttttaaggggacactagtttcagacagaaaatgcttctggactctgctagtttcatactgatgattggacttttttttctcaacataaaagtgatattcattatagaaaatttggtgatagaattctttacaaaaaaaacaggagattatgcacacaaacacatttgccttgtaaaagagtccaacagtacaggatactgaacaaaacctgacagcctgtctcagtcagggtttagcagaagaaacagggaccattctgggtgttgtaaacaggagaaggtgtttaacaaagggtgcttaagaagccgcaggagcaagcttcaggcagagtcccagactatagtgttagtctccagtggctgcagccagaggccaagaagctcctgctgtgtcctgacatccaggaagctggagagcgggtggtaggctaccactacaaacgaacccgggttccctggccctggcttgcctttggaacagcttagggcgccaagagtgtgtgggacctcatgcaagggcatcagatggacagaatcaaattcctgttcagaacctagctgcacgggagacgaggcagtgtggtcttgatctttccagcctttcccactaacgttcagcaggtttcccttgccaccctggacctcgcccatgcgccacacaggtaacccctggcacagtcgggatggggactgtatgttccctttccaagcactcatgggcgtttctttgatttttttttttataagtgggctcccgctttacatattattaggtacttttttgtgtggtttttgtgttttgttttttgggttttttttctttggagacagagtctcactctgtcgcccaggctggagtgcagtggcacaatctcggctcactgcagcctccgcctcccagattctcctgcctcagcctcctgagtagctgcgactagaggtgcactccaccacggccggctaatttttgtatttttggggagagacagggtttcgccatgttggccaggctagtcgcaaaactcctggcctcaagtgatccacccaccttggcctcccaaagtgcagggattataggcatgagccaccgcacctggccaattgtgtacttttaaaattagtttatcttggagattgttctgtgatttcacacgttatagggtttcatttctagaaaggtcaagagaggcgcaaaacaagattaggtgatagaaattagagtagaggttgcttcatagtggggggagactgactggaaggaggcacaagggaactctgctggcggaagcgctgctgggcttggatgagggctccacggcggatgcagcattcaggaagggctgaacttaggatgtatgcatttcactgcagctgagttatgcctcggtgaagacactgaataaagatggatcatagcgtatgaacgaacagtagcgacgtttcttgctatattcgtttataatgcatccattaatatgtatgtaaattaacaaatactttagacatacaagtgttcatttatactggtaaatgtttatgtgctcaaattggtcataaaaatgtatttacattttattgggaaaggggccagtcgtcttgtattcagatagatgtttatggtctttctaaggatgaagcattacaagttattgtggcaaaagttaatgttttaacattctattcgggctttctagtcaatgtgagtcagtgctcctgccgtgagttaatgttctgtctgcacagaacaagtcagtgagtattggggaatcttccaaggggattggtgtgatggcatgggggagcttgtccttcagggcagccccaaggtcctgctgggacctgtcgtccactggttgtagatgctcacccctttctccaaagcctgtgtttttagtagaaagagctgtcctcttcacacccctccttcacttctttcaacgtctgttgttggaaattcattgtttgcttttctaaaccatggctccatttatgccctaggggatgtgcttcattcggaccacccgaccagaaactatggttatttacaccccacaagaacgctttgagatcggacaggccaaggtaagggcttacgcgctcctgcgttattcagtatcatctcctgtaaaaagaacacttctgaatctatcaccagctatcttcagagttgagacatcatcctttctttgctctcatttttttaaaaaacagttgtgacctttacctgcttttccttgggaaggaacattctatgaatttcagcttagcctgaacttttctgctttccaaatggagtcttttgttgttgttgagttcaaagatagtaacatgaagccacttgagcggtcgtggctataatttatcttggccgcaagctaaacaaaacagaagccagcgctttgggaggccaaggcgggaagattgcttgaggccaggaattccagagcagcctgggaaacatagcgagattcccatctttacaaaaattttttaaactagccgggtgtggtggcatccacctgtggtctcagctactcaggaggctgaggaaggaggatagaggagcgcaggaattcaaggcagcagtgagctatgatggatcacaccactgtactccagcctgggtgacaagagtaagaccctatctctaaaaacaagacaaaaaataatagaaatcacttgaaatgaataatctgttaggttcagattttacagatctaaggccaggaataaaagggaacatgatctctggtattctcacaaaagccctgagaagttcagattatcagtcctatctgtagatgaggattggagaaagtaagtgtcttacttaagggtttacagcttgtgagtaccaagaccagaatccaggcctgagtagtgagcccagtctccccaggtctgcccaccacgctgaccatcccctgctcagcctgcctgtcagggccatgcatagagaaaagcagaaacgtctatggagaaaataagtgactctgctcatcacctagggagtggggcttgtagacattttggcatgcttccttcctgtctttgttctaggcatacatgtatattttacacagttgagatcatactgaatagaaaggtttgcccatagccactcttgaaagagcagcaggtaacatccaatttggttgctaaggactaggctgctccagaattcacagttgcaagtactcagaatggccagagtgctgccataaagcaggtgtttccagaactgtccactgtgtgccataacgtagctggaaaacgccaccaaatggaaaagttagtgttcacctttggtgttaactacaggttctgtttctatggggagggtctcttgacattcacatggtttgcagagcttgcttatttctgtcgtctcttttctaataattttcctgtcctgacaaaagcaagtaaatttactgatagtaaaggatgtgagataaatgtgtgtgataacatgcatggcatggatcgttaaagggctgggctttgaaaagaggacatggatatgtgtgcatgcgtgtataagtattttaagaggccaggacatccttaaagaatggggtggctcagaaaccctttctgtactatcagcaatggttcttaagctacagggaaacctatacagaggggaagtggagaataattccagatgcctccgatgggtagctttggaggcaacaatctatgaaagaagcccaggaactctgtctttgcttgcagaatagtacgttgtcgagagcgagggctttgatgtcagccccgcctggctgtgggtcccagccctgccctgggccacttcctcctgctctgagatttgctttcctcagctgcagaacggttgtgccactgaacagatcttacagggaggctgtgagggttctcagagttcaggcacacaagatcttagcactcagcgtgttgccaatgcccagaatgttctcattaacatgttagtcactggagtccaatctttgcatgccatagtgagctctcaaaccagactcctgatgggtatgtggcgtatccatgctccaggacagctggagcagtgtaatttcctatcaaaaagtatgtgtcctggcttgtaaatgcatctgatttttttagtagtgagttattaaggagtgaaattgttagaattgggggatagcggcatagcaaagtgccttccactttgacatgcattctgtgtgtagtaaccacggcattctgttttgctggcactataccaggtcctccgccactgtgtcagtgacaaggtcacagttattggagctggaattactgtgtatgaagccttagcagctgctgatgagctttcgaaacaaggtcagttggttgagtatgagcattgaagttcaagctgggaagaggtaggacttcagctacctcctgtgccctgagtgctctttttatttttatccctgcatgttattctgagtctctttcttgtaccaagctggtttttgctgttctgcagatatttttatccgtgtcatcgacctgtttaccattaaacctctggatgtcgccaccatcgtctccagtgcaaaagccacagagggccggatcattacagtggaggatcactacccgcaaggtgtgtgtgggcattgagaatgctttggaaggttttggtgtttttgtttccttgattggccacatggcatgctctcaggcatcacctatagtctacctctcacccagcatggctttgttatttgatgttcactaagcgtggggccatactcatacacatctgtgtgtccccaacagagtgcacagtgcccagtcaccagggcgggtcagtggcaacacagaggagtggctattgcaggcaagcgaggtgtcatgaaaagcatcgcagtttctttgggtttggaatgatgaatagtatgccccaggccaggcgtggtggcttacacctgtcatcccagcactttgggaggccgaggcaggtagagatcacttgaggccagaagctcaagaccagcctggtcaacatggtgaaaccccatctctactaaaaatacaaaaattagctgggtgtggtggtgcatgcctgtagtcccagctacttgggaggttgaggcaggagaatcacttgaacccaggaggtggaggttgcagtgagccaggatcataccattgcactccagcttgggaaacagagtgagactctgcctcaaaaaaaaaaaaaaaaaaaaaaaaaaaaaaaaaaaaaaaaaaaaaaaaaaagtgtgccccgacgaaagcaggtatagcagagaacacagcaaatgcagaaaacagtgtgtcagggagaatgggctgggcagtgtttgcgcctggaaaggttaggtgggacagatgatgtgatacaaggagcattgagtgttcatgcggcaggggccctctgagcctgcacaagcggtgcctgatctctcgaaggactcctgggacccagcacacagttgctctcacacctgaggttgatgacagggaaagggtgcagggggggatccaccagggcaggaaccatgggccaggtggagttgaaagaagtcctgccccagcctccccttggccccacaaggggcatactgagaagtgcctcccacgcaggctgtgttcctgcctaagggatgcctgctagagacttggcacctcaagtgtgtactgggggcaggtcctgttggcaccctctgccaggcaggtacccaaatccctggctcccagcaggaaagcaggtgctcatgtcaaccacattgttcctacagacagtccaggtgcatgaccgccctgtctagtggggaaagtgttagagtagcaagggaaccttcacgagccaagagctaaccttgccaaccaacagcctcaagccagctagtcacttttctgcactgttaattcattagttctaaccattttcaggtccccaacagctttgagaatcagagtgccacagacccccacactcaggcagcccttactgtaggttgaggcagagcagtttggaaactggcagtttagaatgagaactccgcaggcccatcggagtggctgttcacatgaatcagattttcccctgggaagctgcagattcaaaggcctctatgtggtgaggctttaaggctgacgagctgctttcacaaaagggcctaacatccttgtttccccaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaacca

SEQ ID NO: 4095 - DNA, 5080 bp, human
gatgtaaaagcaggacaaggcggagatggggctgtgaagataaaaggtgctggcgcacacctgaatggaaatagaatgatccaagagaaagggaagtagcacaagaggggaggaggagctgcatggctggagacccctgtgagaaagcaggaacaggacagattcaggatgtcctgtcggggcatggaccctggaaagctgcggacaccaggagggcaggcaagagagtctcatctcttgctccctaggagctatgagttgagggcgccgtctgagcaggagggacggacgggtgcccagggtttgaggaaagaggggtgtgggaaggacgcatgctagaacttcagagcagttcagcaggtgcagaatgggagttatcatggggactgtgggagaaggggcggtgggggcaatgcccagggatgttctgattcatgttctctgtgctgcaggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtaagggttctaaatgccatcatcttggtagccttcctccttcacagagaaagattagcatgtgattggttaaaccacgaatttccttatggttccatgaagtttgattattcaagcctttttcttgaaaaagccatattgtactttaaaagtgtcagactctcagggcaacttttgaagtgcatctctcggtggtactgttgtttcagacagtgagaaacagttgcttatcccgagtgccccttgtgtgttgagctgcgtgcaggttatggacaggactggcagagtcatggagccttttctgccctcgctgtggttgcagtctaactgagggtgaacagcatcacagaggacgaggagcattctggctggctgcacagcctgctcaggtgggaggggggctgggaccaccatcaccaccttcctgcctggggcagcgagaaccctggagcgtgacacgaggcaggaactcttacaaacacacccttctcagagtagtagtcacctggcaggtgggctagaaggaaaccacaggaaacgggaagccagagaggggattgaaacaaggtgtgcaaggtggtgggggagaaaaccaggggggtggggggggacctgagagtgaagaaagaggtgagtgtgcctaacagatggagcactctgcaatggcgtgaagagcaaaacacacgagtctccgggattcctcacttgggaaacgtcagagagtcattttcgtgaatgacagaaatgacatgggaaagatgagccagctggcgtcctgtggcaggcagatgggcttactagatgtggctgcacacacttgcttctagaatgccagagatgcacgctggaaagccatctcagggactccctgggagaatgaggctggacgagatggctctagatggagctagagtcacggctgtctgggtgaagctggaggcacaggtggtggccagagagaggaggcgcggcagtgttgcaggggcagaggggcctaggaaagggtccttgagcccacctgtggctgtgctcagtttcagttttgaaatagtcacatggagaaagtgactctaggttccatccaaagaagaactggaaggctgggcgcagtggctcatgcctgtaatcccagcacttggtgaaaccccatctctactgaaaatagaaaaattagccaggtgtggtggcacgcacctgtattccagctactcaggacgctgagacaggagaattgcttgaacccaggaggcagaggctgcagtgagccaagatcacaccactgcactccagcctggcgacagagagaggctttgtcaaaaaaaaaaaaaaaaaaaaaagccagagcggtggctcacacctgtaatcccagcattttgggaggccgaggcaggtggatcatctgtggtcaggagtttgagaccagcctgaccaatatggtgaaaccccatctctactaaaaatacaaaacttagccagacatgttggcacatgactgtaatcccagctacttgggaggctgaggcaggagaattgcttgaacctgggaggtagaggctgcggtgagccaagatgacctagtgcgctcaagcctgggcaacagagcgagactctgtctcaaaataataatagttaatttttttaaaaaaagagctgggctgttgaggttagacagtggtcctaggcaaggcagtgtgcatggtgacaatccccttcctagctgagaaaagctaagctgcccagtgcacattaagatttctctttcacatttctggtgagaaactacgttcccagatacaccctaaagtaccctgtagcaccctcagcatgctttgaaggtgtgttaactacttggaaggcctggagaaatgaaaaagaccactttggtatgcaaaacccggtctctggatatagaaaagatagagcagaaaagggagaacaaagcctgaggaccttcctaaagagaacgggttcagagacttagcaggccaaactcaggccaccaatgctcagccatcgtggacagtaacttggagtgatccatctgaaaagtcagctgagacttttcagttgactaacccgaggtgtcacagtgtgatctcaagggagacaggcgtgcaagaacacaatgtaaatgagttgtgaggatgcagcgggaccatttatggggctctgctacagctcgggacaccccgtggcaataggaataattgcttcttcagagctagaagtgggtggagggcaggttcctaatggggttatgctcctgttttcatcgggctctggttctctcaggtgacgatggtgcttcccagatggccctggaggatatagccatgttccgaaccattcccaagtgcacgatcttctacccaactgatgccgtctccacggagcatgctgttgctctggcagccaatgccaaggtatttttaaggggacactagtttcagacagaaaatgcttctggactctgctagtttcatactgatgattggacttttttttctcaacataaaagtgatattcattatagaaaatttggtgatagaattctttacaaaaaaaacaggagattatgcacacaaacacatttgccttgtaaaagagtccaacagtacaggatactgaacaaaacctgacagcctgtctcagtcagggtttagcagaagaaacagggaccattctgggtgttgtaaacaggagaaggtgtttaacaaagggtgcttaagaagccgcaggagcaagcttcaggcagagtcccagactatagtgttagtctccagtggctgcagccagaggccaagaagctcctgctgtgtcctgacatccaggaagctggagagcgggtggtaggctaccactacaaacgaacccgggttccctggccctggcttgcctttggaacagcttagggcgccaagagtgtgtgggacctcatgcaagggcatcagatggacagaatcaaattcctgttcagaacctagctgcacgggagacgaggcagtgtggtcttgatctttccagcctttcccactaacgttcagcaggtttcccttgccaccctggacctcgcccatgcgccacacaggtaacccctggcacagtcgggatggggactgtatgttccctttccaagcactcatgggcgtttctttgatttttttttttataagtgggctcccgctttacatattattaggtacttttttgtgtggtttttgtgttttgttttttgggttttttttctttggagacagagtctcactctgtcgcccaggctggagtgcagtggcacaatctcggctcactgcagcctccgcctcccagattctcctgcctcagcctcctgagtagctgcgactagaggtgcactccaccacggccggctaatttttgtatttttggggagagacagggtttcgccatgttggccaggctagtcgcaaaactcctggcctcaagtgatccacccaccttggcctcccaaagtgcagggattataggcatgagccaccgcacctggccaattgtgtacttttaaaattagtttatcttggagattgttctgtgatttcacacgttatagggtttcatttctagaaaggtcaagagaggcgcaaaacaagattaggtgatagaaattagagtagaggttgcttcatagtggggggagactgactggaaggaggcacaagggaactctgctggcggaagcgctgctgggcttggatgagggctccacggcggatgcagcattcaggaagggctgaacttaggatgtatgcatttcactgcagctgagttatgcctcggtgaagacactgaataaagatggatcatagcgtatgaacgaacagtagcgacgtttcttgctatattcgtttataatgcatccattaatatgtatgtaaattaacaaatactttagacatacaagtgttcatttatactggtaaatgtttatgtgctcaaattggtcataaaaatgtatttacattttattgggaaaggggccagtcgtcttgtattcagatagatgtttatggtctttctaaggatgaagcattacaagttattgtggcaaaagttaatgttttaacattctattcgggctttctagtcaatgtgagtcagtgctcctgccgtgagttaatgttctgtctgcacagaacaagtcagtgagtattggggaatcttccaaggggattggtgtgatggcatgggggagcttgtccttcagggcagccccaaggtcctgctgggacctgtcgtccactggttgtagatgctcacccctttctccaaagcctgtgtttttagtagaaagagctgtcctcttcacacccctccttcacttctttcaacgtctgttgttggaaattcattgtttgcttttctaaaccatggctccatttatgccctaggggatgtgcttcattcggaccacccgaccagaaactatggttattta

SEQ ID NO: 4096 - DNA, 25291 bp, human
aacttgccccgagtccacggtgctctgcggttaggagctggcctcactgtgcacagggggaggggtggtgagcttaccgggctttaaagcgcccttccaacctgtgagccctgcattccttacccttggttggattcttcccgggctgggagaaatgaccgcttctatgaggagaccatgtgccgaggtcgtgtgctaggaagccagttgctgtgagaaatgaccagtgtcatgtctgtctttcagccaccctacatcatgtagcagttcttctgagatcatgtctgtgctgttcttctacatcatgaggtacaagcagtcagatccagagaatccggacaacgaccgatttgtcctcgcaaaggtatgccggtggggagcccagggctgctgtggcgcctgctggttaagcccagtttgaacagccaccgtgtgggaacaaggcctgaaatgggcctcgtttattattttggttcttctttctttgcatcttaaagctcgagtgttctagtgagggccacttggagccctgtgatggcatggtaggaagggtggcttgggagagctgactgtccttcctttcctttggtcacaccctgcctcgccccacttagcacgaacgcttcccccatggcagggttatgctgctcccaccctctgtgctgcctgaggagaggcaggcagcctcagtgaatcccactcactgagcctgggggaacttgagtgtaaccgggagggacatcccacccctgtcagttagcttcctcttctatgtttctgcacatctgacctgaaactgatgggcacttctcatgagattgggcaaaataccagccacttcatgaagtatcatgggtgataggaaagaaaaagaaccttaaaaacaaggtcagtttgagaatgtgtggctggtttgatgccatctcaaagtacactgtgtcccgaagcaaattaaaacctggctaggggccgggtgcagtggctcacgcctgtactcccagcactttgggagactgaggtgggtggatcactggaggccaggagtccgagaccagcctggtcaacatagcaaaactccgtctccacttaaaaaaaaaaaaaattagctaggcatggtagcacatgcctctaatcccagcttttcgggaggctgaggcacaagaattgtttgaagctgggaggcagaggttacagtgagccgagatcgtgccactgcactccagcctgggcgatagagcaagactccatctcaaaagaaaaatctggctgggtagagtactgtgtccaaatagaaatgccagattagcacagtgggaagtgaagacaaaaactgggcatagctgaagtaagtgcctaaaggtcataattgtgacccttgtcttggtgtctgaaccataacatcaaatggtttggcaaaaaataaatagaatttacatgtgtacgcgcatgtgtggagagagggatgaagtaaatgccttccattgctttcagttggttattggaggtaagcagtatacaggaaggaaatcattgtgctaggctttaaacatgtctataaacttgaactttttttacatctttttttgttctttttttggggaggtagagtctcgctcttgcccaggcttgagtgcagtggctcggtctcagctcaatgcacccctgacctcctggcctcaagcgatcttcccatttcagcctcttgagtagatggcattacaggcatgtgccactacgaccggctaatttttgtattttttgtagagacatggtctcactatgttgcccaggctggcctcaaactcctgggcccaagcgcccacctctgcctcccaaagtgctgggattacaggcaacaagccaccgcttccagccctctttacaatgaaaattgaaaaaaaaatagatatataaacgcaatatgggtgtttagatttctggtttaaaataaggaaaggctgggtacagtggctcacaccagtgctttgggggctccagcaggaggatctcttgagaccagcctgggcaacatagcaagaccccagtgtctacaaaaaatacgaaaattagctgggcgtggtggtgcgtgcctgcagctactcaggaggctaaggtgggaggatcacttgagccttgggagatagagcaagaccctgtctcaaaaaaaaagaaaaatctagactgtcatataacagctgctatcagagccattggccttaggggatgaagaggctttctatcgggcagcagcacaccaggccctgttcggctgccagaatttgtgtgttcatcagatttagctggctgatgaaattggaacaaaagagaaaacacatgaagcatagtccattgtggtttgcctgggaacggggtaaacagctatactccaggcagagcagatctttattctagcctttcacctccctgaatcgtctgccccgcagcataagggttcttgagaaagacagcacccatgtgggagcacttctgccataacgggcatcatactgatgcctcaccattttctcaatctatcctcactttatccttgacctcctgtcacctaagggggctctggtctccattgcacccataaagtctttgagatgggcccactggcctcacacttcacagccagagggaagcagagttggtctgactgctgagcccaggctcggtccattatgttataggacttccaagggcatgcaaggcgactgggagccagagcttgttacgtgagtgtggtgggtgccatagggagggagatgtggctagaggcatagtcaaaagagacttgagttgagtggggcagttctgctgggctggaaatgcagaaccaaaagggagtctctggggggcacaaagcatgcagagaattccggggaaggtcaagagcaaccagagagtagcagagggtaggaagcaagaagcaggagatcagagaatcgtaaataccatccatccatctacagtagtgatgacctcgctcatctctgctcgaatggcgctgacgtttgagcagaggagggtgacaggcaggaaacaaacttttaagtcaatagatggagtgtcaggtggggccaagcatctggaatcaagtaaaagtggaggaggtaggaggcactggttgaaaaagagtggtccagaaagacctcagtgctgacgcttgagcagggatttggaagaggcaggagagtgagctgtgcccacatccacgcacaagcactccggtagtgggtgccatgagtgctaaggccctgaggcaggtgtatgcccactgtgttcaaggagcagcaaggaggccagggtgccagagcagtggaagggagaaatggaggtgatgggggctggggtgggcagacaggtgcaaacagttgagctctacttggtgggaggtcggaagaccttagaaagttgagcgatgtgatcagtcaacttcagttttaacaggctcccccttgtggctagattgagaatggctgtgggggaggctgggaggccactgcagtgacagaggcaagggatgtttaagaccaggtcgaaatggtggctgcagaagctgttgggtaaattcagtatgcttgcaagttgggcctctccagtcagtgcagcagctctttggcatgaccttgtggcccacagagggccacattttctgcttgggatagtgatgaccctgtgcctgcaaacaggatgttgggggtggggtagatgctagtagaaagggattcatttctagcgtgggcacttctagatgagcacgtgtaagatctcagttgacctgagttttataaaccagggaaccagagtattctctttctggtttctgttttaagaatccatatcctccataggattgaacatgtgatttgtgcatgaccgggaagggccatgggaaaatgtcaagaatcatactttacgttttctgctttgtacttgggctccccgtctctattcccaaagctccagccacccttgccatactgtatggattacctatgactccctgggcagggacagtggatgtcttcgtcaccttagtcacctgagtttccagcccaggctgagccctgggcttgacccattttccacttgtaacgttgatcggaagcttggggtgcatatgggtgtggggaagaggaattcacccagcagggcgggaggggctgttcggatgggacgctgctacagagctgacaggagcagcctgcactcagtgcgtgagtccacctgataccatgtcctgcagctgcgtctgggctcactgggtcccttctcttacagagactgtcgtttgtggatgtggcaacaggatggctcggacaaggactgggagttgcatgtggaatggcatatactggcaagtacttcgacagggccaggtgaggttcttccccagaagccatttaactgccctacatctacatccccttcctagagtctcggggggcagccacctatctccgtgatgtggagagccctgaagggccagtccccatcacatcccgtggtgacccctctggaaggccttccctgtgccttttccccacctcgggcggctgccccactttctctcccacaggtctgttgaaaggtttcagctgctgttgcctttccattcttatcctagggttgatagcttttttaaaacttccagcactttagtggggtctgggatgtgtggtttgtttttgagactgagtctcactctgtggccaggctggagtgcagtggcatgatctcggctcactgcaacctctgcctcccagtttcaagtgattctcctgcctcagcctcctgagtagctgggattacaggcatgcaccaccatgcccagctaatttttgtatttttggtagagatggggtttcgccatgttggccaggctggtttcaaactcctgacctcaggtgatccacctgccttggcctcccaaagtgctgggattacagatgtgagccactgtgcctggccagatgtgttttcttgatgcgaacactcacgtcgttggttgtggaggaatttacttcacagcagaacacgtttccaaggtggggtgttttgattgttgtgattattgtaaataagttgtaagaacagaactagcaggtggcggcgggaggcggtggctcacgcctgtaatcccagcactttgggaggccgaggtgggcggatcgcctgaggtcaggagttcgagaccagcctggccaacatggcgaaaccgcctctctactaaaaaatacaaaaactagctgggcatggtggcgtgggctgtaggcaggagaattgcttgaacccgggaggtggaggttgcagtgagccaagatcacgccactgcactccagcctgggtgatggaaactctgcctcaaacaaacaaacaaaaaaattagaaggtggcaatgctttaaaagggaacttaccagaaaaatgaatgtgtaaatgtttggggaacttaaggatgctgctttcttccccttcccctctggccctgtttgcttattgataaggaaatgtggcagaagaacctaaaagttgctttacagctagaacagaaaactagccagaggtaaagcctgcttgtgagcccccaggcttttcaagctcggctttcttagctgctgggctggggcagagttgatgagggagattgtgggaagcgaatggtctggagcagcagctccagttgcgtccgtttctcctcctgaaatgcatttgtttggttggcccagatgatcccccacagggtcctaaacctctcttgtcttgctccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtaactgtattctcttgtgcttgatttccattctgtcctgcccccttcatctcttgtaacccagcctgctcctctgttggcaggtggaacacttatgtggtggacggccgggacgtggaggcactgtgccaggtattctggcaggcttctcaggtgaagcacaagcccactgctgtggtggccaagaccttcaagggccggggcaccccaagtaagcaagcactttcctcctgctcctggttgttaaaagcatctgtccgctcagcagcagaggcgggagaggcttagaggggcctaggcagatgactcatttagtgaatagcagttctgcctggagtatatgttggaggctcctgctctcttattttcactagctagtgtctgcttaggataggagatatcaaaagccctagcaggtgaacagtgatgtgctgcctgcacaagggagtggctaggagtacagcccatcggaggactgacagggaacaatctctacggttagtagaatcagaaagcgtgctgtgtgtatgagcaggtgcaagaaataagagtgcatacctacacacgtgcctaggcccacactcttctggaagaaccctgggaattggggaagacgggagcttggaatcaccaactatcacatttcaaggctgacagctgaaattgtttatctcaggtttaactcatcacaaagagtgcggctcctggatttttttaaaagactatagacattttagaataaaactgttctgtgactcctaccgaaaatatagttttactctggtaccctccgttcagtaaattattttaccagtgtgctcctggcaggaccctgggtgttgtccttgcctctgcctccccctcatatgcccacacatagacccagtcccctagattacatcttggacccattcactcctccccatctctactaccatgactgttgccacacccatcatctctcccaaagttccagctggcctccctccacaccagtctctacactgctgccacagtgatctttctacagtggatctgatcagtcactttccccactccaaacccttcaatggtttccaatcttgctttggataaaactcaaacttctcatacccacaagacccaccctccatggtctgccctacctgtctctccagccttattctcattctcccttccactcaccagtggccctcaggggcatagctaggtgcaatggcttgcacctgtaatcccagctacttaggaggcggaggcgggaggatcactcgagcccgaggagttggaagctgtggtgagttatgatcacccactgcactccagcttggggaggagtcatagcgtgagacccctgtctcaaaacaaaaagcctcagggcctttgtccaagctgttctctctggctgcagcagcgtcccaggccctctgtgccaggtgttcctcctgtgagtcctagggtgacatctttttcatcggggtctgtttttcaggtgacctcataggcactcactaaatatttatggaatggatgtcttttgtttgtttcattacaggtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaaggtaggcagaaaggtggataattgaataaatcagatacgtcaactgctttgttctctaatgttgttcgtatgtacacaggattcttcatttattctggtctccatggacgaaccaattactagagtgacatgtaactaacagttcgtaggcaataaagagaggtttgccatttttaaaaaatacatttaggggtccaaagtgcagctgtgtcacgtggatagatactgtgtagtggtgaggtctgggctttcagtgcacccagcatcggagtagtggacattgcacccagtaggtacttgatctttcaccactcctggctccccttctcttttattaggtctgatttttatttttggctttcacatgtgtgtctgaattttctgattggtcaattgctatttattagctcctggtgtggtgtgcctttttctagcttcctaactttggtttgtgcatgaaactgccacgactctgtgtctccgctaagaagactggccccaggcgggctgaccttttgaacttactctctgaattacacagaggagcaggccaattcatcagaaacctcaaaaaggaatcaaatgatgcacaaaactcttgagtatcaagtccttttggtttttagcacctttacatcctgccttctggtatatcatagcagacctgacataggcaagttctttatggcctagaggaagtaaggcggcgagcctagggaggaaggacacactttctgatccttctttatttggagaaattttgagtgttgctcatgttttcttagcctggtaatgagggttaaaaataaatgaattttgaatacttgagaaatcaaaagacaaaaaccagaagaaaggagacggtatatcaacaaagggtgggcaggcacagtggctcactcctgtaatcccagcactatcaggaggccaagacaggaagaccacttgagcccaggagttcaacactagcctgggcaaagtagtgagaccccatctctacatagaatttaaaaattatccaggcatggtgccataatatggttccaggtactctggaggctgaggcaggagaatcacctgagtccaggagtttgaggggatagtgagctatgattgggccactgcactccagcctgggcaacggagcgagactctgtctcaaaaaaaaaaaaaaagtttgagaaaactatataactccatagttgcataattggtatgaaaatgtgtaaaaagcggggggaccatttttaggaatacataaaatatcaaaattgactaaaagaggtataaaaaccttaaatggatcaatagccctagaaaaaaatggagaaaattatccaagtgctatacccccaaagcaccaggctcaccaggttatataagactgactcatttttaacctttatgaaaagagtaatttctaaactgtttcaaatttttccaaatacggaggaagatgaaaatgtcatcccgatttacttatgaagcgaaaatgtgacaaagctagcctaaagaaaactgcagagcaactttctttatgaataccaatataaaaattctaaatagaacattagcccatctcaacttcattagtacattaaaaaaattaaatgaatcagtgagctcaaattagtaatgcagatgactcatgccaggagatgtaggaatagaattcagtgttctagtgttaggttaaaggaaggagggaagtgtgatcatcatcatacacactaaacaaaagcaattcataaaactcaacattttttttttgagatggagtctcgctcagtcacccaggctggagtgcagtggtgcaatctcggctcactgcaacctctgcccccggattcaagcgattctcctgcctcagcctcccaagtagctaggattacaggctcccgccatcatgcccagctaatttttgtatttttagtagagacggggtttcaccttgttagccaggctggtctcgaactcctgacctcaggtggtccacctgcctcagcctcccaaaatgctgggattacagatgtgagccagcacacctggccaagtaatttgaaaaatataatgagaaccattaatgtcggaaatctcactcttgagctgtggagtgtttacctgcttaggaagtgggggttgggggagcgggggatgttaactaaaaagagcacaatttgagaaaaacttgggtgccacatcagccatttagtatggatttaagattggctagcagtccatgtttatgacattaaaggaaatttttggtgagtcacgaatttactttcttcaagatagatgataatttgtcattctacaatatggtaccttccttctgtagtcgttccttctaaatgcatttgaagaaactctaccacctgattgtctctgtcttctagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagtgtgtagtgtctctcagggcttcttagaatcaatggcccactggacacaggaggcccagcctgtgctagtttttctttccatttatgaaagcaaaaggactggaaaaaaatttcctgggaagcaggaggcaagtagccaggtggagtctgagaggtggcttctaggtctgctaggagggccgtaatagactactcggcacttggagtctccaagttggctgagggcagcaggcaaggccacagacagtgggtcctctgagcctcgaaccatctgaacccagggctctgggcctgaagcatcccaggctccctagtagctccttctgcccaattctgcaaccacccagaggcacactggctgaggagtcacagggaatgcagagtttccttctctccactgtagaggggcctaatatagcacagaaatgcaaatgttgcacttacttcaatcacaagaatatcaatgcttagagctggtgccttaggcaaagccattctgcttatctatgcctcagtctctccccagagtgatattaatgcagggagtatctcaagcacatgcacacaagcgcacccctctggagaggaaggagttatggccagtaaaccctttgaactctaaagctctgcgcgtcatagaagatgatgcccagctcctgtcattaggccagaaaaccacaggccagcaggtcttatgtgaccaccagtgactttatttataacaagtagtatttttaaaaaaaatttttttagacgaagtctcgctctgtcgcccaggctggagtggagtgctcagctcactgcaagctccgcctcctgggttcacgacattctcctgcctcagcctcccaagtagctaggactacaggtgcccaccaccacacccggctaattttttgtattttttagtagagacggggtttcactgtgttagccagagtggtctcaatctcctgacctcgtgatccgtccgcctcggcctcccaaagtgctgggattacagacatgagccaccgcgcccagccagtattttaaattttttaaaaattagttgccagcatttaaaaatcagattataggtgtagtggcaccagcctgcagtcccagctactcgggactctaaggcaggaggatgcttgatcccaggacttaaacgctgcaatgtaccactgcattccagcctgtgaaacagcgagaccccatctcaaaaaagaaaaagaatcaggaggtcttatatagaatacatatttctggattcttttgaaaaatgggaagaactactaccatagggtggcattccctcctgacgccagttgactgaagccaaacagcacccctgttgagatgggtgtccccacagctccccatgctctgctgggccatttgggttttttgttgttttgtggtttttggtttttttttgggggttttttttttttgagatggagtctctctctctctctcaccgaggctggagtgcagtggcacgatcacagctcactgcaacctctgcctcccaggttcaagcgattcccttgcctcagcctcgcaggtagctgggattacagacatgcgccaccatgcctggctaatttttgtgtttttagtggagacagggtttcaccatgttggtcaggctggtctccaactcctgacctcaggtgatctgcctgcctcagcctcccaaagtgctgggattacaggtgtgagcccccgagcctggctcattaagctgttttcattttgaatagaaaacaatgcgatccgtaattttctggattaatgctcctgtcaaaaattttgctccccacctcactgattgcctcagcacgcagccatgtagtctactccgtccctgctgatatgttctcacagttggaaaaaagttgtaaagaaaaggcgagcaggtggtatttagtgccatgttgaaagaggtggctacaatgtagagcttgaccaggggcagtcagggacaacctctcagaaaaggtgatacttaagctgagtctcaggtgacgaggggtcagccgtgtacagatgtgggagacagcatttcaagcaaggggcatggccaactgtaggcaggcccaggcttggaatgtttggagagcagaggaagggccaagtggtaggagcatggtgaacgcagaaaactctccagggcccaggtcatacggggtcttataggcgcccttttcagtatctctggttctcttgcagtttgctgggaagccactggagggctttaagcaggaaagcaacagcctgcgttttccaaaactctgaagactggagaatggcttcacgtaggaaagggaggagaaggagagggtgacttggaccagggcagtagctgtggagtcggagggaagcagacttgtcacatattgccttggcaggagagccagcaggatccaacggcaggtgtcaggacaggacccaaggctggtgcttgagtgtgggtggcagcacctgggggaaggtggtgtcacctcttgagattgacaagactgggggagaagtggactggggggcaccatcaggagctctgtgtgggcctggggggttggggcacctgttagatgtacagaggggagacagtggtatcagatggctgggcagtagatcagtcagtcattttcacatgtggccgctccacaccactaaatgcagttttctaaactacatattcgttggcctagttttaagctaacatcttttttttatttttattttttgtagagatggagtcttgctctgtcacccaggctggaatgcagtggcacaatcatggctccctgcagcctcaaactcctgggctcagggggtcctctggcctcggcctcttgaggagctgggagccgccatgcttggccacatctacatttttaatcataaatttaagtcgttgcaaaggatgtagttgttcatatattgacatttttgatactttaatactcaaatcatgccattaatgatgacactggctgggcatagtggctcacacctgtaatcccggcactttgggaggctgaagctggaggattgctggagttcaagagttcaagaccaggccgggtgcggtggctcacgcctgtaatcccagcactttgggaggccgaggcggacggatcacgaggtcaggagatggagaccatcctggctaacatggtgaaaccccttctctactaaaaatacaaaaaaaaaaaaaattagccgggcgtggtggtgggtgcctgtagtcccagctactcgggaggctgaggcaggagaatggcgtgaacccgggaggcagagcttgcagtgagctgagattgcgccactgcagtccagcctgggcgacagagcgagcctccgtctcaaaaaaaaaaaaaaaaaaaaaagttcaagaccagcctgaacaacatagtgagacctggtctgtaattaaaaaaaaaaaattcatgccaagccacttttctttgtcagaaattaaaaccctttttctacttgatttccaatttccattccattcatttccccaatatatctttatgcatgaaagccttttattgattgtcctatcatttttctctgcaacaaaaatatgcatataaattgataggtttttaaaaaattataatataggcttctgagcattaggtttttttttctggactgagatagaattttgattattattagctggtatgttagtggatgagtatacttgtagtttgaatgtgatagcattgagaacagattctattcctgtttttcatcttcatgatgtgctatgaaaccttacttacatgaataagtagatgggaagggaagttttgttagaggaatgtcactcagttctttgaattccttcccagttgtaagtcaaaaaatcacatagtgatctttcatgtaaagttgtttataaaagttatttacagagttgacagtttcattaattaagttcttcactttctctccaccagcatagttatttcaaattgtcctctttacttgggtctggaggttctgcactccaggatgatccccctgtaagagtcaggtggctgagagcatgccctttggggatcaggttgctagaaggtgattgttaaaagagacagttgggagacccaggggcagtggctcacgcccgtaatcccagaactttgggaggccggccgaggtgggtggatcacctgtcagttcgagaccagcctgaccaatatggtgaaacctcgtccctactaaaaatacaaaaattagccagacgtggtggcgggtgcctgtaatcccagctactcgggaggcagagacaggagaatcgcttgaacccaggaggtggaggttgcagtgagccaagattgcaccagtgcaccccagcctgggcaacagagcaagaccctgtctaaaaaaaaaaaaaaagaccatgaggggagcacagaccctccttttggcagatgaatgtagacagagttgatctggagtttgggatcttgagtgtaacacccacagccacatcccctttggaaagcctgtgtgtatccgcagagaggtttgtattctagtttgaagccttctggggtatttgagcccggacttctggggaaggggggtaaggaatggcaatgtaaagtggggatcattaccagaatgcacatcaggggagcattgggccagatgcgacttcccgagggtgcacagggccctgaggacttgccccagcagcgcccatgaggcgacagcagtgggccactgccacactgcagaaaccgagaggaggaaatgccttgagatcaggggccaagtcaagtcacaggccacccaaggtcaggcagcctcttggttttgtggcttcgaggtcccttgtggggatggtggcctagatgaagtaggctgggaagagcgtggaaaatgagaaagcaggggcaatgactataggcaagttttgagaagtttgctgcgaaggagaacacagatgtaaaagcaggacaaggcggagatggggctgtgaagataaaaggtgctggcgcacacctgaatggaaatagaatgatccaagagaaagggaagtagcacaagaggggaggaggagctgcatggctggagacccctgtgagaaagcaggaacaggacagattcaggatgtcctgtcggggcatggaccctggaaagctgcggacaccaggagggcaggcaagagagtctcatctcttgctccctaggagctatgagttgagggcgccgtctgagcaggagggacggacgggtgcccagggtttgaggaaagaggggtgtgggaaggacgcatgctagaacttcagagcagttcagcaggtgcagaatgggagttatcatggggactgtgggagaaggggcggtgggggcaatgcccagggatgttctgattcatgttctctgtgctgcaggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtaagggttctaaatgccatcatcttggtagccttcctccttcacagagaaagattagcatgtgattggttaaaccacgaatttccttatggttccatgaagtttgattattcaagcctttttcttgaaaaagccatattgtactttaaaagtgtcagactctcagggcaacttttgaagtgcatctctcggtggtactgttgtttcagacagtgagaaacagttgcttatcccgagtgccccttgtgtgttgagctgcgtgcaggttatggacaggactggcagagtcatggagccttttctgccctcgctgtggttgcagtctaactgagggtgaacagcatcacagaggacgaggagcattctggctggctgcacagcctgctcaggtgggaggggggctgggaccaccatcaccaccttcctgcctggggcagcgagaaccctggagcgtgacacgaggcaggaactcttacaaacacacccttctcagagtagtagtcacctggcaggtgggctagaaggaaaccacaggaaacgggaagccagagaggggattgaaacaaggtgtgcaaggtggtgggggagaaaaccaggggggtggggggggacctgagagtgaagaaagaggtgagtgtgcctaacagatggagcactctgcaatggcgtgaagagcaaaacacacgagtctccgggattcctcacttgggaaacgtcagagagtcattttcgtgaatgacagaaatgacatgggaaagatgagccagctggcgtcctgtggcaggcagatgggcttactagatgtggctgcacacacttgcttctagaatgccagagatgcacgctggaaagccatctcagggactccctgggagaatgaggctggacgagatggctctagatggagctagagtcacggctgtctgggtgaagctggaggcacaggtggtggccagagagaggaggcgcggcagtgttgcaggggcagaggggcctaggaaagggtccttgagcccacctgtggctgtgctcagtttcagttttgaaatagtcacatggagaaagtgactctaggttccatccaaagaagaactggaaggctgggcgcagtggctcatgcctgtaatcccagcacttggtgaaaccccatctctactgaaaatagaaaaattagccaggtgtggtggcacgcacctgtattccagctactcaggacgctgagacaggagaattgcttgaacccaggaggcagaggctgcagtgagccaagatcacaccactgcactccagcctggcgacagagagaggctttgtcaaaaaaaaaaaaaaaaaaaaaagccagagcggtggctcacacctgtaatcccagcattttgggaggccgaggcaggtggatcatctgtggtcaggagtttgagaccagcctgaccaatatggtgaaaccccatctctactaaaaatacaaaacttagccagacatgttggcacatgactgtaatcccagctacttgggaggctgaggcaggagaattgcttgaacctgggaggtagaggctgcggtgagccaagatgacctagtgcgctcaagcctgggcaacagagcgagactctgtctcaaaataataatagttaatttttttaaaaaaagagctgggctgttgaggttagacagtggtcctaggcaaggcagtgtgcatggtgacaatccccttcctagctgagaaaagctaagctgcccagtgcacattaagatttctctttcacatttctggtgagaaactacgttcccagatacaccctaaagtaccctgtagcaccctcagcatgctttgaaggtgtgttaactacttggaaggcctggagaaatgaaaaagaccactttggtatgcaaaacccggtctctggatatagaaaagatagagcagaaaagggagaacaaagcctgaggaccttcctaaagagaacgggttcagagacttagcaggccaaactcaggccaccaatgctcagccatcgtggacagtaacttggagtgatccatctgaaaagtcagctgagacttttcagttgactaacccgaggtgtcacagtgtgatctcaagggagacaggcgtgcaagaacacaatgtaaatgagttgtgaggatgcagcgggaccatttatggggctctgctacagctcgggacaccccgtggcaataggaataattgcttcttcagagctagaagtgggtggagggcaggttcctaatggggttatgctcctgttttcatcgggctctggttctctcaggtgacgatggtgcttcccagatggccctggaggatatagccatgttccgaaccattcccaagtgcacgatcttctacccaactgatgccgtctccacggagcatgctgttgctctggcagccaatgccaaggtatttttaaggggacactagtttcagacagaaaatgcttctggactctgctagtttcatactgatgattggacttttttttctcaacataaaagtgatattcattatagaaaatttggtgatagaattctttacaaaaaaaacaggagattatgcacacaaacacatttgccttgtaaaagagtccaacagtacaggatactgaacaaaacctgacagcctgtctcagtcagggtttagcagaagaaacagggaccattctgggtgttgtaaacaggagaaggtgtttaacaaagggtgcttaagaagccgcaggagcaagcttcaggcagagtcccagactatagtgttagtctccagtggctgcagccagaggccaagaagctcctgctgtgtcctgacatccaggaagctggagagcgggtggtaggctaccactacaaacgaacccgggttccctggccctggcttgcctttggaacagcttagggcgccaagagtgtgtgggacctcatgcaagggcatcagatggacagaatcaaattcctgttcagaacctagctgcacgggagacgaggcagtgtggtcttgatctttccagcctttcccactaacgttcagcaggtttcccttgccaccctggacctcgcccatgcgccacacaggtaacccctggcacagtcgggatggggactgtatgttccctttccaagcactcatgggcgtttctttgatttttttttttataagtgggctcccgctttacatattattaggtacttttttgtgtggtttttgtgttttgttttttgggttttttttctttggagacagagtctcactctgtcgcccaggctggagtgcagtggcacaatctcggctcactgcagcctccgcctcccagattctcctgcctcagcctcctgagtagctgcgactagaggtgcactccaccacggccggctaatttttgtatttttggggagagacagggtttcgccatgttggccaggctagtcgcaaaactcctggcctcaagtgatccacccaccttggcctcccaaagtgcagggattataggcatgagccaccgcacctggccaattgtgtacttttaaaattagtttatcttggagattgttctgtgatttcacacgttatagggtttcatttctagaaaggtcaagagaggcgcaaaacaagattaggtgatagaaattagagtagaggttgcttcatagtggggggagactgactggaaggaggcacaagggaactctgctggcggaagcgctgctgggcttggatgagggctccacggcggatgcagcattcaggaagggctgaacttaggatgtatgcatttcactgcagctgagttatgcctcggtgaagacactgaataaagatggatcatagcgtatgaacgaacagtagcgacgtttcttgctatattcgtttataatgcatccattaatatgtatgtaaattaacaaatactttagacatacaagtgttcatttatactggtaaatgtttatgtgctcaaattggtcataaaaatgtatttacattttattgggaaaggggccagtcgtcttgtattcagatagatgtttatggtctttctaaggatgaagcattacaagttattgtggcaaaagttaatgttttaacattctattcgggctttctagtcaatgtgagtcagtgctcctgccgtgagttaatgttctgtctgcacagaacaagtcagtgagtattggggaatcttccaaggggattggtgtgatggcatgggggagcttgtccttcagggcagccccaaggtcctgctgggacctgtcgtccactggttgtagatgctcacccctttctccaaagcctgtgtttttagtagaaagagctgtcctcttcacacccctccttcacttctttcaacgtctgttgttggaaattcattgtttgcttttctaaaccatggctccatttatgccctaggggatgtgcttcattcggaccacccgaccagaaactatggttatttacaccccacaagaacgctttgagatcggacaggccaaggtaagggcttacgcgctcctgcgttattcagtatcatctcctgtaaaaagaacacttctgaatctatcaccagctatcttcagagttgagacatcatcctttctttgctctcatttttttaaaaaacagttgtgacctttacctgcttttccttgggaaggaacattctatgaatttcagcttagcctgaacttttctgctttccaaatggagtcttttgttgttgttgagttcaaagatagtaacatgaagccacttgagcggtcgtggctataatttatcttggccgcaagctaaacaaaacagaagccagcgctttgggaggccaaggcgggaagattgcttgaggccaggaattccagagcagcctgggaaacatagcgagattcccatctttacaaaaattttttaaactagccgggtgtggtggcatccacctgtggtctcagctactcaggaggctgaggaaggaggatagaggagcgcaggaattcaaggcagcagtgagctatgatggatcacaccactgtactccagcctgggtgacaagagtaagaccctatctctaaaaacaagacaaaaaataatagaaatcacttgaaatgaataatctgttaggttcagattttacagatctaaggccaggaataaaagggaacatgatctctggtattctcacaaaagccctgagaagttcagattatcagtcctatctgtagatgaggattggagaaagtaagtgtcttacttaagggtttacagcttgtgagtaccaagaccagaatccaggcctgagtagtgagcccagtctccccaggtctgcccaccacgctgaccatcccctgctcagcctgcctgtcagggccatgcatagagaaaagcagaaacgtctatggagaaaataagtgactctgctcatcacctagggagtggggcttgtagacattttggcatgcttccttcctgtctttgttctaggcatacatgtatattttacacagttgagatcatactgaatagaaaggtttgcccatagccactcttgaaagagcagcaggtaacatccaatttggttgctaaggactaggctgctccagaattcacagttgcaagtactcagaatggccagagtgctgccataaagcaggtgtttccagaactgtccactgtgtgccataacgtagctggaaaacgccaccaaatggaaaagttagtgttcacctttggtgttaactacaggttctgtttctatggggagggtctcttgacattcacatggtttgcagagcttgcttatttctgtcgtctcttttctaataattttcctgtcctgacaaaagcaagtaaatttactgatagtaaaggatgtgagataaatgtgtgtgataacatgcatggcatggatcgttaaagggctgggctttgaaaagaggacatggatatgtgtgcatgcgtgtataagtattttaagaggccaggacatccttaaagaatggggtggctcagaaaccctttctgtactatcagcaatggttcttaagctacagggaaacctatacagaggggaagtggagaataattccagatgcctccgatgggtagctttggaggcaacaatctatgaaagaagcccaggaactctgtctttgcttgcagaatagtacgttgtcgagagcgagggctttgatgtcagccccgcctggctgtgggtcccagccctgccctgggccacttcctcctgctctgagatttgctttcctcagctgcagaacggttgtgccactgaacagatcttacagggaggctgtgagggttctcagagttcaggcacacaagatcttagcactcagcgtgttgccaatgcccagaatgttctcattaacatgttagtcactggagtccaatctttgcatgccatagtgagctctcaaaccagactcctgatgggtatgtggcgtatccatgctccaggacagctggagcagtgtaatttcctatcaaaaagtatgtgtcctggcttgtaaatgcatctgatttttttagtagtgagttattaaggagtgaaattgttagaattgggggatagcggcatagcaaagtgccttccactttgacatgcattctgtgtgtagtaaccacggcattctgttttgctggcactataccaggtcctccgccactgtgtcagtgacaaggtcacagttattggagctggaattactgtgtatgaagccttagcagctgctgatgagctttcgaaacaaggtcagttggttgagtatgagcattgaagttcaagctgggaagaggtaggacttcagctacctcctgtgccctgagtgctctttttatttttatccctgcatgttattctgagtctctttcttgtaccaagctggtttttgctgttctgcagatatttttatccgtgtcatcgacctgtttaccattaaacctctggatgtcgccaccatcgtctccagtgcaaaagccacagagggccggatcattacagtggaggatcactacccgcaaggtgtgtgtgggcattgagaatgctttggaaggttttggtgtttttgtttccttgattggccacatggcatgctctcaggcatcacctatagtctacctctcacccagcatggctttgttatttgatgttcactaagcgtggggccatactcatacacatctgtgtgtccccaacagagtgcacagtgcccagtcaccagggcgggtcagtggcaacacagaggagtggctattgcaggcaagcgaggtgtcatgaaaagcatcgcagtttctttgggtttggaatgatgaatagtatgccccaggccaggcgtggtggcttacacctgtcatcccagcactttgggaggccgaggcaggtagagatcacttgaggccagaagctcaagaccagcctggtcaacatggtgaaaccccatctctactaaaaatacaaaaattagctgggtgtggtggtgcatgcctgtagtcccagctacttgggaggttgaggcaggagaatcacttgaacccaggaggtggaggttgcagtgagccaggatcataccattgcactccagcttgggaaacagagtgagactctgcctcaaaaaaaaaaaaaaaaaaaaaaaaaaaaaaaaaaaaaaaaaaaaaaaaaaagtgtgccccgacgaaagcaggtatagcagagaacacagcaaatgcagaaaacagtgtgtcagggagaatgggctgggcagtgtttgcgcctggaaaggttaggtgggacagatgatgtgatacaaggagcattgagtgttcatgcggcaggggccctctgagcctgcacaagcggtgcctgatctctcgaaggactcctgggacccagcacacagttgctctcacacctgaggttgatgacagggaaagggtgcagggggggatccaccagggcaggaaccatgggccaggtggagttgaaagaagtcctgccccagcctccccttggccccacaaggggcatactgagaagtgcctcccacgcaggctgtgttcctgcctaagggatgcctgctagagacttggcacctcaagtgtgtactgggggcaggtcctgttggcaccctctgccaggcaggtacccaaatccctggctcccagcaggaaagcaggtgctcatgtcaaccacattgttcctacagacagtccaggtgcatgaccgccctgtctagtggggaaagtgttagagtagcaagggaaccttcacgagccaagagctaaccttgccaaccaacagcctcaagccagctagtcacttttctgcactgttaattcattagttctaaccattttcaggtccccaacagctttgagaatcagagtgccacagacccccacactcaggcagcccttactgtaggttgaggcagagcagtttggaaactggcagtttagaatgagaactccgcaggcccatcggagtggctgttcacatgaatcagattttcccctgggaagctgcagattcaaaggcctctatgtggtgaggctttaaggctgacgagctgctttcacaaaagggcctaacatccttgtttccccaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaacca

SEQ ID NO: 4097 - DNA, 779 bp, human
tctgtggggcgagaggctgcaatactccatcccgggtgtctgggctgctcaccaggccggctcaggcttcccacatcctgtaccctgggttgggcatgaaaccgatccaatcgtcccataggctgttctttttgatacacatagaaactgacccttctggtcttcaagcttgaaccttacagttgttttatctgaattccttcctcaggaaatgaccttcgggcctctcaaaatatcaaagaactgaaactcaccagataaccacatccagacaatgagatgctggaccccccaaattcatcaggattgctttctgggccctcccgagttcctgttttcctacacattggtgcatttcttcctggctatataaacccctagttttagtcagggggatggatttgagacttaactcccatctccccggctgcagcacccaattaaagccgtcttccctggtaatgctcttcgtctcagtcagtcattggctttctgtgcggccagcagcaggacgtagaccaaacccttggtatttcggtaacaggcacacccccaggaagggaccccggacacggctaccacctctaggcttaaagcgaatgcacttcccgcatctccagtcttccgtgtagcagctttaacctatgtatgtctgtgccacatccagtcctcagacggctgagtgaccccaagaaaggcttccccgacacccagacagaggctgcagggctggggctgggtgagggtggcgggcctgcggggacattctactgtgctaa

SEQ ID NO: 4098 - DNA, 892 bp, human
tgcatactacaggtgcagggttctgtgcgtggttccaagcagctgcggaatgggaccctagtgtcccagtttcttctgaaaggcctgagggacagcaaggcttggaggcccctgctgttcaccacctttctgctaatctacatagtggttgtggttgggagccacatgttcacagtggactaccgacgccacactcccatgtacttcttcttgggcggccactcgctgatggatgccgcctgtatctccaacatggtgactcaggtgctggtgcatttgctggctccggtagggcccgtactttattgtgcttgtctcatccagatatgctttctccacttcctggcaccctaggagtccttcctcctcacagccgtggcctatgattctatgcagctatctgccagccattgcactactttgtcctcgtgggccgactgacccacacgggcctcacttccatctcctgcctgctggccttggccaacgcattcacctacagcatcctcacagctctacccaagttctgcaggccttgcctcatcacccacttcttctgcgacctccgtcactgctcagactctcttgcttcagcacacgtaccaatgaacttgccctgttcttcagttttctggtggctcttgcacactgcgtcctggtcgtggtctcctatggacacgttgtggctgctgttcaggattcattccacccagggctgaagaaaagccttttctacctgtgttgcccatctcgctatgatcggtcttttctacgtcacttcagtcccctgctacatccttcccaactctgcatactctggcttgggcgactgggtgctctctgtgctatgtgtggtcctcactcacatgctaaaccccatcttccccagcat

SEQ ID NO: 4099 - DNA, 76329 bp, human
cacactactgtgcaagcaatcaagtggaatagggaagtccaagaggagtcttgcttttgtttctccgtgaactatgcacatggcagatgcaggtggtacttgggtttcagctccagggtccctgagacccagggaccagcccgtttggcgtggcggattggggatggggcatgagggcaacaggttccaggctgtgctcccattaggtcgcagggctccttccgagcgctttctcgtgaccctgggtgagagtggcaggcgccctgctgcgtaggctcccccccccacaccccccccccgggcacagccgctggcggagctgcagttgctcgaaggggcttcccaggcttcgctgcttgcttttcccgccgtcttgggttgcgggcggcgtcggttccctccccgggggccgcggcggccggaggcgggggtcgcagcggccgctcggggcggcgctgggcgggcgggcgctgggcccgccccgccggcatccttggcccgacttccttctgccgcgggcggctggcccagctggaggaagcggcggcggcggccacgatgagtgcgggcgacgcagtgtgcaccggctggctcgttaagtcgccccccgagaggaagctacagcgctacgtgagtaggggcgccgccacccgcccggccttcgcgtcccggggcacccgcccgcggggcggccgcggggagccgctgggctccgggcgcgccaggcgcagccgctcccagcgcccgggactgcgggcgaggccgacggacggaaaccgaaatcgcacgtcgagccagcttcgccgctgtgctaggcagcgggccggagaccaggtggcgcctgcccgcggggctcagggactccagaccgccgctgactctagcggagggaggcgggttggggctgaaacctcaggcgccactctccgtacaggagcggccagggagacatctcgaaagcgtgcccctttctttggctgggggtggctctgagacccatcgccccgcgaaggagacgcggcaggggatagggagactgacagccagaggggaattgcctgcattccccctggaccgtaaggagtaaggagtgctgctcttgtagctgtcatcggacactgctgtctggaaccctacacagtgtaactcgtttctcatcgtgtaactcctttcagcttcttcttaatgctgacaccgcgcttttatagtgccagctggacaactgacttttactaatatgaaattaggaatacttggaagagcgaatcttcctacctattccattaccgttttaagatgtactatcgacacctcaaacgttcattatctccatcagcgtcctcacgataaggtcttaaaaacattctgcttaaagacctgattgctactcagtgtttttcagccattaggaagaaccacttcagtccccagggagttgcatataaatagctattaggacttcttgctttttttaggctgggagtagctggatggattcatcttgttcttaattcctaatttctctgcaacttcactgcacggtggtaggaacaaactcgcgcatgtctgcgctcatccaaagcagcccaccccaaatgtggttcagccttgtgctcttgtctatacagtgctctcaaactgctgtcctcttctggccaaatttcacaactgtttttgttcccacatagatgaggcacatattgtgtggaagttcaagaggtgggattataaaaagactttaataatgtatgaatacttccagaatgtgtggcaggagattttcctgaacatagagttgctcaagccctctttccccattcacatcgggctagacagtgtgtgtttctctcttaggggtctttgaaaagatttttgttgtttgttctgcagaacagaactttagaggaaggttgttctatttagcacgtgaatatcaggagtgcataaatactgagatttctctaagtgccagtgtgtccctacatcatttgcttttgagtccaggagtccataagcacagggtccaatatctcttggcctctgcattatccagctgcttccttaactgtgaagctactcaaaggaggcaagagaagaaaacctgctcccatcacctgcatgagcaggtgaggcttttgtcacacagtagtgcttgcagtgttgactcaggatgggtttccttgttgtcctttggaatgacagacattttaaaggttcactatacaatttcagtagatgatacagaaagatgcccctggagggcaaagattatagaatattttatttcccagtctttttttgtatcttaagcagactggcttagggaagtttattagtatttcatcaactttgggaaggcatgagtgtgtgtgcctattatcacacgcggttcattcctttaggggatgtggcaagagtggacactgcgcagcttagagatatgtggggcgtgtgatgatggggcagtgactagacttaagacacaagagtacctaggtgtcatcttaccaacactccaagacataaaccttgatgtttgggaactgtctctaagaaagatcatatctagtcaatgcttttttcgctgacaggcatctgtccctggaacacaccacagaaagaattctttttcctctcatagctaaattctgcaggaatctttttcaccactagatggtgatcatgtgtcacttcgacggggcctggatagggctgttacagctgcttaaattcaattcctgtcactccctcccgttaacggagcgctaactccgaactaggccctgtgttacaggctgggaagacagaaaaaaaagacttgattccagtttatagtttaacatttataatagtaacatagcaaaactagttattggcacaaccaggacaataactcagttattcgtgctgccaggccagcaagcagcactccatcaatgtttgctgttacaaatggaagctcaggcagtttttaggtaaacctttcagtccaaagtaggcttgtacttcatccacttgaatccatcagtgaagacaatcagaaagttattttttatcactggtcttttaaaagatagttattttcatctgtattttttgtttcacaagaaatatattcttatgttaataaatagaatgaaaagtgaagaccccctttaaatttcccctaccccgctaccttccctttgctctcctccttattccactccccaacccagggataacaactgtgagccgttcagtgagtaccattctacaaaatttttcagaaaatatataattttctttttgcacaactgggatcatattctactaacggtcctgcaatttgctttgttcacaaacatcctggacatctttccaggttagtacatatagatttacttcattcgttaaagcattgtcaaatattccttgtaatacatataatataacaatttctctattggtgaacatttggcttgcatctatttttatccattttaaagagtcctataataacagtgataataaagctataatagttcacttttattgaatgtttatatgtgccaggcactacactaagaacttgtattaactcatttagttttcaaaacaatgccaagagccaggcactgtttttgtccctggatataggttctctggatataggttctttgttgcatatttaatttgcaaatattttctagcagcccatagtttttgtcttttcatcctcttttgaagaactaaaatttaaaaattttaatgaaatccccaatacaatttttcttttatgaatcatggatttaatgttaaatctaacaactcttcatctagcctaagatcctttgtcacccagccttgacctcttgggctcaagtgatcctcccacctcagtctcctgagtagctggcactatagctgctccccaccatgcactgctaattgtattttttgtagagaggacaggatttctccatgttgcccgcaggctggtctccaactcttggcctcaagtgatccttccaccttggccttctaaagtgctgggattacaggcgtgagccaatgtacctggcctctgaaagttttataattttatattttatatttagatattttatatttagatctatgatccattttgagtaaattttataaaagctgtgaggtttgtatcatggtttcttttcttgcataccgatttcatttgttccagtactatttattgagtagactgcctttattccattgatttacttttgaaacatcatcaaaaaccaatttacctgaagggcacagtggctcacgcctataatcccagcactttgggaggctgaggctggaggatctcctgaggtcaggagttcaagaccagcctggccaacatggtgaaactctgtctctactaaaaacacaaaaaaaattagccaggcatggtggtgggcacctgtaatcccagctacttgggaggctgagacaggagaattgcttgaaccccagaggtggaggttgcagtgagctgagatcacaccattgcactccagcctgggcgacaagagcaaaactatctaaaaaaaaatccatttaccatatccatgtagatctatttctggattctctagtctgttccattgatctatttgttttatgccaacaacatgctgtttaatgactaatgactgtagctttacaataattcttgaaatcaggttattttagccctcaaactttttctttctcagagttgttttggctattttaggtcctttgtttttctatggcaattttaggattggtttgtcaattgatttcactgacctcatatcccatagccttgctaaactcacttattagttctaatagccttgtctgtagttgcaacctgcaatactataaatgttgcatagaaatgacgagagcagacatccttgactttttcttgattttagagggaaagcattccatttttcaccttttaagtatgttagctgtaggctttttgtaggcaccttttaccaaattgaggaagctcccccatcttgctagtttgctgaggcttcttctcatgagttggattttgttgtgtttcctgcatctataaaaatgatgatatgttttttattttttagtctgttactatggtgaattacactgcttgattttaaatgttgaaccaacctcgaacttatgggataaacttcagttggttgtaacatattattcttttcatatatttctggatttgctttgctgatagtttggctgaagatatttgtctctgtccatgagggatatcggtctgcagttttccttttttatgctatctttggttttgatattagcataatgctggcatcataaaatgaaatcagaagttctccctcctcttgtattttctgaaagatgttgtgtagaattggtattccttcttccttaaatgattggtagaactcaccattgaaaacatctgggcctatacttttctttttgggaaggctatcaactacaaattttctttctttcttttttttttttttttttttgagatggagtttcactcttgtcacccaggctgaagtgcagtggcacgatcttggctcgctgcaacctccacctcctgggttcaagagattctccagcttcagcctcccgggtagctgggattacaggtgcccaccaccatgcctggctaatttttgtatttttagtagagacagggttttgccatgttggccaggctggtctcgaactcctgacctcaggtgatccacccgcttcggcctcccaaagtgctaggattacaggtgtgagccactgggcctggccaaattttatttctttaatagatatagggctatgtgggttatccatatcttcttgaatgagtgtcgttagtgtctttcaaggcttttctctattttgtctaagttcttgaatttattggcagaaagttgttcattatgttcccttattatcctttaaatgcctgtatgatttgtagtgatgcctcagttttcatttattacattagtttttaggaaccatcctttggtttcgtttattttctctactttctccctgctttcaatttcattaatttatcctcttatctttattattttcctccttttgattgcattgggtttaatttaatcacttctttatctagttccttagggaggaaacttaaattactgatttgagacctttcttattttctaatataagcatttagtgctataatcttcctttttttttttttctgagactgagtctcgcattgtcacccaggctggagtgcagtgacacaatcttagctcactgcaacctctgcctcctgggttcaagcaattctcctgcctcagcctcctgagtaggtgggattacaggcacctgccaccatgcctggctaatttttgaatttttagtagagatgcggtttcaccatattggccaggctggtcttgaactcttgacctcaagtgatccagcccaccttggcctcccaaagtgctgggattacaggcgtgagccaccacacctggccaatcttccttctaagcactactttaggtgcatcccacaaaattggatatgttgcattttcattttaattcatttcaaagtattatttaattttcccctgagatttcctctttgatccaagggttttctggaagtttatgtaatttcccaatattggaatttctagatatctttctattattaatttctagttaaattccattatgatctaagaacaaactctatatgatttatattctttaaaatttgttaaatgtatatcatggcccacaatatagtttcacttcatgtacataagcacttgaaaaaatatgtattcttctgtcattgggtaaagtgttctataaatgttaattaggccaggttggttgataatgttattcagttcttctgtatccttactgattttctgttcacttttactctcagttactgagggaggaatgtgaaagtttctatctgtaattgtagatttgtccacagtgtccacatttctacctccagttctatttgtttttacttcacatattttgatgctccatttctagttatacacatttggaactactatgttttcttggggaatagaagcctttttcattatttaatgtcttgctttgtccctgatgctattccttgttttgaagtctattttcttctttctattgtctttttgataatagctttcttttgatatgtgcttgcacggtgtatctttttccattcttttacttctaacctctctgtgtctatatttgatgtaggtttcttatatacagcatagagttgggtcttgctttttaacgcctttttttttttttttttttttttttttttgagatggaatctcactctgtcaccaggctggagtgcagtggcacgatctcggctcactgcaacccccgcctcctgggttcacaaagttctcctgcctcagcctcctgagtagctgggattacaggcacgcgccaccacatctggctaatttttgtatttttagtagagatggggtttcaccatgttggccaggatgatctcgatctcttgacctcgtgatccgcctgtcttggcctcccaaagtgctgggattacaggtgtgagccaccacacccagcctctcaccttgttttaattggcatatttagttcattcacataaagtatgattattgaaatgtttatattaaaatacaccatcttgctagctgttattcatttgttctatctgttctttgtttcttttctcctcagtttctgccttctcttgggctaatagagccttttttattattccattttatctccattgttaacttacatttcataacttcatatttttgcagttaccctggagtgtaaattatacatctttaattagttgcagacttcctttaaataatattatatcattataatattagtagtataaggacattggaatagtatattcccaattccattcttatattctttgtgctgttgtcatgcattttacttttacatgtgctataaacgtatgatacactactactaattttgctttagacaaccagttatcttttcagtcaattaaaacaaagagaaaaaactaaacttttatttttcttttatttattccatttccgtcactcttcatttctttatgtaggttcaagtttctgtctgctatcatattccttctgcctgaagaacttccttcagcatttcatgtagtttaggtctgctggcagtgacttctctgttttgtttgtctgagaaagtctatttctccctcattttaaaaaatattttcactgggcatagaattatgggttgacagtttaaaaattttgttttgttttgttttgtttttcttttcagcaccttaaagatgtcactttatcaatcaggaaatacacacacacacacattaatacatttagcttgatccaatattatattctgtcttccttggcttaacatcctgggaacccattccacagatttcagtggtttttaaagacagctttattgaggtatgtgtgtgtgtatgtgtgtgtacatatatatatatatatatatatatgtacacacactatagaattcacccatcataagtgtacagttggttgactttgagtaaatttatacagttatgcaaccatcactgtggtctagctttagaccatttctatccccacaaaaaattcccttagcctatttgcagtcactcctcactcctatctctagccccaggcagcaactgatctgctttctgtctctatagatttgccttttctggaaatttcatataagtggaatgatagactatgtggtccttttatgtctggcttctttcccttagcattgaccccacagcagccagtgtactttctgaaattcatttaaagtagaagctgtggccattgatatgagatctttcttattttctaatacagatggttcctgacttacgatggtttgacttatgactttttttgctttacgatggcatgaaagcaacactcattagtagaaactatacttcaaattttgaattttgattcaaaattccttataactattataaaataggctttgtgtgagatgattttgcccaactgtaggctaatgtaagtgttctgagcacatgtaaggtaggctaggctaagctatgaagttcaataggttaggtgtattaaatgcatttttgacttagggtatattcaacttatgatgggtttcttgggatgtaactccactgtaagttgaggatcaactgcatagacatttagtgctacaaatttcccccttggcactgctttaatggcattccacaaattctggtgatatgttgtatttttggttttattcacttcaagatatcttctaatttcccttgtagtttttttctgtgacctgcgggttatttagaaatgtattgtgtaatttccaaatatttgggaattacctagatatctttctgttttttacttctaatttcaatttgtggttggttgaacctatggttgatggaacccacgagatatggtttggctctgtgtttccacccaaatctcaccttgaattgtaatccccataatccccacatgtcaagggcaggaccaagtggaggtaattgataatcagattatgggggcagtttcccccatgcttctcatgctatcgagtgaatctcacgagatatgatggttttataaaggtctggcatttcccctgcttgcactcacttcatcctgctgccctgtgaagagggtacctgtttctcctttgccttctgccatgattgtacatttcctgaggcctccccagcaatgtggaactgtgagtcaattaaaccttttcctcttttcctttttttttttttttttttttgagatggagtcttgctctgttgcccaggctagagtgcagtgacatgacctcggctcacggcaagctccgcctcccaggttcaaacaattctcctgcctcagcctcccgagtagctgggattacaggcgcctgccactgcacccggctcatttctgtatttttagcagagatggggtttcaccatgttggctaggctggtcttgaactcctgacctcgtgatccacccgcctcggcctcccaaagtgctgggattacaggtgtgagccaccatgcccggcccaacctttttcctttataaattacccagtcttgggtatgtcttcatggcagtgtgagaacggactaatacaccacatatattagtctgttttcacactgctaatacagacataccagagactgggcaatttacaaaagaaagaggtttaatgggctcaaagttccacgtggcggcggaggcttcacaatcatggtggaaggtgaaaggcacgtctcacatggcagcagacaagagaaagaacttgtgcagggaaactcccctttataaaaccatcagatcttgtgagacttatttgctatcgtgagaatagcatgggaaagacctgcctccatgattcagttatctcccactggtccctcccacaacatgtgggaattatagtataggagctacaattcaagatgaagtttgcatggagacacagccaaaccatatctccgtggatgcattctctagtaggtagaggccagggatgctgctaaatgttctgcaatgcacaggacggtcctccaccacaatgaatttggcccaaatgggtccaagtggtgccaagagggagaaattctgttccagattgaacagtgaattccttcagcttaagtgagaattctgttgatagatatctactttaattctttcctgttatggtgaagaggaaggccagggacctgggttggctatacaggtagcttgttttctgggtcgtgggctacctcagcaactggaagtctctgtgcttaggatcaccactaagggagggatctcctccatgagtcctatataccgtgggaagggattgtcatccctctgtggaagtcagatcacttgggcgccttgtgacctccactctctgatgggctcaagaaaatgaagattttgtgttttgtccagcttttctcgtcatagtgggaaggatgttctttgcatctttttacattcctagaagcggagaacccttatatttcttttctgagacaagtttcttgattttcttttcagatatattccatgcatatacaagcacatatacttccccattttttgcacaaatggtagcacactatactcactattttgtaacctcctttcttagtaatgtattttggagattggtccatatcagtccataacagcttcataatatttcactatgtggagatactatgatagaacttctcttgtttccagtctcatgctgctgtaaacaatactgtggtaaatatctttgtacattggtctttgtggttatgtgcaattatgcttgtaaaaaaaactcttagaagttgaattgctgagttgaagtgcatgtaaacgtataatgccaatttttactctcagcaacagagtatgaaagtgcttgtcctcaaatacagtgtactgttaaatgtttttatctttgaaaaatcaatagatgataaatggtatcttgttttaattaaatttctttgtgagtgaggttgaacatctcttcaagtataaaagccatttatatttctgtttctagaaaattatcttaaatgtaacctaaatcttaaatccttcattgggtctgttttggggcagttttgttgatcttcctgtcaattcttctacttttgacttagttttaaaaattgctaccaaataggtaatgcagtcatgtttcaaaaattaaaaaatatattttaaatgtttgatgaaaacttcttccacctctgtcttcatccaccctatttacccttacccccaaataaccattttttaatttttttctttaatcttttcagtatttctttatatgaacacaaggaaatacatatacagcttcttattcctccttttcttacacaaaagatacacaatgttctgtacattagtctgttcatttaaaaatttatcctagaattgtctccatgtcagtggccagagttcatcttttttcttttattgatttcacttaatataataacctccagttccatccgtgttgctgtgaatgacaggatttcattcttttttatggctgaattgtattccattgtgtgtatgtactacattttctttttccattcatccattaatggacacttaggttgattctgtagcttggctattgtgaatagtgctgcaatacacatggatgacgtgagtatactttaagtatggtgtaaatatgtaaaagcagcttctgttaatgagtttcagggcatggtactgagaagctttgtttttttaaatcatatatctttaataaaaactttaatttttgacactgggctcccactccccactccctcaaaaccttatctttagtgggcatgtcatttcaggtaactagatgatgatttaattaggcagataaaaaatactgttgtgggatctgccgaagcaatcttgaggttaaactgtcaggaaagacgatcagaatctgtaccttcattgtaatggagactggaaaagaaaggatccatcatttcttgcttctataactggagttgggaattccccaaatatagaaaaaggtgcagatgctgggtggccaaaacaactgacaatgttactccagattgccacttagattctggaagtcaggttgattgggatggtatttgaagatatcctttttaaaaaaatctttcctaggcaaggcgacttagtccagggtaataatgtgaatgcagcagaagggaaaatatgagaatattttagagaaataatcaatgggaaatgttgattgcttaattataaggtatgtgagagagggcgtaattaaagattttgaacttgacaggagtagggacgaggagaagggtgattagcccaagatgaattacagcaactccaatgctggccacatttttgccagccatttgttatctggacacttccaatgacaggaaaccggttacataatatgctgcccaaataatcgtgtgatagttctgactgcaagaaattggtcctggtgttaacctccttagaatatacagaacacctctaattctttttcaatttgagagccctgcaaatatccaatctaaatgttgccagcttactcagtcattccttaggatagaacagagttctgagttccctcactgtcctgtatatttcctctgaactggtaccagaactaaataaactcctccaggaccatcattgctcatctggacatcgtgcttctgagaaagcagctggagattccattagctttgttctggcagccacgccacaccgttgactcacactgagcttcctgtcaaacggacttagatttcctctgtgtttcagctaagctatcttttctccagtctgttcttgtgctattgctgttttgcttaagcccaggaacaggacctacattattactgttgaatttcatcttttatttatttatttttgtaattgattcttttttatttttttgaaacaggatctcactctgttgcccaggctggagtgcagtggtgcaatctcagctcattgcaacctccacctcccaggttcaagcagttctcctgcctcagcctcctgaaaagctgggattactggcgcctgccaccatgcccggctaatttttgtatttttagtagagacggggcttcaccatgttgcccaggctcgaactcctgacctcaggtcatcctcctgcctcggcctcccaaagtgctgggattacactgcgcctggcctgtaattgattttttacgccacatctttctggacactgactatgtcatacaaacactgtgagcaagagcatgggagaaaagacccagtttgggggcaagccagtgagactggtacgttcaggctggcacataccgagtttgaagtaaccgtgggtaaatttgtctagagctgaggggagggacctgggctccagatggagttttggtggttactggggtataggaagtagttaaagttatcggggtggatgagattatccaaggagggtgtgatgagtaagaaggaaaaggacctagggcagaattttgggagataccgcagttagagagtaagaggaaaagtgtcagcaaaactgagaagagataagaggagagaccattagaggcgatggataaccctaaataccttgcagtggtaatgccagtcacccgcctttcctcccagggctctgactgatagggcacagagaaggaatggacaaggggcacaagataaggaagatggatgcaaaacagctgtttcatcactgaaaaagctgaattggagacagctacttgggcctgaagtctaagtggggcttccgagtctttctggtgaagtggattcccaatattaatggtttaggaagaaatgggtagcaacgacagcaagaagtgtggcagtggaagagaaaggagatgagatggtagttaaaagtgaaagacacaaatgggaggaaagtatttattcatttgcagtgtcaaccagaaaaccagtgacccaggctatcagacccaggcctgataaagaaagaaatacaaccaagtgatgagatggactcgaagtcaacaattttccaaagggctaactacatctttagggcctgaagtgtgtgttttagatgagttctgccaataggtatttgtgagattgaggataaagtgcacaggttagaagtcttaataggaaaaatccttggactggttcctccacaggccaaatgctttgggacaagctctctaaatggcagagaggtcactcaggtccaaccctggcttattctccctgcccctgcatttgatgaataccttaaacctttaccgtgaatcggatacaagactttaagatcttagcaccaaaatacgtacacaccacagaaaagcagaaagaaaacttcaagtctagcattttactctttttaaattggaagatggcagtatgtggatccacttggctctagatgataacagtcagcactcaaatatgttgttattttctgagagaataatataatgaactcttcctaggtggtattattgtacttccattaggaggaaaatcgtatctggttgtctccctttttgtgattgtagcagccactgatgcttaatgcttaaattgattaattcattaaggattacaaatggtgagattctatttctcattcgctcctaatcaagtgtttactccaccactccatcaaaactgctcttgtcaaggttgactaatgtcctgcgtcatgggtttgttgtgaggatgaagtgagttatatgtaatgcacttcataagtagccaataaaggtgaccaattcatattgtattactagcaccgctagtactagtaccacggaaagatattggaggatgtgctcctcttcccccactttggggggctttcacttccaacagcggcagctcctgtttgggagattgctattggcctactagagaccattttgcttgcatgttagagagctgaaagtgtctgggaatggcataccccactccttaatcatgggaggggatggacaatgtacagcctctgaagcaggaacacgcctggaatgttccaagagcagtgagcttggctgcagcccagggagtaaggaatggagcaaatgaggtcagagtggtgatgtgagtagaggccttactttagcctttggcttttcgtctgagtaagggaggaagacaccagagggttctgagaacagaactgacatgatttgatgtgaattgtaacaggatcactctggcagctgcctgcaagctgtaggggccagggcagaagcagggagaccaggtgaggggctagtgcagtgatacaggtgagatgcgtggagaggggtatattctaaaggtagaaccggtaagattttctgatggattggttattctatgcaagagaaagaaaggagtcgagaattccagtgtcttggcctgagcagctggaaggatagagttgccatgtactgagatgtgaaagccccaactacccccatgggctccattctgggaagatgtcttgtgaacagtctgcatttaattgttttgaaaatttgcttttggagttatagacttttcatttcactccgacttgtaaatgggatgaagggaatggcactcaaataatcacagcacatgagagtgcggagattgccaaaatataagcgtagactggggtggaggggcttatgtgtgtggtttgcttattcataccataatttattcaaccttttgatagatatttagtttctttctgatttttagttattatgaagaatgacattaagatacattgcacatgtttgaacatttttgccaggcttatatacaaagatgtctcatttaaaattagatatggatatatagtttggggccatttctgtttctttttctgtgaaatactgattcatatattttgcccatgtttttctattaattaggtcattcatatttatcttaacgtctcatagaagctctttttgtgctttgtttattacatacacatttatgtgtaattcaacatagaagattaaaagaaaacataggaaaatattttgataatcttggagtggagaaggcttccagatcgcataataggaggttagcccccacttcagtcagactggatgtgctcaaagcatgctgggaagccttggctggggtggctccagatctgctgtctctgtagctaagggcaagcgttagagtggaaacagcgatcaaagtcagtttccttcccttgcaaagcagcccctctgtttacttgtctgtctccctccctgagcgccttgctcagcgctgtctccccagggcctgcagtgtgctacatcaaagtcggggttccttcccttgtgggttgtgcccagtgcctgaaaacacagtgtcttcctgccaagtagagccttgtaagaacgtcccactgacctgcaaagtgtgtgggcgaaaaccttcccatcctccctcttaggccctggacttccctctgttacaacattagcattctgcacagtgattatttgtttgacttactcatatttgtagcctttcactggagaatttctatccaagtaattcagcctattttgccttctttgcacataagaacgtcaccatgctctagaccaagctaaagctttggctattacttactaaaaggcaacagcagcaaagtgacagctaggcccccaaaggggaatggctgcttttctgtcccctccttttctttagttatttcaccactaagtcatgacttcctgttagaggcttccagttctggcagtatttggttcctatttcacaagaagccagtctgttacattgtggcttttagtgctaacaagaaatcagtggtttagggtctttggccaggagaacagtgtaattagaagttaaactgaggtttaaacagtaatttaaccccacccaaattttcacaccaaatgagaattctaacatcaccttgccaaaaaaaaggtacactcttcaaagtgttagcccctaaaatgttagactgatcaacattgtaagtaaatataagagatgaaagttattgtcagataattacctccaggacagataactgactcggaaagtctttagatttgagatctcttgagctatgacccttataccaaattaggtaaagagcttacggtacaaaaaagaaaattgtagatcaatctcacttaacgcagatatgagagacaaattctagatatatgttgtatttaaatgtaaagaaaacgaaataatataatttctagaagggacaatgttattgaatctcaatctgatcgtggggttgggaaaacctttctaaacatgatagcagaggaaaaaccataaaggaggagagaaggatttttgctacatgaaaataaaacatatctctttgctcatttatttattcagtcggttctccaacaaataatctagtgagtgtctcctatatgctgaacactattttaggtacttcaaaaacaataccaacttataaggcaaatgacaaaatgcgaaagtttttcacatcatacgaggcaagcaaagagttcatattcttcacttttatgagtaatcctgatcaatgattagaaaaagatcagcatcacaattggaaaatgggcaacatacatgaacagcagttcacagacagttcacagcagttcacaaagggacgtgacacataaaaaatagcatacattgaattgcaaatgagactggttggtgttgttgtatctgagtgtgcatattgacatattctggaccagtgctcactgattcattcagcaaacattttctgaaccctaacttgcacatgtattcttgggaggaaagaaagggcatttgggtcaacagtgaagaggccaagagtttgtctggaactgtaagcaataaagagttcttccttctagcagatgtgctttgagccaagcaagtaatgaaaccaagttgaaattgagagtgttcttttcctctccaagtacctggggataagtcagcaggcagatgccctctggggtcttaacttctcccacgctgagacaggagcttaagtaaacactggtgccctgtggtctctgatggagcagcttctattgactcaaggttatgtgctggccgggggctcggaggtggttttggcaacttcctccagccagaggagtacttagaactgatgaaccaccctgaaaaaattcatttggggctgtagctgactgctgggtttcccactgaccctggggtgctgggaccctttctagaacggctcactccttcccctgtcatctcttttcttccctctcacccttagactcacacacaacacttaggtgtttcaagcatttctactttttaggaattcatatatggttagaaagccttcccagctgccagtattacgtaagtgtccacctctattttttcagtactgtcagtttctttatttcaatgtaaatgtttaatccaggaagaatttatttttattatatgtggaatgagatagagattcattaattaattcaacaagatttactgagtccctgttaggcaccaggcactgttgggacatttgagaaagactttcttcagtattaaacgtcagattatattatgtccgataacaccagatacaaggttttctgaatgctttccaaattcatgtattttaggaaaaaaaataggaggacctcttgctagactatgagctcatttttacaaaatgatgttgtatttttctcctctcctagaccttttaacctgaatacacactcttccacaatcccagtcattcagctcatgcttttcttcatgtggaatgaggttcctctttgactcctcacccactgctcactcttctgatgtgctaagctctttgacctacatagctctagtcagcggatgacagcttctcgacatcacacatagtctgtgattaggaaccagaccgaagcagacgatctgatttcatggccacctctgctacatattcgctcttgcccgaccgcaacttgctcaacctctgtgtgcctcagtttctgcatatgtatagaatgccctaaaaagagtattcactcacatggggtctgtgtgagcgtcaaatgatttaatttaatttaaagcatttagaataattcctgggatatacgtgttagctattaatattgctattgcatattttgagggatctgtgttacttcatgtttgtctgtgactctggtactgatatcttctcattgttaatggactcctttagagacaatcccaggagccaccacacctgtgcactcagcttgggcaatggggaatgtccctagcggacacccatgggtgtgagggtaacatttttcattacttttcttgtgggaaaagatgcataacataatattgaccattttaatcacgcgtaaggggacagttcagtggcattaactactgtaccttcataatgttgtgtaaccatcaccactaattatacctaacactttggagttattcttaatgttttgcaagtacctctgcttagaagagcctcccctcaaccacattggtctcacacaactggtgagttcagctgcgccgtcacttcctctatattgcaccttccttgattctccatccagacttgattacctccactgcacctcagacacttaatgtatcacagaacttaccagagtttaaaataactttattcctgagttggttttggcccatggtttcaacccgtaattttgcatcctgatcctgacctaacatattagtgaccctcccaggtttgtaaacacttgcagatttgattagctggtcttaatgacctcaaagattctgccacacaagaaataatgagaaactggccaggatattcagtggcactttggttgacaatacatgaggaaggtcaagtccatgtcatgtatgtacttgaacacagacctcttggtgtacttatctttgctgaacatttctcctcaggattctcccttccaaggcccaccatactgtagagatacaggacttttctgcttctgttgacaagctatagaagcagatcctgtgggccaggccatcttcaggacaatcacaggaagttattccacgccttggacaagtcccaactctatctggcagggagcagaaggttacaggccatcaggctgaaaggtcaccggcaatcccagggctagtggcattgagccaggatagagaggagaagtgtgtaacctgctcctggaaactcccaacctttgtggccccccttggcaaggaagtagaaggtggagggaaagggccctcttgagtaaagctcagcagaaaatagaaaattaaccagatttctgtttctttaatgatgcttaccttttgcaacacataaacaacccccagcctcgtgagtgcgttcaaggtgtagctactgggcagagaacgggagatcagcttagaggagcaggtcttgggaggttaccaaaaatctctaagttgttaccaaatgctttatttcatttcatgttctgggaccacatccaaaattcctaggggccttgcaagtggcagtcagtaattgagttgttaggttttctaaacagtaactagaatctactaagtatatgtcaatagcaacacaagaacaagaaaaacacggtaggggaaagttgtccatagtcagaggaacaggggtgaggaagggtgtcaaaggaaatgaaaagtcagtaaatcagacaagagcaattcttattcctctttccttcttttcctctgtgtcttctggactccaaagaatgtttgcacatgaagggacagaaatatccaactttgcaatacagagctaaatcagaggaaataactttgacagttccatgtgatagaacagtgcccaaagtgctctagcacatgactgtttccctgcagatacccccacagcaaactgcagagcgtggcaggagcaaccagcttgaaaacttgcctggtaaagttctaagctatcttgaagggtcatcaaccaacttgaacgggcacataccctctccttactgtggctctgttttctctcttctttaatttcaaataatttgaaacaatgttgttgaacactgaatgggggagccatgggttcagattcactgttactcagtgagaaagccacttcatctgtctgagtaccagtttctttttctggaaagttagggtagtagctgccctgaccactgcacgagattaggaatgtcaattgataaaaacttgtaggagaaagaaatgtcatcagtgaaagctcatttgcccttgttccatgaggccctgatagcatgttacacaatagtattatctgctaattgcaaaccagaaccctgtgattcagtctgaatcctttcctctccctggtggcccacatgcatttggtgacccagtcctgttaattctccttgcaacttgtctgctactgccacatctctagcttcatcttccgtcactccaaacctctggcagttacgaactcatccaggtggcactcattaacagcatttggcccagttcttggttcattgcaccgagcatcataggagcagggcctgggtcatattcttcgctgtttcccttgcaaccaaccgggcttggttcacagtaggcattggataaatgtcttttcacaagagcattgagtccatttacatttaaagtaatcatgggtgcctttggattaaagtcaagcatcttattgtgctttttatttgccctatcttttctaggtttctttttctgcacttttaaaatttcctttggattgagtgtctttttgtaaacttactattttgaaatcactagattcacaggaagttgtaaagaaatgtccaggaaaccagtgcaccttttccccccagttccctcagtgtcgccatctagcataattctagttcggtctcacaacagcaaatgacattgataccctctaagagcagctgtagatgtcaccccttacacgtgcatgtgtgtgcatgtgtagctctgtgtgatttcatcacctgtgtagagtcatgtacccaccactgaaaccaatactgaactgttccatcacaaagatcccctgtgttgcccctttatagccatactttagtcagtcatgctgtccacaacaacacattgagtacgtattgtatgccaagactgttaaagatgttggaggtactttagggaccaagatgggcaacgtccttgccttcacagagcatacagtttaggtcagcacaggctaagatcccagggaaagttggagccagttgctgtttactgggtgtggcttggtttccaggatttctgtgttctatctgtaactccaactgctccccaagctagttccatctccaacgtctcatcaatttacattcaacttgaaagcctttcacagttggttcaggtaggatcttagcaacatttttttttctccttgttgtcttttaatctgaggcatctcctatacctggtcaataaggccactgaaaaagcagcgcagaaggagaccaacacctgtaagcaatcagaacaatcagaatctgagcaccaaaatcctggcgctctaggcgctcttggccaggacagtatgaagcacgtccatgggtcaggaggggaagaggcccacacaattccttttggcagattcagtcaaaaagtgtcattgctgaaatgacagcagtattgaaggatcaaaacgtagagctccaaatgcagataggtataggttctcctccctcagcctgagttggaaagcctggctctgaaggcaggttgctgacccctcctgtgcacatgtgaaggaaatgatttcacagctttgggatttcaccaccgcagagggggcagagggccaattctgctgaaacaaagggacaataatcactctcaccagaaaagtagtttaaatcagaggtgtctctttacagcctcagagattttcaggatgtttctcagttcatttctgtgtcttttgacaatggatacaatccaggcgggccacttcaattttattggagtgaattctggagccaaagaagtgaaacttgctataacccagccaggtttattttactgtgcaagtagaattgagtgcaggaggaacgtgtccaaacttctaagccttgttcgttgttcagtttaatcctgaacaacatgctgcaatatctggatagagtatttgctggttttgagttaaaactctggtatgatgccttgcctgacagcctaagttccagcttggagactgtgtctatctggttcactgttacatctccagctcctagcacataaatatgtgatgagtacattctggtgattaggtttgctataaactacaatactagtcttgttcctcaagagtagtgttttaaacctaggtctatgatatcatgaaatcacatgtacaattcattcattcaacaagtatttactgagcaactatcctgtgccaggcactactaggcccagaggataaaacagtgatcaagacagacaaagtctctactgtccgggagctcacattctagtgctggaggcagagaatgactgtggctggccacttcaatatggatgatcagagagggtctctctgagagatgacaattaagttcaggtgtcaataacaggaagcagagatctgcatggcagccatgcaaggatctgtgtgacagagtattccatggagaaggaacaagtaaggcaaagcccccaagatggagaggagattctacatgttcaggaacagcaaaaagaccagtgtggaagagcaagagagtggctgagatgtgaagtgggagagacaggcagagccagttcatgtgggacgttctaggctatgtgaaagagtttgggttttgttattaatttattgggaagcctttggagggtgctaaccaagggaacaacatgatctgatttatgattttaaaatgttattgacttctttgttaagaatgaatttatggggggagttgagagtggatgtgggaagacaagaggctatttcaattactcaggtgaaagacaatggtgacttggactagggtggttgtggggcaggggtggtgcatggagagaagtggattgatttggaatgttttgaaagtagagtcaacagaactcactagtggtttggatatggagagtggaagcaaagatcactccaaagtttttgtatttacagaatggaaggatggcgataccattgggaggtactgagaggctgggagaggagagggttaagtggccatgaaataaaagctgcattttggccctgttaagtttgacagacctcttagatatgtaagtggagatgtcagttagatggttggctatatgggtctgaagttcatgggaaagatccagattggaaacataattttgtaaaccatcatcaaatagatggtagttaagggaaatgagactggatgaagcctcttttattttcatctgtggccgcttacttttatgcatcgtgatctgcacctctgcaccaagtcaggcctggtgaattaggatctctggaggtgaggtccaggaatgtgcatttttaacagctctctgggtgattctggttattcctctcttcccaggcttttctatctgtgcttcaggtttgatgatcacttcttcagagtctgagatgttattatgcccatctagtgtattttttttgtttcagatattgtattttttacctacacatgttccatttttttcttgtctgtaacttccatttctctcattatgttcgtattttcctttaaatctcaaatgttataatagctgtttcaaagttgtctgcttattctatcatctctgttatttctaggtttctttctattgactgatttttcctttggttatgagtcatatttttatgcttctttgcatatttagtaatttcttgggtgttttcattgtaaatattatattgttgagtgtctgcttttgtctttccttagagtgttgaatttttgttttggccagcaattcattaccttgctgatgaacttgatcattccaagccttctttttaagctttcttagggcaagtctagagcagcctgtactctagggctagtttggccttactcctgcttctaagatgtggcctctctttgagtctctactgaatgttccaggtctctccattatggctgatcagcactcaaacatctcccagccctgtgtgagctctggcagttgtttagattgggggtcttcagtagttgttttaggatgcacctcatagggtttcactctacacacatgaatgttagtattcagccaaagtctcatggggaaacacctatgtagatttgtagagctctttctctacataactgtgttctctgtggtcctttgtcctgcaaattctagccacctcaaccacccagaattccgatctctgctttctcaactctgtgagatagccatggttgagaaagtgcttacaggatgaaagccagggtgatcagggactcacctcttttgctttcctttttatagaggccatagctctgcactgactgccatctaatgtctatttcatgtatttatttggtctagttttctaattggttttatgggtaggaggcaagttcagtgtccagtacactaatgtggctggaagtggaagtccttccaggtgattcagatgcataataaaggttgcagagtgtattagtttcccagggctgctgtaacaaagtaccacagactgggtggcttagacaagagaggtcattatagtctcacagttctggaggctggacatctgaaattgagctgtcagcagatttggttccttctcaaggctgtgagggaaggatgtgttccaggcttctctccttgacttgtagatggccatcttctctctgtgtcttttcacgatgtcttccttctatgcatctctgtgttccaatttcccctttttatgaagacaccagtcatatttgattatgaccccactttaacttgctaaagactatttccatataagtttatattcggggatactgggggcttaggagtttaacatatgaatttgggggggcggtgacacctgccattgcataggacccacttcagccttgcaggtactcgcacctttgttcactccattaagaaacaaacttggagatgtttgttaactatgtaatcagcaagttggattgttttaagatgagaacaatgtgtagcttttactctcagaagaatgggattaaactgttctctaacaattttttaaaaactaacaagcctgtgacctaaacacaccttcctggaggagactagaaattagcacaaacacctttccacaaggttacaggatattgcagggttttgttgttagagatgatactggtcggtggtaatgagtcagcttggttgctgtggcaggaaaggctgatgggaagtggatctttcgatggtcagagctggaaaagccctcagagctcatcattgtatagtatggagacatgggctccagaaggggagaagcagtttccccaaggcaagtgatgccatgagccctgggggccaacagtcacattgtcattttatttttatttatttatttatttatttatttatttatttatttatttaagatgaagtctcactctgttgcccaggctggagtgcagtggcccaatctcggctaactgcaacctccacatactgggttcaagcaattctgcctcagcctcctgagtagttgggattacaggtgcgtgccatcacacctggctaatttttgtatttttagtagagacggggtttcaccatgttggtcaggctggtctcgaattccagacttcaagtgatccacccgtctcggtctcccaaactgctgggataacaggcgtgagccaccgcacccagcccacattgtcgttttataagttacttttacattgataatgttttgccattgtttctcattggttcactacaatcataccataagggtgacaggccagggtttactatttacatttacagatgacaggactgaggtttgcagaagttgagttactcaagtactgtgtgctcaaagtcacacagaaagtagaatcggaattcaaattcaggtctcctgactttcaattcagtgcctccccctgcccatttttgtactccatttctctaagttactgttatggatacttgtttgcatagtgattccgctttctatatcctcttgacccaggctcatcttcacagtctatcgtgaactcttgacctcacccttttccatcttggcttcccaagctgctcatgacctacccagcagagaaggcctgaggggagaaggtgaagtccagtgcagctacttgaagccagcaagcctgcaattttatgtttccataaaatgcaaacatctcagtaagaagagagggcagccctcaggtcctaacatccccacaccctctattctgaagtgttcaccatcatcttttgtactctttacttcctgacccatctctgaacttcttaggttcagacccctctacttatctcttatttatactctgactccctctcctcacatctggtagttgatgctggacattgagcataaacctctgctttccttcctcatcctgtgagcttacgaactccctgataaacatagcaccctttttctttacatgcacagtgtctggcacatagtggacactcggtaaatattgattgaatgaatccacaaatgtgccctgtacagaggaattgttttaagattttttttgtcataaaagaaaacacaaggccgggcacggtggttcacgcctgtaatcccagcactttgggaggctgaggcaggcaggtcacctgaggtcaggagttcgagaccagcctgaccaacatggcgaaaccccatttctactaaagatacaaaaaattagccgggcatggtggtgcatgcctgtaatcccagctacttgggaggctgaggcaggagaatcgcttgaaactgggaggtggaggttgcagtgagccaagatcacaccactgccctccagcctgggcgacaagagcaaaaaactctgtcaaaaaaaaagaaagaaaagaaaacacaaatattgcaaaccacataaaacaaatgtattgacaaatagaactttgccacccacaacagaagtccctccatgtgtccttctcgatcataacctccttcttctccccataaataactaccatcctgacatgtatagaaatatcttctttgcatttttaatgtttttatcactcaaatgagtatctgctaggcacacttaaacattttgatgtgtcttttaagtatcatttaatccatagatatctcctctgtccctttttcttttctttttaaaagtaaattttattgtatataatttggagtttacaacatgaccttataggataccaatggatagtaaatggttactatagtgaaggaaattaacatacaatctcacatgtttactttgtgtgtgtcaatagcagcaaaaatctacttatttcacagaaatccctaaggcaatacaattgcattagatgctggttggatctttagctgcagtcctcatgctgtacattggatctctcgacttgctcctcttacatatttgctactttgtatcctttgacctacatcttcccatttcctcccatcttgtccctggtaaccagttttttttttatatatttataaatataccacagtacatttgaccttttccccccacgtacaaaacagatcattcagtatttgtctttctgtgtctggcctgtttcacttaacataatgtcctctagatccatctatctttttgcaaatggcaggatctccttcctttttaaggatgaataatatttcatagtgtgatgcgatgcacatgccacaatatctttatccacttatctgtcaacagacacctaggttgtttccatatcttggccattgtaaattaatgctgcactgatcatgggagtgcagatatctttatgagagggtgatttcacttcctttgggtctatactcagaagagggtctgctgggtcagggtctgctgggtcatgtggtaggtctaatttcaacttccttaggaacctccatagtgttttccataagggttgtatgaatctacattcccaccaacagtatactagggtttccttttctccacaccctcaccaacacttgttatcgcttgtctttttgataattgccattctgatgaatatgaagtgatatctcattgtggttttcatttgcatttccttggtgattagtgatatcgagcatcttttcatatacctgttgctatacttgaatgtgtcctccaaagttcatgtgttggaaacttaatccctaatgcaacagtgttgggaggtgggacctttaagagatggttaggtcatgaagtcagccctcatgaatgggtttctgtcagtgtcaagggagtgggtttgttatcaagagagtgggtttgttctaaaagtaagttcagctctctcttgctcttgcgtgcactcgcttgcccttctgccttctgctatggggtgacacagcaagcagatcctcaccagatgctgagcagatgctggtgctatgcctttggacttgccagtctccagaaccatgagcaaaataaactaatattgttataaattatccaatctcagatattctgttatggcaaaagaaaatggactaagatacctgctagacatttttatgtcttcattggagaaatgtctgttcagatccttcacccattttttgtttctttttccgcaattgacttgtaagagttctttgtaaattttgaatattaaccccttaatgtagtttgcaaacattttttcccagtacataggttgccttttcattttattgattgcttcctttcctgtgcttttctttttcttataacctatccattgaagaacctgggcttttgacctgtagagttttctacaggctggcttctgctgattgcaccctcatatcaggctatcagaggcacaaaatgtctgattgtttcttttcccaagttagcagctgttgatgcttaatggctatacctattaattcactggggctagcaaatagggatattctaattctgtcatttgtttttccattactgatcagaatacattcataaagagacattcccttcatctacccaagtgggacagttcacgtagaggaaaggttggataatgcttgattcttcccttttacttaagtagttttcaaggaaatgaagtagttcccttacatcctctgaagatgacaaattcttttgctttttttttttttttttttttttgagacggagtctcgctctgtcgcccaggctggagtgcagtggcgcgatctcggctcactgcaggctccgccccccggggttcacgccattctcctgcctcagcctcccgagtagctgggactacaggcgcccactacctcgcccggctaattttttgtatttttattagagacggggtttcactgtgttagccaggatggtctcgatctcctgacgacaaattatttttctaatatcataatgaactcatggatttaagtgtatttgatggatttcaagctactataattattacacaatcatgcatcattcaatgacgggcatatgttctgagaaatgtgtcattaggtgatttagtcactttgcaaacatcacagggtgtacttacacaaacctagcttactacacacctaggctatatgttatagcctgttgcttctgggctacaaacctgtacagtatggtactatattgaatactgtaggcaattgtaacacaatggtaggtatttgtgtatctaaacatagaaaaggtacaataaaaatatggtattaaatcttttgggattcagatgtctcggaggattgaaaaaaaatcttataggaccaccattgtatatttggttcattgttactattatgtcatgcagcatatgactatttatgaaagcaaaaattctttcatatatggccagtggtagcctcttcaggttagcccctaagtccttttgacatggccctcgtcattccttgtggcattgtttcactgtaaaaagcttcactttagtgctggcagactgactgctttcaggggctttgtcacatgtcttccattttccagaagcctgtaagcctggtggaacagaactatatgtggcctctggttttacctacttagcaaagagctccaagaacacctcacttctgtttttgcataatcaaaactcttatgtagagatttaaaaacctaagggatgacacactggcgattttgcatgattcagcatcaagactatgctacgtcctatttaagttactgtgtgactgttctttttcctttccaccctcatgcctgccttccagccctgctgaactacttacgcaaagttttgagcctttccaccttaatgcctttgtgcacgctgcttcctcctgccccactttagccttagcttagtcaccacttcttcctggaagcctccccagacaactgatctgagagagatgtctcttttgtttgttcccatagcatcttggttttgccttatcgtagcacttatctcactgattgcaatcgtctgtttatccatctgctcactcccttgttgcccatgagactgtgagtggcagggcatgtggcttgctcacttcatcttccccagtatctgcacagtgtccagcatattagtgggctatcaacaggtaattgttgaatgaatggataaagcccaaacttcttcatgtcactcttcccattgcactcccaccactcctggttcattcttctgctagaccgctcactacgctgagttgaaatctacccatatcataattctacccttctccctatcccagctagagagtgaggtcttttagggaccagctctaatccccttttctagcttcattgtctagcaggatgcacagtgcagagtaggcactcaaataaactcttggtgttacttctcttccaatattgttattaaaagataagaaatctattgtctccataacactaagagcggttaatgtgaaacttgtttctgtgcttagtttgacttcctcttttagaatcatttttgggaagtgcaacaaagttcctctttacatttcccccaccaaagtggcttttggaaagtttggagcaccccatgctccctccccatgaaagctttcctcagcaggcacaaatggcattctctcatcccctgagccccttccctggactaggccttatgttcctgtttgcctcagttgatgccagaagcccaggtttcccactttcaaaccccacagcaaaacttgagctccttctcttatgtttagtggctctactcccatccagtgccacgtttttgcaacaggaatttactgaatcaatttttctctccctcttgggtcacccccacgagcatacaaacatgctgttatttttcctgtcttaaaaacatggacttaatcacaccacgttgtttgtctcctgagatggtctccttgtttgactcatggccagacctcttttcaaagctttatactgtctgtaaaggcaggagcaaaccagggttcacctgccccaacctgacatggagtgactgccttccttctgcttgctgccccttgcctcagtcctggaagggctttttattctaaggcataattggaggtcagtgcttctttggattctctgccatctcagattcatgttctctgagcagggagggagctgagaatactccaaatagtgtcttttcctttttccctggcctcttggtcaaagctggtgggcttaaaaagtatcacacataaatgaagctagagatacaaaagacttcctgtcccaggggtcgctgtacctcctggcagaaccccacacttcctgctgtcacacatgctaccgcatgggagagaaaaaccacagagctataaatctccctgcggtcagccgtcatccttctctgtgctcaattcccaactggggctaatgccatagttccctaccgcagaaagtaaggatacgctatccatgcaggctggcctatctggcccttcgatgaacaaagggcacctaaatgtaagacaaggaactcaaacatttccttccccctggctccatgagagggcagggaggtttacagatccaggggactccctagggctttggtcaattgtaaatacctctttccccaggccagagatctgcaccctttctttgtactgagccaagatggtactgtctacatcaaaaattctaagtcaatggtgagtgggaagccaaggagccctaggtcattctcagttgttctcagggcacaaaaagagacctgtcaaatcttggcactggtttctgtggaatatcattctcttttcttttctgagcatggactgagctttacctgttcatctgacttccaggcttggctctttccaagattcctattccattaaggaaaattcctttttgtttttacagtgtttcaaaacaggggcactgatagctttaggccaatcctgccatgccccaccccccactccatctccagcctttataacaagcaaaacccacatattttcagatgctcccgagaggaattataccatccctggttgaaaaacactgtgacttagggggtgaatgcttaagagtctcccatctttaaaaaatcccttgaccccagagctttccccctttacagtcagatgtttctggagagctggctacacttcctctctctctttattttttaacttcacatccattaccgatccttccatcccaacctgagttcaaattcattcctacagttgtttagctatgtgaccttgagcacattacttaatctctctgaacctcaattttatcagacataagatggagatagtaatagttacccctcccatagtatagttttagggattaaatgggttacagtaaagcgcttagacaagggtctcttacataggaagtgtaactagccaagctagttaattctctgagaattctattagtgttttaatcatcattgggggttttatggaagacaatttgtcaccttcagacactggcaatcttctctcctcctctccaatgtgtatgattttccttcttggccagttgtgtagaacttaaatagcaatgttggaagatactggggcagtggtgagcatttgtgattttcatctgattttaatgtatgatattggctcttgaactgagatacataatagtaagaaagcttccttctagttctttattgctaagattcttttaaagcttcagcatatgttaaatttgtactacattcctttgctgcatcaatttcaatgattgtataattctggcccttcaaactgtgggtgtgaatcccattactagactctccaatcctgacccgtccttaaaatcatccaataaagcggacttgaagatgggcactagtcctgtaatacaaagcgtttcatcattagaatggctgatttgtttccttcctgctgtccttgtcatgacatgggttcttggcatagcctgagaaacaagagaaattggtccagtaactccttattgaattgcctttctgcaggcctggcgcaagcgctggtttgtcctccggcgaggccgcatgagcggcaaccccgatgtcttggagtactacaggaacaagcactccagcaagcccatccgggtgatagacctcagcgagtgtgcagtgtggaagcatgtgggccccagctttgttcggaaggaatttcagaataatttcgtgttcattgtcaagactacttcccgtacattctacctggtggccaaaactgagcaagaaatgcaggtgtgggtgcacagcatcagtcaggtctgcaaccttggccacctggaggatggtgcaggtaagagcggagttggggctcccatgtgctaaggggtatcccaggactggagggttactgcagaaaaacagttcaagatgccaagcctgcctccttgagggtgttttggcaggctaatttatatcagaactgttcctaccaaatacaatactggaaattgccctcttttacccagtccaaatgtgggaaggcagagtccatgagcacactgagcattgcaggttactttaatggctttaaaaccccttcatgtctttgctctcattcagccacagtgaaagtcaaatgtggatgaggatgtcttcccatgatgctgacactcatgaccttctagaaatatcaaatattgccatacttcaaaatattgtggaactccagcatttctggtgcctattgggttgttcatcactaaatggtagaaagagagaacttggctacttatcgtaggcaagaaagatttcctgatacctccaaatgtctcaagttctctgcagaggaaattagttgtaagtttgctctgggccatttctgggcagtgggagcaattgacccatgaagagtaccccagagtctctctctctctctctctctctctctgccacacgcacacacgcacacacgcacacacacacaactcatcctatgtaattttccaggtatattgtaacctagggttacaattaacttcccttcatggattttgttgttgagcccctgacattattgcaacatgtcctattcctcaaaatatgagattttgaatctggtttcttttagcctcttagtctagtagacaaaactttgcccctaaatcctgtaatctatagttgcttcaacattttaagagttactgcatggtttccaccatctgccactgaaatatccacactctaacgctaggtggcaatggagagtcagaattgaatctccctccaggacaggcacaagagtgtgctttctgagaacacattccttttcgtttcatgaaccagggaagcatattaagtgaggctattcaataatattgctgagcattgggagcactcaaataaaaggaaatgaagtgatggcaagttctttatccttggtacaatggacaaaacttaattggaaaagcagcattaagtaggttctggctagagtctgacattatgcaaatcaagcagaacctccctgaccaactaacttctccagccttgctgctggctctttaccaccctgttgtgcaccttcagccttaactaggtatatcgtcgtatactgtgttatatatctcctctgtttctttccttatccaggagttatcctaaaacatacatatataatatgtttcccaataacccaagagcaccaggaatgagtaaggcaccaggccgaaactggagagcctgtcccggcatgaagttggaggaagccagaaaactcacctatgaccctttccattctctgtagccccccgcctcagtttttagaaccacataagagcagggtcctcttcatctgagaattacacccaaagggctttcttgtgacttttcacagagtgtttggttctgtctccagcaaccatatagtagtcaacacattgtgtgtgtaccctggccaggatctctgttgaaatgcttttgtatattaacttgtctcatccccacagcagttctatggcctatgtgtgattactatctccactttatagaaaaggaaacttggagaaggcaggccatgtagtaatggctatgtagtagagcctggacttgaacctagttagttctgggtcatcctgactcaggaatcctggactattaacttggttcaaaagggaaataaaagcaggcttttcattggctgtttctgatctggagttctcattgattcctgattcaaattcatcttaaggaccatgttctcaggtgatggggagaatgttatgctccttgagaaaaagaaatggacttttccagccaccacagcactgtgtttctttccttccctttacttataacagtgatgaacaggactctttatttatgtgttatttgtctgtcttctctgctagaatctaaacttcaataagggcaggatctttgtcttggctgtattgagggttagtggcattctgggcacatggtagatgtaataggtattctatatagacatatacctatataataaacatgtataggtatacatacatatatgcacaagtacatatataactatatgcatgtacttgttatgcatatatatatatatatatatatatatatatatatatatatatatgtttgttagttgagtgaaaaaacaatgaggcaaggctgctgctgagggccataaagaagctgtgcgtagattaactgcagatttttgggccaagaatgctgggttttttactcttaattgattcaacactttgctcttgaaacattggccttctttcccagacattgtttatagcttggggaaatggtcttctccatcagtacaaacaccagctgtgatttgcatcttctgtttggcttctttgatgctgttggagaaattttgagtgcgtgttatagccattcttaaacattaacctgggaaatgatttctccagcagattccatggagagcctctcttacacgccctcctccctgcagccatcctctgccagctcccttcttaccgcccatgctgccagctcctctttgccaagagatgacccaaacactaatgccgtagccactgaggaaaccagaagtgagtcagagcttctcttccttccagattatctggttttgtccaactgcgagactggaagactgcaccataccaggtatgcttatgcccaggactctgtctgagctgggcctgctagcatgctctctagagtcacactgcctcctcttgcagtccgtagctgagatgtgttcagtgtgcttcaccaaattagtccatttagtggtagcattttctagtgggtgtgtctgctgtcacctctcttcctgccaatgtcaaggcaggaacagattgctatgaaccactgtgaaagatgaagcatgtagtatactaaacagaatgagtcatgcttttcagcattgtggttttcacttctagccttgcattttcatgtgtatctgatgcttagaggatgaaaaaatcaacaaaccatttttcttttgccacaccaaggggttggtgtaactgagtgttgtagagggaatgtggctatgcaagtagcaagcaaggtggtactggggagatgggaatgaggccagcgttggttttgtggtgggtggatggctgcattttagtccaacttacatgcttttcttccccagtctacccaccagatgtgatagctggtcaaactcagaccgttcattggaacaggcttcatttgatgatgtttttgttgactgcctgcagccgctcccctccagtcatttggtccacccctcatgccatggcagtggagctcaggaggtgccatcctcgaggcctcaggctgccctgatctggagtagagaaatcaatgggccacccagggaccacttgtcttcttcaccattgctggaaagttccttaagttccaccattcaggtagataaaaatcaaggttccttaccctgtggagcaaaagaactagacattatgtccaacactccacctccccgcccccctaagccaagccatctgtctgaacggcgccaagaggagtggagtacacacagtggtagcaagaagccagaatgcactctggttccaagaagaatctccctctctggtttagacaacatgagaacctggaaaggtaagtgttgggtcctaagattcaggcgccaagaaaacccgggctcctcttcactctttgtgcccatgtgaggtcatgccaatggaccaaaacgatggggctgggttagaattaccttgatgtgtgcagcttggtaaaaagccacatcagtagtgtgtacttgtgtacatatgtgcttgtcccttgttcaggctggcctgatcttctaatggggctggatccttggtggaagcatataccctgaaagcagcactcttctgttcctggatccccccaacccctcctttgagcctgaccaccaggagagacatttaggtccccatagatgctgcaataggttggaaccctggtcccttgtgatgggcttgcccatgcaagtccttgcccatgtggtaagcttcccacctgagtctgagctcctagtgttttttggagtcactcagggacccacttggtacaaaagttgatgtcttttgtcttaactcagtcccattcccttctttgcctctctctcacatacatagagagtcctgagaccacagaccatcactgccttctattttttagcaatcccatcaacctcattcatcatcccactagacttgttctttccaaattctaagtggctgtacaaagggccctcccacagccctcttttgcccttttctataaggccatttatcctcacgaggttatcttgcaattctgcttgcagttccatcttcctccacctgtttctttccacctgggcctctctggccttcagaagctgtttggtgaaagccaattcaagcccattcattgtggtttttcagtaacctcttctttactgctttgctgagccacctcatctttctgccatgagccaaccaaccttagcattttgctcttctttcttacatcagtctgtatctctcagatacacagacagacacaaaaactagttgtctatctctgtgtctttctccttttttctttcttctctctctttctttctctctccattgaaatataatcacccacacatcactacttatttaggccatgttttcaaggaattatggaaagtggaaggagtgcaaatttattttcaaattgtacgaatctctcattctgactgagaattaagtcactagtaaaaaccttccctaatgtccctaatgatgttaccattatgtatgttgcttccttttgacagtccttatgaaatagatgtatactgattacacaaatgatctggatatgctaacatgtgtgaacagttgacaaaaagggaaaaatgaaagtggttaagcagattttaggaagtgaaatgaataaaaccagtagaataataacatatgaaaatgaattaaaagtcttaaattgaagaacaaaaacttgaaataatttgaaatttcaacacaaacataaaacaattaggttgtgttcttttacatgaaggcaaacaaagattaaaactaagtaaaatagaggttttgaccatgaaacaaagaccaaacaacagtggtgcctagaagcaaaatggctctgataaagctgagggaatgcataaagtttattgttctgcctttcccactgagatttgcctggaatctgtgttggtacgtggtggcagagtgaggtcaaggttcgtttttgtccatctggatctccatccgatgaccctgcaaggctgtcctgtccccatggctctccagcgccccctctgccatagatgaagtgcccatgtatgtgagggtctgagtttcctttctgctttctatcccttggagcctacttgtccagcttgcaccagtgccacactctcttaattactgtaccattctgtcttaatatccagtaggacaagtcctcctgcctttgggaatataatggctattctagggtcaattttacagtcagctggtcaggttctagacacacatatataaatatattggggatttgaggaggattgcatccgatctgtagatcggtttgtgaagatttgactacaatgttgaattttccaatccatgaataggaaatatgcttccatttctgtaggtcttatttttgtattttaaaatatttaattgacaaataaagattgcacatattcaaggtgtgaatgcatatgcatcagaacatgatgatttgatatgcatatgcattatgtactgattattacaatcaaactaattaacacatccatggccacccatgctgtacattggatcccccagacttgttcacttatcactgaaagtttgtaccttttgaccaacatattctcatttacctgcattccccagtccctgacaaccaccattttactattgccatgagtttgacttttttagattccacatataagtgaaatcgtgcagtatttttttttctgtgcccagctcatttcactgaacataatctcatcctggtttacccatgttgtcacaaatgacaggataccattcctttttaaggctgagtaatattccattctgaatatataccacattttttatatccattatatcctttatccattcatccagtgatggacacaaattgactacatgttgtattagtccattctcagtatgagaatggactaaagaactatttgaggctgggtgcggtggctcagactgtaatcccagcactttgggaggcgggggcgggcagatcacaaggttagaggttcaagaccagcctggccaatatggtggaaccctgtctctactaaaaatacaaaaattacccagtgtggtggcgggtgcctgtggtcccagctactcgggaggctgaggcaggagaatcgcttgaacctgggaggcagagtttgcagtgagccaagatcacaccactgcactccagtctgggcgacagagcaagacttcgtctcaaaaaaaaaaaaaaaactgccggagactgggtaatttgggtaatttataaagcaaagagatttaattgactcactcacagttccacaggctgtacaggaagcatggctagggaggcctcaggaaacttacaatcatggaagaagacaaagaggaaggaagcatgtcttacatggctggagcaggaggaagagagtgaagggggaggtgctacacacttttaaacaaccagatctcgtgagagctctatcacaagacagcactagggggatggtgctgaaccattagaaaccacccccatgatccaatcacctcccaccaggccctacttccaacattgggaattacaattcaacatgagatttgtgggggacacagggccaaaccatatcacatgttgtggctattgtgaatagtgctgcaacaaacacaggagggcaagtatctctttgacatactgatttcatttcttttggatatgtatccagaagagagattgctggatcataaggtagttatatttttagtttctgaggaacctccatactgttttccataatggctataccaatttacattcccaccaacagtgtacaagggttctcttctctacatgctctccaacacttgtatttcttgtcttttttgatattagccatcctcacaggtgtgggccgataccttgtgtggttctgatttgcatttccatgatggttagtgatgtcgagcattttttcatatacctgttggccatttgagaaatgtctattcggatctttgcccattttaaaattgggtcatttagtttttttgctactcagttatgtgagttccttatatatttttactgttaaccccttttatatgatttgcaaatattttctctcattctctaggttgccttttcattttgttgattgtttcctttgctgagcagacacttgttagtttgatgtagctccgcttgtttatttttgctatttttgcctgtgcatttggaatcatatccaaaatatcattgtcaatcaataccaatgtcaatgagctttccccctatattttcttctaggggctaaatggttttagattttagattgaagtctataatccatttcaagttaattttttgtatatggtataagaaaagggcccaagttcattcttttgcgtgtggatatccagttttcccaacacaatttattgaagagactctcctttctccattgtgtattctttgctctcttgtcaaagcatagttgaccatgtacatgtgggtgtatttctggcctctctattctgttcttttggtttatgtatctgtttttatgccagtacaacgtagattttatttaatttgtgtatataatgttttatagtttttagtgtagaaattttacatatctcttattaatacatttccgtgtatttgctattttttatgttattgtcaactgttttttgctgttgtatgaaaacttaaattgagttttggattttgattttatatccagctttttaaaactatggattattttgtcttttctttgcatataattatattgcctgcaaataataatagctttgttttttctttaacaacccttgtatttttcattactttttcttatgtcactgcatgggataagaagtccaggacgttactgaatagtcctggtgacaatacggatccttgtatcattcctgatctcagatagaaagcttctaatatttcaccgttacaatgtggtttgctgtggaatattgtagatatcattcattagattaaagtcattcacatattttctactttgctaactgttattttctaaagtcatgaatagatgtatttcttttatttttaactgacaaataattgtatacatttatgggatacaatatgatgttttgatatacatctatatcatggaatgattaaaatcaagctaattaacaaacattacctaatataattatcattttttgtggttgaagcactttataatcatattatttttatcatgttaatgtcaagaaattcactggataatttttttagtgctaaactaaccttggcatttctggaataaacccaactttatcatgatacctatcctttttataaattactagatttgttttgctcatattttgtttagaacttcaaaaaaaatctgtgttcatgagggagattgtcctgtaactttcttttatcatgacgtctttggttttggtaaaaatgttatgctgacgtcataaaatatggatttatttctgggttctctattctgttccattggtctatgtgtctgttttcataccaatatcatcatgctgtttgggttattgtaattttgtatattttgaattgacgtagtttgatgcctccagctttgttctttctaattttttttttttttttcagaaacaaggtctcattctgtcacccaggcttcagtgcagtggtgtgatcatagatcactacagcctcaaacttctgggcttaaataatcctcccacctcagtcccccaagctgctgggactacaggctcacgccaccacacttgactaatttgaaaaaaaatttttttttttagaggcagggtcttgctatgttgcccaggctgatctcaacctcctgacctcaagcgatcctcccacctcagcttcccaacgtactgggattacaggcataagccactatgtccagcccagatttgttctttttgctcagtattgctttggatgttcaaggtcttttgtggttccatatacattttaagattgttttttctatttctgtgaagaacgtaattgatatactgatattttgatagagagtgcattaaatctgtagataactttggatagcatgttcattttaacaatgttaattcttctgatccatgagcattttttttttttttgagatggagtcttgcactatcgcccaggctggagtgcagtggtgcgatcttggctcactgcaacctctgccttccaggttcaagcgattctcctgcctcagcctcccgagtagctgggattacacgcatgccccaccatgcccagctaatttttgtattattagtagagatggggtttcaccatattgatcaggctggtctcgaactcccaacctaaggtgatctgcctgcctcggcctcccaaagtgccaggattacaggtgcgagccactgtgcccggccagatccagaagaatattaattcttctttccatttgtttgtgtcctcttcaattctttttatcagtgttttgtagtttagttttcattgtacaggtctttcacctctttcattaaatttatccctgggaaattttttgtagctattgtaaatgggattgctttcttcctttctttttcagctagctcattgtttgatgtatagaaatgctacagatttttgtatgttgattttgtatcctgcaaacttactaaattcatttatcagttctaagagttttttggtagcatctttaaattttcctgtatttaatattatgtcatgtgcaaatagagagaatttgtcttcctcttttccaatttggatatctttatttctttcttttgcctgattgctctggccaggacttccagtaatatgttgaataaaagtggtgaaagtgggcattcttttcttcttctagttcttggaggaaaggctttcagcatttccccattctctatgatgttgtctgtgggtttgtcatatatagcctttattattttgaggtatgttccttatatgcctagtttgttgatagtttttttaatcatgaagggatgttgaattttatcaaatgctttttatgcatctattgagatgatcatatggtttttatccttgattctgttgatgtgatgtgtctcattcttgcatctctgagattaatcccacttgatcatggtgtattatctttatgatgtattgtttgactcaggttgctagtattttttaattttttaattttttaaacttttattttaggttttgggtacatgtgcaggtttgttacatagggaaatgcatgtcactgggtttgttgtacagattatttcataacctaggtactaaacctggtattttgttgaagattttgcatctatgttcatcagagatactggcctgtagttttcttttttttcttgtgtccttgtctggttttggtatcagggtgatgctggtctcgtagaatgagagggaattccctcttcattttgtgggggatagtttgagaagcattggtgtcacctcttcttcattttgtgggggatagtttgagaagcattggtgtcacctcttcttcaaatgtttggtagaattcagcagtaaagccatcaagtttctgggctttactttgttggaagacctttttttattattgattcaatctcattactcattattggtttgttcaggttttctagttctttctgattcaatcttggtaggttttacgtgtccaggaatttatccttttcctctgggttttcaaatttgttaatgtataattgttcaaaacaatctctaataaccgtttgtatttctttggtaactattgtaatgcctcctttttcagttctaattttatttatctgagcattcttcgctttttcttactctagttactgactaagtgactaaaccacttagtctagtggtttattgattttgtttatctttttgaagaacgaactttttctgtagttctgatgtgatctttattatttatttccttatactatttttcagtttggtttgctcttgcttttatagtttcttatttctttttaatttttgtgggtacatggtaggcgtatatatttacagggtacatgagatgttttgatacaggcatacaatgtgaaataatcacatcatgcatttgttcttcatgttacaaacaatccaattacactctttttgttatttaaaaatgtacaattaagttattattgactatagtcaccctgttgtgtggtcaaatattaggtcttattctgtctaatgaatttgtgtatctattaaccatccccacttcccccacagccccccaccctggctacctttcccagcctctggcaaccattcttccactctttatgcccataagttcaattgttttgatttttagattccacaaataagtgaggacatgtgacatttgtctttctgtacctggcttctttcacttaacctccttaatgacctccagttcaatccgtgttgttgcaaatgatgggatctcattcttttttatggctgaagagtactctatcgtatatatgtaccacattttctttatctatttatctgtcgatgggcactttggttgcttccaaatcttggctactgcgaatactgctgcagcaaacataggagtgcaggtatctctttgatacactgatttccttcctttggggtatatacccagcagtgggattgctggatctatggtagctcgatttttagttttctgaggaacctccaaacttctccatagtggttgtactaatttacattcctgccaacagtgtacaaaggttcccttttctccacatcctcacaagcatttgttattgcctgtcttttggatataagccatattaactggggtgagatgataatctcattgcagtttttaaatatattttttattttaacttttgttttaagttcaggggtacatgtgtaggtttattaaataggtaaacttgtgtcataggggtttgttgactatttcatcacccaggtattaagcctcgtatccattggttattttttctgatcctttccctcttaccattctctgccctccaataggccccagtgtctattgctcccctctatgtgtccatgtgttctcatcatttagctctgacttttataagtgagagcatgtggtattgggttttctgttattgcgttagtttgctaagaacagtggcctccagctctgtatatgttcctgcaaaggacatgatctcattattttttatggctgcatagtatgccatggtgtatatggaccacattttctttatccaatctgtcatcgatgggcatttaggttgattccatgtctttgctattgtgaatagtgctgaaatgaacatatgcgtgcatgtgtctttatgttagaatgatttatattcctttgagtatatatccagtgatgggactgctgggttgagtggtatttctgtttttaggtctttgaggaatcaccacactgttttccacaatggttgaactaatttacattcccaaaaacagtttataagcattcccttttctctgcaacctcaccagcatctgttattttttgactttttaataataaccattctgactggtgtgggatggcatgttattgtggttttgatttacatttctttagtgatcaatgatgttgagcttttttgtatccttgttggctgcatgtatgtctcttttgagacagttttgatttgcatttctctgatgatcagtaacattgagcaccttttcatatgcctgtttgtcatatgtttgtcttcttttgagaaatgtgtattcaaatctttgttccatcttttaatcagattattagacttttttcctatagagttgtttgagcttcttaaatattctgtttattaatcccttgtcagatgggtagtttgcaaatattttctcccattctgtgggttgtctcttcactctgttgattgtattctttgctgtgcagaagtttttcaagttcatgtgatcccatttgtccatttttgctttggttgtctgtacttttggtgtactgctgaagaatttttttgtccaggcaaatgtcttcgagattttccctaatgttttcttgtagtagttttatagtttgatgccttagcgttttttccctaatgttttcttgtagtagttttatagttcgatgtcttagatttaagtgtttaatccatttagatttgatttttgtatatggtgagagataggggtcttagtttaattattctgtgtatggatatccagttttcccaacaccatttatttatgtgcctatctttttcccagtgtatgttcttggcacctttgtcaaaaatgagttcactgtaggtgtgtggatttgtttctgagttccctattctgttccattggtctatgtgtctgtttttatgccagcaccatgctgtttggttaccatagctctgtagtataatttgaagtcaggtaatgtgattcttccagttttgttctttttgcttaggatagctttggctattctgggtctttcatggttccatacaaattttaggattttttttctatttctgtgaagactttaataggtattttggtagggattgcattgaatctgtagattgctttgggtagtatggacatttaaataatgttgattcttccagtacatgaacatggaatatttttctattttttggtgtactcttcaatttccctcaatattgtctcatagttttcattatagaggtctttcacttctttggttaagttaattcctaggtatttaagtttttgtgtggctattgtatatgggattactttttaatttcttttacagattgttcactgttggcatatagaaatgctactgatttttctatgttgattttgtggcctgcaactttactgaatttgtgtattagttctaatagttttcttgtgtagtgtttaggtttttcccaatataaggcagaggagcctcactccatagctatcaccaccccaggccatggggagtactgtctgcccatgttcccttaaggcccaagggcatttcaggaagcttgcaatgaatgctgtcatataagagaaaaagtgccttcctttactctgatcccatctgcattctatctgtcacaaatctcttaaattatctggcacatggattatacctatgtctttgattcagagttttctctatatttatgttatttgatggctttaaaagggtctggtagtggaaagggagttaagggcttgtgctcacacatgcaagtcccacaatgagaaattattccataatagtttctaagaattattaagtactttctgtgttctaggcagtgttctatgtcctttccagaagtcctatgaaataggttatattattggcttcactttacaaataggaaactgagacatagagagggtaagtaacttgtctagtgccatacagctaatacatggtggtgtagggatttataactagacagtctgacttcagagtagtttttaaccagtacttgtacatctttaaacatatgtaagcatagatatatacatatatacatacacatatatgtatatataatatatatgcttaattccatcagtctctgtcacatcttttccgagctgggagttgtccttgcattttaagatgttgtcgaattttaagtttatttcttagaggcctcctgacttttcacacctccaagctcttgagggctgagggctgagggccactttgctctggccaccacatgctgggagcacttgctgaacttctctgcaccactcaacactgttggccattctttccttcctgaggctttcatggcaccatacccccaagtttcctcattaatctatggttgctctttctcaagatacttcactgacttatctcttagttctttgagtcttaggattctctagagttttgtatttttctcaacacttgcaacctagatagtttcatctactcttatggtctaaattattctaaattttaatatcacactgtttcttgcatccatctgatgagtttctaatcctggataactccaaatgtcctttctctccatgcgtctacctgagtagcttttctggtcacagacctcaattgggcccttaatgctgctccacaaggcaatcgtttctctgttcaccctgttctcctgctcgttacaaggaatatttcaaacctctctcctctcctcaaacctccagttctgcctccagttcagaagatttatgtaataaatgcaataagaatttgttaattacttgctatgtctcctcctatttcacagagagaactcaaaccattggctagaaacttcttcaaaatctggtctgatttttcatctgttggggaaatgtgttctgactgcccagctagactctaatagcaactgttgtgttatgcttctctgcctctctggactctagtttcagttgatattgttctgcatttctcaccaccttggcttatttcttgcagctgatgtagaaggccaatccttaagacaccgagacaagcggcttagtttgaatttggtaagttcaacattcaggttcttttaagcatcaattttaccaaaaacagcttgatctatgtatattcccttgaaatctttaagattcagcactctgagtctctgaggaatcttccagtctcccctgaagacttgaacttgcttgggaactacaggacttggtgttctataagggccttattggttctaatggttcagacacttgctcaacttggtatagctacttaaggcatcactttatgcttaaagcatttgcataaactcataaccctctgtcttccagtgtcagatcttggagacttatcgcctatactaaaacgataagtccagaggcagaacttgagctagaggcttgtctgactttgctgaggaagttcagagttatacttggataatttggaactgaaaccatatgtacagctttggccgccctctgatagcagtttccatgactggtctgtggttcccaatctgtatctattcttttgcagccatgcaggttctccccgatgtaccccacagcttcagccagtatcgaagacagctatgtgcccatgagcccccaggctggtgcctctggtcttggaccccactgcagccctgatgactacattccaatgaactcaggaagcatctcaagcccgttgcctgagctgcctgcaaacctggaacctcccccagtgaatagagatctcaagcctcagaggaaatgtaagcacttgaccaggcctgctgtacaggggtaggggagcaaggttccggtggttgcatagaaaaggtttctgtaaaggaagacctagagaaaccaccccagagggccggaaagtgtaaggtcaggaaagaagtggctgggttggaataggaagggctggggcaccttgctgccccagattgtcatgataataggagtcaggagacttacaggcactgtggccttgcaaatacagctgacaaagccaagttcattccagagggctcgtctttggctgtttccctaacaaaggcccaggaataagtgatggtggattagaatggaatcccacctggcatctcctcattagacagcacttgaatgtaatcatagtgccagcctctgtaaggcagtcaggaatagcctttgacaccaattcctgaaggtcagacccagtcacatgcagtttatcactcatcgttctgtgcatgcccgtcagcagaggtattcagggatagaagaggattttggcaatgagcaggctgactcctctgtgcacggggtgccttgcagcttctgtcttactcccaggcagcttctctggtttgctaagcagcacagacagacagagagatagataggaaaagagggaaagaggaagagcaggtcagagtgactttttaacttcattcttgctcatcctccccttcccagttggctgtgtgattacaaggaagcattggtagaatgactgatctctcgtgcattccaacttctctttgccctttagaaagcaaaaaaagtcacttcaggtggctgtgcccaaagctgccaactaagacccctactcatgcctggtctactccaggcatattcccttaaatttcagtcaaaatacatttatacatttacaatgcatgcgctgcatatgtattgctgtggtgggcactgggtgggatacaaagatgagggagcaaggagggttcttcagtctgagggggaggaagatatgtaaaatccacctggaccatgaaatagaattatgaaatcagtgctaaataggagaacagaccctgtcttatgaggttcagaggaaatagccattaattctggtcagaaacaattaaacaacaacagaactttctgtgatgttggagataatggctattgaacccttgaaatttggctaatgtgactgaggaactacattttaaattgtatttaattttaataaatgtacatatatgtctaaatgggcacgtgtggctagttgtcacgacaatggacagtgcagctctgcaggaccttgtgataggcaacagaagatgtctgacagactcagggttggagatttaatgagtggatgcaaaggtggatacctgagccaggactaactcaagaagatgggccactgaggtggaataagggttggggcagataccaagtgcttttctaggtgctgagactactgcagtgaacaaaccagatacacccctattctcctggagcacagtttaggtccagataaatcatagatgagtgtattatcacaaactggggctgtgctgtgaagggtaagtacaagaacttgagagcccaggctgtggggcctgatcttgtctagaggcaaagagatgggatagaatgttctaggcagaaggatcatcaggtggacaatggattgtaggtggggaagactaggacctgggtgatcatctctgcctgtgataagaaaggtaacatttccacttcagacacatcgggtgtgaggtaatagatgttgcaattccacaaggtcagagactttcatctgctttattcatcctgtgccttcgacacctagaagcacgcgtgatatacagagacttcttaataatgccttgccacgttgttacctccagcaggtaatgtgaccatttgctcagtatttgtctttactcccagtgaggcagggaagaggaggacagtgaaattcaccctcatcatcagtgctgcctgttagtaaatgtggatttggtgtgctgggaaagtgaaatgtcatagttttacagtctttagactctggccttgacctcctggatgttgcacactgtcttgtagcacggccacctcctctggacctgagaaacctctcgatcatccgggaacatgcatctcttaccaggacccgcactgtgccttggtaagactgattgctcaaaagagcctcatccagcacagacaccccggtgtgtgttaggcctctgattaaatgtagttgaagcccatctgatctagcttaagccaaaggaggggtgaggtttattatcgagagcaagagctgttttatggatcacaaaggaaggaatatgtctgggtctcccaggatcctggaatcaggaactagtgtgctgttgggaacccaaggaatctactcacttctgcttcactcttcacatctgtgcattcctttgtctttgcagtattcttttctattgcacaatcctcatggtcaaagatagctgtaccataccccctgaacttgtttgcatgctacaactccagtaccaacagatgggctctttttcagtgccaattcagatttcctggggagagagaattgtgttccccagtctcagtggaactggctatggcccaagcccaactttgtgaatggggtaggacaagggagttcccaggttcacgggctgggtagacagacttcaaaatgtaattgcaccctttcatctcaccttttagaagttgcatttttagtcctgagcttggctcaggagtttctcggttcactctaaatgccacaaaacacaattgcattgtaaagcagaattctgcaatgagctgtatttccagccaagactgtgactcagctcatgcttctgactcaggagaaggatgggagttgattggcagtcttgtgtcctatcagaggaatggccatacttcctcacttttccttacattgaatagaaacaagaaggccccaaaggagtattttttttttttttttttttttttgctaaatgatatgatgccctcgtccgtttagaaagctcatgagctgtgtcacatagagggcctgagaaaaagcagcctttgtgaattgggagccatttgccccaaagtggagcagaaactgttgggcattttgtgcctcttcaggaattgctttggccggaaggaagttgtgtctggaagaggagggctgaaaccccatgagggccatgttagttcctggccagctttcagagcagctgtaagacattgctttgacctcatctatatttttattcttagcagtcgaaccagctttctctctccagaaagaaatggtattaattctgcaagattttttgctaatcctgtttccagagaagacgaagaaagctacatcgaaatggtaatcttatatttttcacactcttcttatccttcaccccaatctgtagtcttatgagctcattgtaaaggaaacacatccttcagtaagccctgtgcaattttaaaacaaccacttgatcgtaaaaccaggccacaagcttttctagacttggaacaaatcaatttgaagttggctttctttcctgcaacattcaactcctcataccattttgagattgcagtatttcaagatagctcagggctgaggcttgcttaatttgaaaatggaaatgccagcaattcttttcaccaaggctgtgatgtcctgtttgaccccaataggtttgtagttctctggatgtccagagttcaaattgtaaaaactcaacatattacatggtcccttccaccagaacacctggtggccctgtcctgactgcttctgaaccttcctggaggatgaatcacttagagtcccattgggaaaggtacagtgccctggactgtgagtgtatcttagcctctggaagattcctattatgggtctttctatagacctgagtggatggagacttgattaaccatttgcagttaaagagtcctgatgtttcccttctagcctgttgttccttctattctcttcatcttggatgctattgagaacatgggctttttgaagatggagaggaacttttagcacctctggcaattagcagacactttagccatgacagtgcctgttctgcaatttagaaatgtagggaactcaagagagagcttctgtttgaactacgaaattttgaaaagagatcttagaaggacaatgttcaaggctctgtgacaatatactcttgagaagacaattctgccttcctatatgcaaggataatcagcaactgaaaatctaaaaatagtaatctccagttaagctataattaaatgcttcattttaccttcttattttattcaaatcatgctgtaagtgcacttaaccgtatgcagatgcaaagtgactcatatacaaatctgttatggtcttcccaatatttctgacacttagtaatggcccttgggaaatttctagaagaaaacactcttataaaacgatgcttaacagctgtgctctgtctccagagaacagaaaaaggaagtgaatctaaaacccaatggaagcaagtacagagtcattccagataccaacagttcatttctgatctttgatgttgtgagaaagatcagtgttggctgggcgcggtggctcacgcctgtaatcccagcactttgggaggctgaggcgggcggatcacaaggtcaggagatcgagaccatcctggctaacacggtgaaaccccttctctactaaaaatacaaaatacaaaaaattagccaggcgtggtggcgggcgcctgtagtcccagctacttgggaggctgaggcaggagaatggcaggaacccgggaggcagagcttgcagtgagtcgagataacgccactgcactccagcctgggcgacagagccagactctgtctcaaaaaaaaaaaaacagagaaagatcagtgtttcattaacaacaaagctaagaatcgtttgtttacctaggtttataatcactgatcaatgactgtctctgtgtattagtaggcaacatgacacagcagattaagaacccagaacactggctgatagtagctatgatctgggaactgtcgtataaaaatgtttaaaggctatcccatcttgttcaattgtgtttttttaaactttagtaataagacagtttcacatgactttgatttacgttatttcacttgtgccacataacagcccaatatggtagtcaaacctagtatgatttgactttgattttgtgcataagtatatatgttaatttttttttttctctttaagggcaagttctgatctgaatgtagtgattaaggccaggggctgaaacacggttttgctttactgaaatacaagttttgccatatatccttctttaaatgtttgtgaaattatagaaaatttagaagaataaacataattttattatatgggatttcttctctatcactttttcaagccctttgatttcaacagctttgtaaggcttttatagtagagttctagcctcttaaatctcacattaattttttgattatggtattacaatacttttacatttttagatcatttttacatcatacagtgaaattgactttctcttggtgtgcagttctatgagtttgaacatatatagagatttgcgtaaccaccaccatgatcagagtacacaacggttccaaaatccctcatgctacctctttagagccacatcctcccttcacctgtaacccctagcaaccattgatctgttcttcatgactatagtattgtcctttcaagaatgccacaaaaatagaatcatacggtaccttttaaaactggcttctttcactcagaatggtttttttgaaattcatccattgttacatgtattaacagctctttccattttattgctgagcagtgttcaagcatatggatgtgtcatatcttgtttgtcccctcacccatggaagacatttggatttttttcaagtttttaggcaattagaactgttagatgctttcttttacagtttttgaaaaatatttttcttgtagtaaagctctactttctgtctctatgaacttacctgttctaggtacctcatataagtgaagtcatacaatatttgtccttttgtgtttgtcttctttcatttcatctagtgttttcaagattcatccatattgtaggatccaacagaatttcatttctttttaaggctgaccacattttgttcatccattcatctgctaatgggcatttagggttgttcctaccattgtctattatgaataatgctgctataaacattggcatacaagtgtatgcttgacttcctgctttcaatttgtttgtatatatatatgtagaagtggaatttctggatcatatggtaattctatgcttaactttttaaggaaccaccaaacttgttttccacagtgactgcaccattttacattactgccagtaacgcacaagggttccaatttctccacatcctcactaacaatttttatttatctttttttttggagacagagtctcgctctgttgcccaggctggagtgcagtggcgcaagctcggctcactgcaacctctgcctcccaggttcaagcaatcctcctgcctcagcctcctgagtagctggaattacaggcgtgtaccaccatgcccggctaatttttgcatttttagtagagatggggtttcaccatgttggcaaggctggtctcgaactcctgacctcatgtgatccgcctgccttggactcccaaagtgctgagattacaggcgtgagccatcacacccgacctatttatcattttttataatgggtatcctaacgggtgtgaattggtatctcattgtggttttcatttgcatttccctaatgattaatgaacatctttttatgtacttattggccatttatatatcttctttggagaactgtctattcaagtcctttgcatatttttaagttaggttgtttctttttttgttgttgagttataggaatttttaaaatatattctggatgttaaccccttatcagatacatgatttccaaatattttctctcattctgtgggttgtcttttcattctcttgatagtgtcctttgatgcgcagaagttttttattttgatgaagtcaaaattttctttccttttattgccttgcttttggcgtcatatccatgaaatcattgccaaatccaatgtcatgaagattctctcctatgttttcttctaaaagttttatagttttagctcttatgtttagatctttgatcttttttgagttaatttttgtatgtggtataaagttagaggccaacgtcattcttttgcttgtggacattcagttttcccagcaccatttgttggaaagtctagactatcctttccatgtcgaatggtcctggcgctctcattgaaaatctcgttgaaaatcaatatatgcaagggtttatttcttggtctatatgtctatccttatgccagtaccacaatgttttgattagtgtagctttgtagtaagctttgaaatcagaaagtatgagtcttccaactttgttcttcttttttatgattgatttgtcatttaagggtcacttaatattacacgtgaactttaaggacagggttttttatttctgcaaaaaaagaccattggaattctgatggggaatgctttgaatctgcaaaccgttttgcataatattatcatgttaacaatattaagtctttcaattcatgaacacagatatcttttcatttacttatgtctcctttactttctttcttacagttttcaatgtataagtctttgcctccttggttaaatttattcctaagtattttgttcttttttttcttttttatttatttattattattatactttaagttttagggtacatgtgcacaatgtgcaggttagttacatatgtatacatgtgccatgctggtgcgctgcacccactaactcatcatctagcattaggtatatctcccaatgctatccctcccccctccccccaccccacaacagtccccagagtgtgaagttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtgttccatggcgtatatgtgccacattttcttaatccagtctgtcattgttggacatttggcttggttccaagtctttgctattgtgaataatgctgcaataaacatacgtgtgcatgtgtctttatagcagcatgatttatagtcctttgggtatatacccagtaatgggatcactgggtcaaatggtatttctagttctagatccctgaggaatcgccacactgacttccacaatggttgaactagtttacagtcccaccaacagtgtaaaagtgttcctatttctccacatcctctccagcacctattgtttcctgactttttaatgattgccattctaactggtgtgagatggtatctcattgtggttttgatttgcatttctctgatggccagtgatggtgagcattttttcatgtgttttttagctgcataaatatcttcttttgcgaagtgtctgttcatgtcctttgcccattttttgatggggttgtttgttttttccttgtaaatttgtttgagttctttgtagattctggatattagcccattgtcagatgagtaggttgcgaaagttttctcccattttgtaggttgcctgttcactctgatggtagtttcttttgctgtgcagaagctctttagtttaattagttccgatttgtcaattttggctttggttgccattgcttttggtgttttagacatgaagtccttgcccatgcctgtgtcctgaatggtaatgcctaggttttcttctagggcttttatggttttaggtctaacgcttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttgtttctgagggctctgttctgttccattgatctatatctctgttttggtaccagtaccatgctgttttggttactgtagctttgtagtacagtttgaagtcaggtagtgtgatgcctccagctttgttcttttggctcaggattgacttggcgatgcaggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccctgaagaggtccttcatatcccttgtaagttggattcctaggtattttattctctttgaagcagttgtgaatgggagttcactcatgatttggctctccgtttgtctgttgttggtgtataagaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaatagcctttatttccttctcctgcctaactgccctggcaagaacttccaacactatgttgaataggagtggtgagagagggcatccctgtcttgtaccagttttcaaagggaatgcttccagtttttgcccattcagtatgatattggctgtgggtttgtcatagatagctcttattattttgagatacgtcccatcaatacctaatttattgagagattttagcatgaagggctgttgaattttgtcaaaggccttttctgcatctattgagataatcatgtggtttttgtctttggttctgtttatatgctggattacatttactgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcccggctttggtatcaggatgatgctggcctcataaaatgagttagggaggattccctctttttctattaattggaatagtttcagaaggaatggtaccagctcctccttgtacctctggtattactagatttttaaattttctaccttctgatggatgtatattggtatctcagtgtggctctaacatgtactttcctaatggtaaattatgttggacatattttggtgtgtttacttgccatccatatattttctttggtggagtatctgttcaatctttttgccaatttttaaatcaggttgtttgttttcttacattgagttttgagagttctttatatattctgtgtacaagtcctccaaaggggccagccatggtggctcacgcctgtagtcccagcactttgggaggctgaggtgggaggatcatctgagggcaggagttcgagaccagcctggccaacatggtgaaaccctgtctctactaaaaatacaaaaattagctgggcttggtagcacgtgcctgtagtcctagctactcgggaggcagaggcaggagaattgcttgaacccgggaggcagaggttgcagtgggccaagatcatgccactgcactccagcctgggtgacagagtaagactctgtctcaaaaaaaaaaaacaaaaacaaaacaaaaaaaacccaagtcctccaatggatatatagtttgcaaatattttctccgtatctggagcttgtctttccattctcttctgtcttttgcagagcaaacatttaaaaatttaattaagtccaatttattgattttgtttccttaatggattgttatgtctaagaactctgcctaaccttagttcattagaattttctcctttatttccttctaaaagaattatggttttacatttaggtctatgatccattttaagtttatttttgtatgagatgtgaggtgaagtcgaagctgacattttgcatatggatgtccaaatgtttcagtaccatttatggaaaatataatcctttcttcattgaattttctttgcacctctgtaataaatcagttggacatatttgtgtagattttctattctgttccattgtctctttgcctatgccatacagtcttgattattgtagctttggagtaaattttaaaatcaggaagtttattttctctaacatcattcttgtttttaaaacttgtttttgttattctacttcctttgcctttccatgtataattagagtcagatgttctttatctacaaaaatatcctgctaagactttttttttttttttttttttttgagacagagtctcgctctgtcacccaggctggagtgcagtggcgccatctcggctcactgcaagctccgccccccaggttcatgctgttctcctgcctcagcttcctgagtagctgggactacaggcgcccgccaccacacctggctaaatttttgtatcttttttagtagagacggggtttcaccgtgttagccaggatggtcttgatctcctgaccttgtgatccgcccgcctcagcctcccaaagtgctgggattacaggcgtgagccaccacgcctggcctaacacttttttttttagttggaattgcattaaatctatacatacatttgagaattgagtctttactattctgaatcttccaattactgagcacagtatatctttccatttactcagattggtttttgttttttttgttttgtttttttcttttttttgagatagagtcttgctctgtcacccaggttggagtgcagtggcacaatctcgactcactgcaacctccccttctcgggttcaagtgattgtcatgtcttagccacccaagtagctgggattacaggcacacgccaccatgcctggcttacttttttgtatttttagtagagacagggattcaccatgttggccaggctggtctcgaacccccgacctcaagtgatccgtctgcctcagcctcccaaagtgctgggaatacaggcatgagccatcgcgcctggctcatttattcagattttctttgatttttttcccctcataattttgtaatttttacatagatcttatgtgtgtcctattagatttatatctaagtatttcatttttggaactattataaatagtattttttaaatttcagcttccaatgacccattggtggtatatagaaatatgattggctgagttcagtggctcgcacctgtaatcccaggactttgtggaggctgatgtgggagaatggcttgagcccaagagttcaagaccagcctgggcaacaaagtgagaccctgtctctacaaaaatgttattaaaaattaaccatgcatagtagctgtgcctatagtcccagctaatcaggaggctgagacaggaagatcccttgagcccaagagtttgagattgctgaattaacttattaattataggaggtttttattttcctcagatttcttgggatttttttttttttttggtagagacagggtcttactatgttgcccaggctggtcttgaacttctgagctcaagccatcctcccacctcagcctcctaaaatgctgggattataggcatgagccactgtaccaggctttaagccagtcttgtattctctagataaaccccatttggtcatggtgtattatttccttgtatatattgctgcatttcatctgctaatattttgttgaggattttcatgtctgtgttcctaatgggtgttgatctttaggtttttgtagtgtctttgtgtggttttggtattaaggtcatgccgggctcctcaggaagtgttctctcctcttctagtttctggaacagatcgtgtagaattagttttgtttattctttaaatttttggtataattcaccagtgaaaccctctgggtgaattcaatttctttaatacaggatcattatctatttgatctcgggtgaattatggttatttcctaggagttttctagttttaccttcacatttggattataccaccttgaattaacttgtgtgtgctgtgagataggggtcaagactcatttttccccatatgtttatctaattggttggcaccatttatgtaaaatgactatcatttactgacaattcggcagtgccatctttgccataaatcaaatatccatatatgtacgggttttttatggactcttaattctattctgttggtttccctgtctatctttgaacaatacaaactcccttagttgctgtagctttataagactcaatatcaaggaaagtaagtcctgctttgtttaccttcctctaggttttttttgttttttttctttgacttttctactcccataaaaattttagaaacaattttttaatttctaccaaaaaaggaaaaaaatattgttctcagcaggaagggtgatcaaaattactttattcaacattactggaggtgaaactacatttattctatttttaaaatttgatggaacactttggtaggcaagatagcatgaaaaacacctcttattataaatatgatacatttttaagtctaaaactcagctgacaagaagggaagggaaaagaaatctctggggccaaaaatattgagaaacagcaaccccccaaattaataagaattacaaacaatagaatcaaatatggaagtaggcagtttttggaaacactggattttgaatataaaataagtagttttactatatttaaagaaataaatgagaaattgaaagttggattaagtaatgagatactattaaaaatggccaagtagattgtaaaagaccatttacaacttgtagaaataaaaacaagaatgaaattagaaactcaatggatgagataaacagactaagcacaaagagtgatttagtgagctggaagataatttatgaataagttactaataaatcagaacgaggagttaaaaacatggagaatatgaaagaaatttgggacatggaagatagaataagaaggtcaaatatttgtatagtcagagttgctgaagaagattatagaaccataggagagaggcaatatgtcaagggataatgctagagttgctcacagttcatgaaaggtaccattcctccacaagcccaaagacttacaagcaggttagtataataaaatgttagtggagtatacatggtgggtatattttctttaatttggctgattgctggaaaaattttataataataagtttagaaaaaccctacaaaagtgaaagaataaaggcaaaagcagaaactaacaaaataacaaaatcagagaggatcaatacagctgtaattggctctttaaaaagactaaaatttaacaaaactaatacaaaagatatgaatacaaataagtaatattaagaatgaagaacagataataattacaaatacatgagagattaactacctaagagaattttgtgaacaactctgtaccaataaatttgaaaacttttgtgataggcaaattctctggattaaaaaaaaatcagaaattgactcaagtagaattagaaaacctgaatgtttatgtacctattaaagacactgaatcagtaggaaaatttgtactacaaaggatcataaggcccaaaaaactttacagatagtttcgaccaaaaagaagagataagtgcaatcttatataaacacctaccaggaatgggagaagagaatattacccaccttactttatgaggctaaaataatttgataaaacaaatagcaattacataagtagaaagctgtaggccaatgttactggtggatgcggattttaaaatcccaaagaagaatatgtctaaccaaatactcgtacacaaatgttcatagaagcattttttcataatagccagaaagggaaaacaactcaaatgatcatcgactgatgaatgtgtgaataaaatgtagtataatatataataaaatgtagtataatattccattgtattatgcagccacaaaaagaaataaagtgctgacacatgaacctcaaatggaagattgaccgcaagcttccaatttctctccatccccaaacaccctctaaaataacagtaaagaaatctgttaaaggcataaacccacaaagatatgaagaattggagaagaaaatagcagtaacatattggaaactagaatgcaggtagatatgtagtaaatgacttacaagacccctcccccccacaaaaaaattaaatcttaaatgtggtggaaggaaggcaagaagcaacttgacttatactgcagactacccaaagagttcaggaattgtccacagtaggtagttctgaagtagggttgaagggaaagtaaaagaagcagtaatggtcaaaggcatcaggtaaattccaagatcccttccctcactccatggaggtgaaacactgtgactttccatcccccatctcatagaaaagttgaagttcagtctctctggagagagtaaaacaaaaggtctctgcactgggggatactagacatatttgaccacgaatactatactaacgacaaggtgattaagtaaataggcataatggatatgagaaccattctcaagcccttttccagaatgttgacaaccagaccattacaattgagtttggagattagaaaatatttctctgggctatttgagcagcccaagtggcaaaacgtagttcctaatattgggggttactcaagataaccacccaatgggatcaccctgcagaaaactccagagctgacaaacaccatccatgtacacaaagctccacgttagctttttggtctttcgctcgtaagtataagcaacagtcagtgatttcatgtgacatttcaggagaactctagcatgaaagattgaaatcaaaacagattggaggaaataagaactatgccagaaggaaaagtctttttatttatttattattttatttttttgtgaggcggagtctcactctttcacccaggctggagtgcagtggtgcaatctcagctcactgcaacctctgcctcccgggttcaagcaattctcctgcctcagcctccgaagtagctgggactacaggcatgcgccaccatgcctggcagatttttgtatttttagtagagacagagtttcaccatgttggccaggctggtcttgaactcctgaccccaagtgatccgctcgcctcggcctcccaaagtgctgggattaaaggtgtgagccactgcgcccagctaggaaaagcctttttaaaactctattattaccaatattctcagagagatgagctattacaaccataaaccaggaatatctattaagtcaaccaagcacattaacagattaaaggagaaaaatgatatattatcttactagatgcagaaaaagcatttgatagaactcaacatctattcatgaaaaaatctattagtaaacaaggaatagaggaattttctctaacctcataacaaatgaaaaatgaatcttatagaacctgtagtagatatcatactcagtggttaaaagctaaaaacatctcctaaagaaacaaaatgaataagaattggaaaggaaggaagaagacaaagagtgattattcttagatgaagcgataactcaaaataatctgcttatatgaatgataactcgaaataatctacttagaaataattagaattactaagttagtaaaataaataattacaattaataaaagatatcaagattgatggatataaaatcaatatacacaatccagttcactgtctagataatggtaacaaacagaaaaaagaatttaaacaaaacttaccatttacagtaacaacaaactctaggcatttagcgataaacctaacaaaaaatattgtggagaaaattattaaaacttattgaaagacattaaggagaatgaaataagtggaaaagtagaccatgttcctgaataggaagactcaaatattaaagacattatctaaccaattccctaacagagatttttgaggaactttgaagctgattctaaaagggtcaagatcacgcaagacattctgggggaaaccaggttatccatgttgagtaaaaacaacaacaaaaatggaatgaattttatttctattgcaccaccatatacaatattaaaatccattcaagtgagattattgcttaaacgtgaagcaaattattgcaaaacattataatttcaggaaaaatatagagaaataaattatgacctcagcatagggaaggattccttaaacataatgtaagccatacaggaaaagatcgacattacattaaaagtatttcttagtcaaaagaaataccataaaaagaaatgaaaagacaagaagctagactgtgatgagctatctgcaacatacatgatagcaaatgattactctccagggcagaggaaaaagtactaagggtaagtaagaaaaatatacaaataattcaatacaaaaattaaccagaaacaaggcaaaaaaaaaacccaaaaaacaaaacaaacccaaacaggcaattcacagaggagaaataaacaaatgacctttcaacatatgaacaggtgctcatactaattaataatcaggggaatggaaaatcaaaccacagtaagataccattttacctgtctcaggtaggaaaaatgttaaaaactctgacaataccaagtgttggccaggatgggaagcaatagaaattcttatacactcctggtacacgtgtagattggttcactctggaaaatagtttggtgatatttagtaaagttgaagatactcatatcctataacccagtgattctattcccaagtaaatgccctagaatttctcccacaggtgcatgaatgcccatggcagcattgcttacaatagcccccaaactgggagcaactcaaatatcctttgatggcagaatgattaaataagtcatgcaatggaatatctgacccactgcaaatgagtgaaatagggctaatgcttcgacacaagtgaatgtggagtacctaatattgaacacaaaactgaagccgcccaaaatgcatacaatgtgattctgttgatatgacattcaaaaacaggcaaaatgaaatagtctgttatttaaggatacttgcatactcataaaactatatttaaaagtaaaaggagtggtaagcacaaaattcaagatagtgctttacctcttgggaggagaaggaaagatggtacaggggaaacagcttcaaagatatggattggtagcattgcacttctgaagctgggccctgattttcatctgtgttataactgtttgtattgtgcaaactatatttaagtgcatttgggatgccttcacgagaactttaataagtatagttgatcttgtcagggtttaatctctgaagtatcacaggcctgtcagattcgtgaagcaaattcctttttgagtgaattttggcaaactgttcccatggtgaataatggtatggtttcattgcgaaggccaaattggctatattctgtttgaaattacagttctcactcagatatgcaggctgattgactcaggtctcatcagactattctgttacgatctgatggcagctgcttgggtgaagccacaacttgccctccttcccttgagcaaccaagatagacatcattaacctgactcctgtgatgttggttcctaggaggagcaccgaacagccagttccctgagcagtggtgcccttacgtggacaaagaaattcagcctagattatttggccctggacttcaattcagcatcaccagcccccatgcagcaggtaggaagggctttgtgtctaagaattcccaggtgattccatctctgcctagacttttctgattatcaaaccatgcatattctccttagaaagtgttaaaaatgcagacatgtataatgaagaatattaaaatcggccctcatcctgcctcccagagagaatgaaatcttggtgtatttccttctagggtgtgttctttgtgtgtgtatgtataaatagatgtgatattcacacttcaaaatttggaccaaaaagtttatagaaaaatatctcaggcagaaatgagggtcgggtagaggaccctccaggtgtaggaacatcctgtttagggaacaagtaatagtctagtttggttagacttgagggagcagtggaaagaactgtaagttggaagtaaggggccttgaatgctgagttgggcagctacccctttgggtagaattctcatctgaaaaatgggaatcagaaatgacaacacttatgtcaagggctgttgtgaggattaattgagttaatacatgtaagttatcatatctgtgaactagtatcacccactgtacagcgtaaggaatgagtgcatgggaaacaactgaggactttcctcctcttttgctgaggtaactcctacttgttttctacttttaatatcgttccaaaaatctgatatgagactggagaaaagctggtaagaagggtgggagcaataagtataaaaggagcattagtcagttttggtagacaaacaacccccaaatctcatctgctttcaacacaaaggctcttttattgcaggccagagcctttgtgttccaggtcatctccagtccagggccgaggcaagagaagcagcccccatctgaagtgtgctggcctcctggcagaggaaaaagagagattgcagaatcacagaatacctctttctccttaggattggaacatgtcacttcctttttgttattattgttttgttttcttgagtcaagatctcactctgtcactcaggctggagtgcagtggcatggtcatagctcactgcagcctcgatctcctgggctaaagttatcctcccatctcagcctcccaagtagctggtactacagttgcacatcatcacccacggctgttttttattttttaataaaaaatgatcttgatctcctgggctcaagtgatcctcctgccttggcctctgtattagtccattctcacactgctatgaagaaatacctgagactgggtaatttataaaggaaagaggtttaattgactcacaattcagcgtggctggggaagcctcaagaaacttacaatcatggtggaaggggaaggaaacacatcctttttcacatggcggcaggaaagagaagtgcagaatgaaatggggaaagccccttataaaactatcagatctcttgagaacttactatcatgagaacagcatgagggtaactatccccttgattcaattacctcccaccaggtccttcccagggcacatggggattatgggaactacaattcaagatgagatttgagtgggggcacagccaaaccacatcccagcctctcaaagtgctgggattacaggcacgtgccgccatgccaggccatgtcacttccacttacattatattgatcaaagcaagtcaagtggctagagcaaagttgagggaagcagaagcacgtgcgtgcacacacacaagcacacatacaaagtacaaagtttccacacagaggaaagggcaacaaatatttaacaatttaatacaaaagggtaaacattttcctgacattttaagttagatgtaatgaaaacctttttgttctcctccttcagaaacttctcctttcagaagaacaaagagtagactatgtccaagtggatgagcagaagacacaggctctccagagcacaaaacaggagtggacggatgaaaggcaatccaaagtatgagaggtgcgggcttgtgccatgtgtgaaacagggaagcttggggctcagtttgagttttttcttttttttttttttttgtccactaaaaacacactgatggtcaacacaggtcaaaaccaagagagaatgtgtagttttcaaggtcttggccagaacctttaggaaagaagacctgtttatacattgaaggaagaaaagaaggaagcagttgccttccggagggggctctgagagaatctagcctcccctctgtcctattggagcaaagattggagtgagtgttgccaccaacaggattttatcgtttgactccaatacctgaaattctgacttctctcctgtgcttcaatgagaatgataaattatcctagcaaaggggcctctggagaccatcttgttccagcctctgaagacagttgaggagatcaagcccagcaatggtggcagaatcttactccacagacttcagcagactagtcatttcaatacccaaagaaagacaagtgacaggggcaatggatctcaggctctgagataagtatatcagatgacactggtggctctaaggatattgcaattaagcagctacctgtagccaggtattctgctgctcttggccttttcccacgcatcgtctcgtgtcttctccgaaagaccttggaagataggcctggaagagactgttgatgccactttgaagaaaagaacactgagaactagaggagggaacactttgcccaagattactcacaaagccaagacccagagtccagcttagagaatagagttgttcaggctgccaattgcaagctcattcctctacctcatacttcctctgaggattttgacaaaatggattaattgggtgagccttggagacatgtgggaaacacctgcagacacaaaatgagtagtcatcctgtctccctttcaatagggatctgaacaggtgttttgatacttgaaagatgtgcatgtcaagtgagggtttctttctgcgatgttcaactggaactctcccatcagtagttacaattagaaatacctactgatggttagtctgaaggccattctcatggtcacctatacagtgtgtttccctgtgagctagcagacacaatgaccaggaaaaaacctatgaattccattcttaggtttcccagccaattgctcccttctgctttagaagtgactaggtactgagagtacaaacactcccactttataatgaaggcgtcatgtcaccccttcctttacaggtcctggggtccaggagacccagaatgaaggtgtcagttgggcatgaagtgttatttagtgtccattcttgatccttctgagcacctacagctggaaactaagcagatactggtcctgcattctgactgagattgtgtcttctttatgaggatagatcaaattggcagtcaggcccatgatagtcagtgcagttggggcagttgtagactttgctacaggatttcagggtttccaatcaccccacaggtaagtgaatgccaaagtcttcttttttcagaccatacaagaagtcattttgattttcaaagaagccgttttgattttcaaagaagcaggttctggtgacattattttcttccttggacaaagtggggggaaatttctaagtattttaactgagttcagggtccttagtgagcctggacagagcaaggagagggctccccactccctaagccccacagccagctctgcatcaccacacacagccagagcctgtgaggagctgccttcttccccatgtgacttgcaaagagtctcaggcaagaaaccagggcttcaaactgctagttcccatggagggtagttccctcgtgtggagcacttgtgttaggatcactgattatctgacaaaggctggtgcagaaaaaaaattgtaggcccaagtgtcaagaaccacaccagattggagatagaaaagaatagctgaaattatgtcagtggtgaaatgtcactccattgacccaccgaaaaaagaaaagaaatctgtttctaccaaacatttccagaaacgtatttatagcatgaagaaacacacatgggtagtgtgacctgtttggatgtgattacttaaaaatggaatgctctgaataggcactctctacattaaaggtatggaaggcgataggggtcagaattttaaaaatttaattttgaaaaaggtgactcacccctcatttccagagtgtaggcaattatgtcctgctttgataaaactgctagaggatggctatgcaaaagcataacgattcaaggaaacaaagtacaggtagtttttgagctgacagcagcaaaggcaccataagtcaaaatattggttttggtggagatgatcgatgtgtgtgtgtgagagagagctatgtttctaaccaagggcctaatgtttgttacagaaatgatcccagagacctacaagatgtgggaatcagcataacagggcaatgcagcaattaaccccacatcgttttctgtagttcctttttgtttcattttcttctgtctcacctcgttagaaaattcctcccagtcaggggtcgtccagtgcaggacgggggacccaagggtctcaagcctgcaagtccagaaggtgacaaacccaggagcactgggagttaagctttccttggggagggaagagccttgatgtccagcacacagcctggctataaagacacgaagcgacctacccactgtacagtccacttcacaggatcagctgaatcatgacctttaaaagttccgagttgaaactgaaggctctcctcagacctggctttttcctcagtccctgttcataccatctctgcacccacaatcacactgatttttcaaattcattttgtttttgctgtttcatttctggcattaataaaagtcttataagga

SEQ ID NO: 4100 - DNA, 190082 bp, human
attcccacggcggcagcggaagagggagggccgggcgcgccgcggctgcttgcagtctccgcaagcggctacatcacagagctcagcgtgcggtgtcacaggccccgcggtcccgcccaacagatgcaccgagatgcgcgtgcgcagaaagcgtcccgggggtgaggctccctccctcgctctccctctactcccgccccactctcccccactttcccccctccacccaccgcggccgtcggggctcgctcgctcagtacctggaggcgagttcctgacgcgactgcgactcaatcctcgcctggtgaagaatattttacctatgactcactgaaaataaagacggctgagtgaccgtgtttgttcatgtaaacattgaacaaatatttatcggcttctgcgatgtgtcctactcttttagtggaggaagacacattttatttatgtatttaatttttcttttgaattttacatgcgagttatacttaataaaactcacttcaaaatataccttcaacagaaaatccagcaacagtttctattatgttagttaaaacagccagtcttttcctttacttttaaaaattattcataaatgtaattagtgaatgataataaacattgacatctgatccactgctttaggagtgacacaaatgaagttaactcaggctattttctttataatcattgtgctattgttttctttttcttttcaattatactgcttaatataggattttgtggcaccataggagttgagtaaaaataaaaggaataaaaatataccttatctggccgggcgcggtggctcacgcctgtaatttcagcagtttcggaggccgaggcgggcggatcacgcggtcaggagatcgaggccatcctggctaacatggtgaaaccccgtctctactaaaaatacaaaaaattagccgggcatggtggcggccgcctgtagtcccagctactcgggaggctgaggcaggagaatggcgtgaacccgggaggcggagcttgcagtgagccgagatcgcgacactgcactccagcctgggcgacagagtgagactgcgtctccaaaaaaaaaagaaaaaatacgttatctatgaagatttccaatttgatttctatttatcacaaatggccacagtactcctttgtactttaccacataccatattgtattcagtaattatttgtgaatatgtaattgataatattgtaggttttagagaatccttgaaaacatgaaaatttggtaatggggtctattttgattatttatttatttatttatttattttatttttgagacagagtctcgctcttgttgcccaggctggagtgcagtggcgcgatctcggctcactgcaagctccacctcccgggttcaagcgattctcctgcctcagcctcccaagtagctgggactacaggcacgtgccaccatgcccggctaattttttgtatttttagtagaggaggagtttcatcttgttagctaggatggtctagatctcctgacctcgtgatctgcccgcctcagcctcccaaagtgctgggattacaggtgtgagccaccgtgcccggccatattttgatttaaaatttagcaataatagataaaattttcaatcaactaagcccttgggccagggaatgctattccttaaaaagtgcttctatcaatatagcctctgactcattactttgttaatttttaaattgtatttcattcctgattaacattcccacccagattattaattatacaatctgttaactgtagaacctcaaacatgttggattgtactgtatttgtctggaagacacatttttaaaacattgtaatcgctataagagaagcactgggaaagaaaggagcttctatgcctgcagtgcctgaggagccctttaacagtgtgccccgcccctaagctactcatgcagtcatccccatcccagttagtcaactttattccaaaaaacttggtgttccaaatttttccttctcaaagcccacagatccaaaattcatcagcagttcccacaaacgttaccctcacaatgaatccagccatttttcaccctctccagtggtaccatcatagcccaagccgccaccatttctcacccccggttaacaggccaccctccttctacccttatcctgctagagtttgttttatctacagtgatcagaaagatcagcctaaaagataattctgatcaccaccctcctctactcacaacccggccgtgtctccccattgccctcagtgtagaagtcaatgtccctttgctgaaatgcaaccttagtgaaactttccatgactaacctcctttaaaattgcaacctggtccacccttactcccccttaccccacttctcttttttgcacagcacttattttaccttctaacatactgtataatgtactcatgtattgtaattattgcttatcatccctctttcagttgcttatatttttcatcaatgtgtacccagtgcctaggacaatatctgtctaggacaaatgggtagttatgtggctgtaggcaagccatttaacctctctgtacctcagttactttatctgtatccactttgcggtgttgtcatgaggattaaatcagatagcctatgtgtagcacctggcagtgaatttatcaccctgtactgtaactgtctacttttctgtctcctccattggactgtcattcccagggggttgggaactgggatttcttcatttctgaggcatagaagtatagcatagtggttaggagcatgacttctggagccagagtacatgggtttgaatgctaccactcacaagctgtgtggccatggagaagttgcctaacctctccgtgcttcagtttcatcacccataaaatgaaggtaagaatagtacctgtatttaaaagcacctagaacagttcctggcatatagtgtcagctgtcatctctgcatccttgtacctgtcagagaggagtgtttatcaaaggggcttcttgctgcctgtttccaaaccagtcgacaatataccaattgctccctaacacattcttgtttgtgcagaactgagctcaatgataacatttttatagcaaccctgatcaagtttcttctcataatctcttacactttgaggcccctgcaggggccctcactctccctaataaacattaacctgagtagggtgtttgagctcaccatggctacattctgatgtaaagagatatatcctatacctgggccaaatgtaaacagcctggaaaagtgttaggttaaaaacaaaacaaaataaataaatgaataaatgccaggtggttatgagtgctattgagaaaaatgaagccaagagggatatcagtgatgcaggtgggggtaaagagcttacaacataaatgtggtgttccatatttaaacctcattcaacagggaagattggagctgaaatgtgaaggagttgtgggagtggaactacgtggaaatctgggggaaaggtgttttgggtaaaagaaatagcaagtgttgaggtccaggggcatgagtgtgcttgatattttagggaagagtaaggagaccagtataaccagagtgagatgagactacagaggtcaggagaaagggcatgcagaccatgtgggatgctctaggacctaggccatggtaaagatgtagggttttaccctgatggaggtcagaagccattggaggattctgagaagaggagtgacaggactcgctttatagttttaaattataactataaattatagtttttaaaacaatagttgcctaacctcatgttatatgtaaaactacagttttaaaaactataaattcctcatactggcagcagtgtgaggggcaagggcaaaagcagagagactaacaggttgctggttactcttgctagtgcaagtgaattctagaatcttcgacaacatccagaacttctcttgctgctgccactcaggaagagggttggagtaggctaggaataggagcacaaattaaagctcctgttcactttgacttctccatccctctcctcctttccttaaaggttctgattaaagcagacttatgcccctactgctctcagaagtgaatgggttaagtttagcagcctcccttttgctacttcagttcttcctgtggctgcttcccactgataaaaaggaagcaatcctatcggttactgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaaggtaaaggcatgtcctgtagggtctgatcggggccaggattgtggggatgtaagtctgcttggaggaaggtgcagacatcgggttaggatggttgtgatgctacctgggccccaaagaaacatttctgggtaaggtgtgcacacatctgtgttattagcagaaatgctaactgccaattcttttcataggtctgacctatttgttgatattttgttctgttttgtccattgcttctcttcgtcatatgctgctcctccagaatctagagactggagtagagggagggtgaagggacaaagacaaaacttccctctgcctgcccaagcttccatagagagaatcaaggcaatgaaatccaatcaatatcacacacaagtttcatgtctggttctcttgtgtgtacatgcaatgtgtgtttttataatatcttttcctactttgggtgtaaggataatatgagccttgagttcagaagcttttcgtgttttgggggttctggtgcatttaggcagagtattaaataactttatcaatattgtctatggtcatcagttgattcagatttttctacctcttcttcagtaaatattggtatattttggtctatactttcatagaaagcaatctactgtccctagatttgataatgtattggtatcaagttatgtaagagtctcctgtgattttgttaaactgttctgtgtctgtagttatattttctttttcattccttatgttgtatatgttctcttcctctcttttaaaaataatatttccaggagttttcttgattttattggtcttgtcaagaattttcttttggtttgatttatcaatctcttttttctttctgttgcatcagtttctgcttctactttcattgatttattccttccttctaatttcctttggttcattttgttgttagatttttgcttcttgagttgaatgctgaaatcatttattttatttttttgtcttctttaaatgtgtattataaagatttaaatataatacatagattgtggctgtgtaaacattaaatgtggtcatgttgtacatactttatattctttttggttctttctgtttggctccccaccctctttccacatcagtccccttctcccccacctcagctaggtaaccccagtatgataatatatattcacatacacatacacacacacaaaggttttcttggacattatttgttttataaaattgggacattatacacacatttctcactcattaacacgtactagaactctaagtcaattggtatagctttaattcattatttttattggctatataagattctatggtatggctgtatcacaatttagtcaatatgttcactttattccagtttttggctactatatcctatatcattacatactggtgcttttacttctgttgaacaaacttgcaagaggaatattaatggaacgaagggaatgtttccttctaagttttaatttccaaagaggtcagaacttttcaaacatttctaccatcgaagtatgaaaatggccttctctctgcattcacatagcgataagttttatcctgtttttaaaatttgccaattttacaggtgtagagtgatattgcatcattactttcattgtgttatttttatttctaataagttgagcatctttttaaatgcttgttggctattggatttatttgggggatttaattagtcatatgatttgcccattattctttggactctttcatttaaaaaaattatgagaacccttttattattacaaatattaactctttgtcatgtatattgcagttttccccaagatctattgtttgtctgttgactttcttataacttttaccaaaacagtttttaatttttataatcagagatatcttttctttcatatcttcagagtcggcaaggttggttaaaaatgtttcccacacctcaagattgtacgtgtaatctcccagattttcttgcaagatgtttactgtttcgctttttatatgcattgcttcaattatctgctaattacttttgtcatatggcatgagagagggatttgtctagttttatttccatccagatcaatagcctattgtgatggcaccttttgccactgatttgaatcaacacattcatcatataaagttctcatatatattagcatatatttctggattcattaggctgtttcactaatctactattatcttgctatgccagtaccatagtgatttgattacagtgagcctatgatatcttctgatatctggtgggtgaaagcaatcctcactattctttttgtacctttcttagctattcttagacactttattcttccacataaaactgttaagatatttttcaaattaaaaagatccaagccctgttgtgattctaactgcaatttcattaaactcagaccttaattttattaatgtaataaatttaaatatttttcttattacatttatctctgtgtattttataagtgtgatgctattgttaataagatagttttctcctatttccatttatgagtgcttagtaccaaatagagataagctattggtttgtgtattttcagctttttcttttgagcctgggtctcattttgtcacccaggctggagtgcagtggggtgatctcaccttactgcagcctcaacctcctggattcaagcaattctcctgtatatcagccccccaagtagctgggactacaggagcaggccaccatgcccggaaaatttttgtatattttttagagatgggtttttgccatgttacccaggctggttttcaactcctgagctcaagcattccccccacctcagcctcccaaagagctaggattacaggtttgagccaccgcacccagccattgtatattcatcttaaatctagctaccttaccaaatttgcctattaattctagtaattttaccctaaagtctctgtgagtattgaatcatatcataagttaaatgagacagattttagctcatttccaatatttatagccagttatttcattttcttatcttattgaatttattagaaaacaagagcaaatgttaaataataacaatgaaagtgaacattccttctactctatgattttacttgaaataatttttgtattttgctatttagagtaacatttgctgttttggtttttgtaaatggtgtttattctattctcatttgccacaaaatgtttatcataaataagttttcagcagctggtatcatctgaattgtcttctttgatatgctgatgaacaaattatgttcatagatgtcctgacactaaatacccttacattcttggagtaaaatctactattcatggaatttgatcattagtgggttctatgtactatttctttagactattcttagtagattttcactactcaacctactaataataataaacaaagttttgttggctttatcaaatgaattgatgagtactccatctttttctattgcttagaatagcttaagtaacatttgaattatccattgtctaaaagttaggtgagactcacttatgaatccatttggtcctagtggcatttgcaatatctttaatcacccctccaggctcttctatgataatcagtcaattcaagtttcaacttccaataattatatacctttctaggaagtaactttatttattttttcaattttgttgccacagtgttgcatgtagcactcactcatgattcttttactccacattatctgtagttatgtgccctttcttattcctaaattcctctatctttgctatttatctttttttccttgaataagcttgccaatgacttgtctattttgttgctggtggtgctcttttcaaagaatgggcttttggattttttttttttctagttggtataaagcatttttattttcactgagcagaaaaagaagctattgattcattaactgtgctgctttattggcatgtagctatgcactgttcacacattaatatataaaactcgtcagtctgttttattttgtctgatgggaaaacatgaacagtgagatttcttatgcaaaaagtgaacagttcaactatgctagctccatatacctttattaacattccagagacttatcctctcaacatgatctgatttctgtaggataacttttcaggaaaagtattttctgatcagtgaagcttggagatataaataagcaatcggccaggtatggtggttcatgcctgtaatcccagcactttgggaggccgaggcaggcagatcacctgaggtcaggagtttgacaccagcctagccaacatggcaaaactccgtgtctaccaaaaaaaaaaaaaaaattagctgggcatggtggtgctcacctgtaatcccagctactgaggaggctgaggcaggagaattgcttgaacctaggaggcggaggtggcagtgagctaagattgtgctcagcctaggtgacagagtgagactccatttcaaaaaataaaaaaataaaaaaaagcagtatctctcatattcattaactggaccctgactttcttaaagctcaccccaaagctgaagtccatgaaggcactagttctcaaacttcagtgtgcataagaatcactcgggaagcttattaaaatttacattcctaggccccatcctcagcaaactatttagtccccaggtaattctatcccaccccaccccagctttattgtggtataattgacaaataaaagttgtatatatttaaggtgtacaagataatgttttgatgtaagtatacattgtaaaatggtatagcatgaagggttttcttttcatttttttcagaatagtttgtaatatcttctttgatttcatctttgataatctagacgtatgattttaattgctttttaaatttgtttatcaagttagtttgtagtatttgggtcaacattgaatatcctgttaatttcctattgctgtgtaacaaactacatcaaatgtatcagcttatgacagacccatttactgtctcacagtttctgtgagttagaagtccaggtggactcagctggatactctgtgcagggtcatacaaggccaacaccaaggttttaatagggctgcactccttagtgaaagctcttggggagaatctgcttacaggctcatttggaatgttagcaaattcagttccttctctcactttccatgtagtgccctctaccagcaatggtgcatcaacactctctcatgcttggaattgctctgacttcaattttccgtgcatatctctggccttttttgcctctctcttttacttttaaggactcatgtgattacattgggccgacctgggtaattcagaatactctccccatctcaaggtcagctaatcagccccttaattccatctgcaaagtttaatttgccacataatatatttttggacatgacaccaaggagcaaaggtgatgtgggccaaatttttacctgccacaggtatagtttacatacaatgaagctcatcaattttaaatatgcagtttgatgagttttgacaaatgcatacacttgcataaccaccaccctaatcaacatgcatttacatcaaccctcctgcaactttttaatgagtctctcccactgacctggcctcagccaataaactgctatctggaagttacagatttgttttcacatgttctagaattttacatcagtggaatcatacggtatgtattcttctatggctttttttcttcagcatcatgatttggaaattcatgcaggttgttgtataaagtatttctatcctttttattgctgattactgctccattatgggattatatcataattttggattatttccagttaggagcaaatacaaataaacctgctatgaacagtgctccacatgttttgtgtgaacatctattttcatttatcttagttaaatatctaggagtggaattgctggatcatatggtaagtgcatgtttaagagaaactgccagacagatttcttgaacgtaccattctatactcccaccagcaatgcatgagagttccagttgcaatatatcctggacaacatttgatgttgccagtacttaatgactgcacagtggtatctcactatacttttttttttttttgagatggaatctcatcccatcacacaggctggagtgcagtggcgcaatctcagctcaacatctgcctcctaggctcaagcaattctcatgcctcagcctcctgagtagctaggactatggtcacacgccaccgtgcccagctaatttttgtatttttggtagagacggggttttgccatgttggccaggctggtctcaaactcctggcctcaagtgatccacccgcctcggcctcccaaaatgttgggattacggcttgagccactgcacctggttatacttttaatttgcgtgtctctgatgactaaagatgttgagcatctttgcatgtgctaattagccattcctatatcttcttggaagtgtctattcaaatcattggtcctttgtttttaaacgtagtttcaacttttattttagactgaggaggtacatgtgcaggtttgttacatgagtatgttgcatggtgctgaagtttgggttacgaatgaatgatcctgtcactgaagtagtgaacatagtacccaataggtggtttttcactccttgctacccttcctcctccctctttcctctagtcgtctccagtgtctattattctatgtccatgtgttctcatcatttagctcccacttctaagtgagaacatatggtatttggttttcagttcctgtgttaattcacttaggataatggtttgccagtttttaattgggttgtttgtcttgttattgttgagttttgataattttttatatattctgggtacaagactattcagaggtacctgttttgaatgtttttttccaatctatggcttgcattttcattttccaaatggtgtctttcaaatagtggaaatttatagttgtagttaagtccaatttagcttttcttcttctatgattcatgcttttttttcccctgtcctaggaaatctttgcccacctcaagttcacaaagcctttcttctgttttcttctagaacttttatcattttagcattagtatttaggtttataatacattttgagttaaattttctgtatggtgtgacttttctttctctattgaattcccttggtgcctttgtagaaaattaaatgactgtatataggcaaatctgtttatggattctctagttccatagatgtgtatatctgtgcttatgccagtaccagattgttttgattgttgtaactttatagtaagtcttaatatcaggcagtctaaaacctccaacttacttttttattgaaattgcttttgatatatttaggcttttatatttctgtattaattttatagtcaactagccaactccaccaaatagccaactgggattttgactggaattgaattgaatctgtagatcaatttggggagaattgacatttaaacaatactgaatctttcaatacaacaacatggtatggctttgtttctttaaattttctttaatttccctctaggatattttgtagcctacagagtagttcttgcaagaattatattaattgtatccccaagtattttgagggattcgatgctattgttaattgtatcatttttatttgttttcgttttccaatcatttgttactaaaatatagaaattcaattgatttttgtatattgaccttgttcactctaatcttgttaatttgcattttagctctagtagcgttttgcacttcttttagaatttctacatatacaataatgttgtctgcaaataaagacagtttgcttcttcctttccaaactggatgctttttattttttttttcatgccttactgtactggcaagggcctccagtacaatgttagatagaactgatgatagcagaatccttgtcttcttcctgatttcagagggaaaatattcattattttaccattaagtacaattacttgtaaattttttcatagatgccctttgtcaaattgaggaagtttccttctattcttggtgtgagagtttttatcaagatttgatattagattttgtcaaatgctttttctgcatctattcaaatggtcatatggtttatcttgtttattctgttatggtgaattaccttgattgattttttaatgaggaactagctatgtattcccagggaaaaaatccacctggttgtgacatattacattggtaatattttcgctatggactgaattgtctccacctccccccaccccaaattcatatgttgaagtcctaactctcaagatgattatatttggagatagggcttttaggaggtaaacaaggttaaatgaggccataaggatggagtcctaatctgataggactggtggcctcataagaagagagaaggttctctctctacactcatgcactgaggaaaagccatgtgaacatacagcgagaaggcagccatctaccagctgggaagagggctccactagaaactgaccgtgctggcaccctgatattggatttccagcctccggaactgtgagaaaataagtttctgttgtttaagtcacccaatctctagtattttgttatggcagccctggccaactaaaactgttttgttaagggttttggtggtgatggtggttttttagtttttgcgtctgtgttcatgatggatatttggctgtgattttcttataatgtcattgtctggttttgatataagagtggtattagtccgttctaatgctgctatgaggacatacccgagactgggtaatttataaaggaaagagatttaatggactcacagttccacatggctggggaggcctcacaatcatggtggaaggcaaaggaggagcaaagacacatcttatatggcatggtggcagacaagagagcattgtacaggagaactgccctttataaaaccatcagccctcatgagacttattcactataatgtgaacagcatgggaaaaccccactgccatgattcaattacctcccacctggtccctctcacagcacatggggattgtgggagctacaattcaagatgagatttaggtggggacacagccaaaccatatcaaagagtaagactattctttttttttttttttttttttttgagacggagtctcgctctgtcacccaggctggagtgcagtggtgcgatctcggctcactgcaagctccgcctcccgggttcacgccattctcctgcctcagcctcccgagtagctgggacgacaggcgcccgccaccacgcctggctaattttttatactgatagtagagacggggtttcaccgtgttagccaggatagtctcgatctcctgacctcatgatccgcccacctcggcctcccaaagtgctgggattacaagcgtgagccaccgcgcccggctgactattcttataaaatgagttgagacgtgttcactcttctatttaatgaaagagtttgtgtagaattggtatcatttcttttttaaatgtttattcaccagggaaatcatcttatcccagtgttttttgttttggtttggttttttttttaagggtcttaattgtgaattctatttttaataggtaaagggctatttgaattttctatttcttataggataaattttaataatttcttttaagaaattccatttgagactgggcatggtggctcacacctgtaaccccaacactttgggaggaggcagcaggattgctctaggccaggagtttgagatcagcctgggcaacataacaagacttgacttctacagaattttttttcattagccaagtgtggtaacatatgcctgtagtcccagctacttggaaggctgaggcaggaggatcacttgagcccaagagttcaaggctgcaattaactatggatcatgctactgcactccagcctgagcaacaaagcaaggctctgtctcaaaaaaagaaaagaaattccatctgagctgttgaatttaatagtataaagttcagaatatttccttaccattttttcactccttggaggtatgatttacatactgtaaaaatcacttattttcagtgtggagattcttttcctttcctaaatctccacatttttattgacatatactttacatatcataaaattcaccatttgaaagtgtacaattcagtggtttttagtgaatccgtaaagtgtacaactatcatctttatttaattccagaatattttcatcacctcaaaaagaaaccctgtaatcattaaacagtcacttctaattttcttcctttccccagcccctggcaaccattaacctactttccgtcactgtggttttgcctattctggatatttcatgtaaatgaagggataaaatatgtggccttttgtgtctagcatcttttgcttagcatgttttcaagattcttccatttttgcagaatgatagaggagttaaaataagaaaataaagatatagtaagaatgaaactattttcattttttaatttaaaaaaatcttccatgttgtagtatgtatcagaatttaactcctttttatggctgaataatactccattgtatggatagaccacattttgtttatccattcatctgttgatggacttttggattgtttccccttttggctattatgaataatgctgctatagaacattcatgtacaagtctttgtgtacatatgcttttatttctcttcggaatatacttaggaatataattgctaggtcacatggtaattctatgtttaacttttagaggaactgccagactttttcaaagcagctgcaccattttacattttcactaccaaagtatgagtgttccaatttttccatattcttatcaacacttgttactgtctgtctttttaattatactcatcctagtgtggataaagtgatatctcattgtagtttggatttgcatttccctgatgacttacgttgttgagagtcttttcatgtgtttattgaccatttgtgtatctcctttggagaaatgtctatttaaatgctttgcgtgtttttaattggattatttgttttttagtactgagttgtataagttctttatttattcttaatattatacccttatcagagctatgacatgaaaatattttttcccattctgtgggtagtattttcactttcctaatagtatcctgtgatgcacaaagtttttcattttgatgaaatccaatatttatttattttacccctttggttgcttgtatttttgttgtcatatctaagaaatcaatgtcaaatcaaagatcactaagatttaaacctatattttcttttgagacttttatagttttagttcttacattgaggtcattgatccacttggagttaattttggtatatggtgtgaggaggggatccaagttcgttctacagcctatatagcctgcagatgagcaatgttagtgaccttgaaagtagaggcccaggttgtcagtagcctggcatctaactaaacaaccatttatccattaaagttagccctgttaacaattaatattgagataattttacttaatacactgtgtatattagtgtccatctagcatgcagcctgaggcacagagaataatagtttgagtataaaattgaattgaatggaatacatcattaatttattatctagctttctgttattgtataggcagtcacatgtatttaccagaaaaaagttgatagaatttttattttaatgaaacccttttatactttagattattttgatgctgattaacaggataagctgactctggacacatcctgacagcctctgccaaggtttgaaataaacagctgggaaaattcagttttatattatctgttcccgcagctgctcagtttcttctaaccacaggtcagggaatataataggttttccgattagttttagataaaatgtgaaagaacagttcatgtcaaggacaatggttgccaaatatatttggcaggatttctatattgaatcccaaaggaaatacacaaacaaaaccccacaaaagttaggaaggagtaaaacccaggaaccctggaacattttgtcatttactatgcagatttgcctgaaagtgagacaggcaaataaatcacatgtttctgccagcgtggaaaatattcactcaaatggcaaaggtctcaggctggggagctggatattgtcctgtaataggttcatctcagaactgaatcacacacttggagggtgttaatgctcttaggaacatctagttattccctttgaatagagtcctgtcctgaatcacatatacttgacctagggcctaggcctttttgtttttctgtctcacaatcttgtttctccatcaattatgtgttttcactcttccctcagagagggaaaaagtgtttctgtgtgctcttgatcctgttccctctctgatcttccaatctattgctctataacatattttatatgtgtcttatatcttcattttagtcagaaacatttatttatttatttatttatttattttttgagacagagtctaactctatcccccaggctggagtgcagtggcatgatctcggctcactgcaacctctgcctcccgtgttcaagcgattctcctgcctcagcctcctgagtagctggcattacaggcatgccccaccacgcccagctaatttttgtatttttagtagacagggtttcttcatgttggcccggctggtgtcgaactcctgacctcaggtgatcctcccgcctcggcctcccaaagtgctgggattacagatgtgagccattgggtctggcctttaatcagaaacatttaaagtgaaagcactgtggtaacttatgttgaaataccttagaaatcaatggaaactgcacagagagggggtaggatagacgtagtggaaccaaggatatgatatggaaaaaggagaaaggtagcaaactagggatgagttggtgaatgtggaagggcataataatgttaaatgactgaaaactacataggcttatgttaagactagtgccatggaaatttttagaggtagatgacattagagtatgtttaaatataaattaatgttcttgcagtgagccgagattgcgccactgcagtccgcagtccggcctgggcgacagagcgagactccgtctcaaaaaaaaaaaaaaaaaaattaatgttactggttgtgttccctagatgtagactctgagatgaagattaacatgcaggaattttatttggagtgttcttgggatcaacacctgaggaatcagggataggcagagggagaagcgcgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccaatggctgggactggggagttctttcctagactgccatccgggcgcccctcaccctcttgctgctcagctccaggtcgtcgtgggttcagggctcagctgcacgctcctgcccgcgccctgggcgtgatggcacccccagcccctgccattcttccccctcaccccctctccctgccactgctctgcattgccctgggttagcctggcggggccaggtggcacccgccgtatactcttgcctttctgctgcaggggcctttctgctgcgggtcccagagctgcagggaggggcggcagagactccccacgtggctcattggcgggggtgctaatcagagttcttttgctgccactctttgattcccaaaccccatgtaatcttcttagtggggacacagaatcatctttgaattcatacatatacagcaccttggaggctggccctccatcctcacagagacctgcctccaagctggagttctacctgtgcctggttgtggacccactccctcatctcttttgctgtacaatgattccccaggtctacacggtgctatatggaattccacatcagtgaatcaaatcctctgtaagatttcagatagtggtgctggctaaggccctgaagggaggaaaggctaagttacgccaagattaggtatcacaatgaagtcctgtcctttctaggatggaaggagttcagtgtgtctggccaccgagaagctggtttgtctctgtgatggacaataccatattgcagcaatccccaacctttttggcaccagggactggtttcgtggaagataatttttccagagactttggggttgttgggaatggttacggcatgaaactgtccgcctcagatcatgcggcattagttaggttctcataaggagcacaaaacctagatcccttgcatatgcagttcacagtagcattcgcactcctatgagaatctaatgcagcagctgatctcacaggaggcagagcccaggcggtaatgcaagtgatggggagccgctgtaaatacagatgaagctttgctccctgcctgctgctcacttcctgctatgtgaccccattcctaacaggccacagaccagtactggtcaggggcccaggggttgggcccaatatggcatattgggagctcagcattgatttttgttgctggcaggttggactttggtggcaacagtagctagatcagccttagtcagtgggaagccacgcttttgggtccatgcattaattctctccctgctgctgtagccacttagctcatgtcttgccagtactgcgatggcctatgcagaggctagctgatgtgaattgccagagtcatttttatatgtgttgttggtttgtgcttccttcaagatggatgctttctgttggcattaacgtattacttggagatttttctagtttgtgtccactcactaatatgcctttgtcccaacttttttctggaagagcttccttatcagtacgctgggccctggccctcagccagtacagaaagtcatttgtcaaggccttcagttggcagacgtgctccctggactacgtgctttctcgggtgtcccagaaaccctggaatggagtgaaatgcagggctacgtgggagagcagggaggcaagaattaagtcggccccacctttgcccaactcagtgggtctccttgagagaggtctgcagtttcaaggagacttttcagccaatctgctgcgagatcctgtgaaggggtgtgaaggtcttcctctgtgactatagattggccagtctctccttgtgtgtccaacagttttcattatactttatgtgaattaatgcaaaactgctaggtttaaactgctcaccattttagggatcccttctggattttaccttccttaaggggaaattttcctcctttcctcagttcatcctttctgccttggctttgacgtggtctggaggccacagagcctcctcctgagaacctctctctggtgtgtctgtttgtgtccgtccctctcctttcgatcattccctgtggttcctgttgggcgcggctcccataaacgcacagagcagggtctgctttgtctgcaacctgatgcattgttatttctcaccaaaacttgcagtccaaacatcacatttccgggccacactctttgtcagagctccaggggcacaaccccggggacctgctggaaggtgccaccgtgacgtgtgcctagatgcgttttccctcagttaccacagcgttcctctggttctggtggctggagggtgaccgcgtgcttcatgaagggggtccttactgcttcgcatccacccttttcacggaaagcactttgtcacatgttttcagtgtttctaagcgattttctgccaatcttgtgtgctaagattgtgtggcagcgtttccacagatttatagctggcaatgaattctcccaaaggaaatcagacaaaataaaatgtttccaacattgttcacatactgacaacttatgtgcttccttgggtgattttacaactttttaagcacatgaataaaaattattgtctgcttttttctccttttttctctcttttttttcttgcatgcagaaagtttataggagggggatcctctggatcaacacccatgggggagtgaaggaagcaggattgggtaaaagaagttgaggtgatacagtctgaataaaggtcagtcccacagggagctcaagctaggatggctctgcagagatgttctctattgaggcaagttgtctggacctatatagtcccacctttaccaggaataaggcatgagtttggatgtggtgactgacttcagccaaaattggttctcagagaggaattcagattagagttgtcagctgtcagcacacccagcagcttaggaaataagtgctttagtcctgaagcggtgaatctggacaccagcctccactgtggtccaccctttctgctgctcagattcatttgcttcataagttctggaatggttccttcaggattctgatgggctccctttcctggggaaacaaaagagaaaggtttggaacacagcacaactcctgctgctttagcttttcttgagtctgcaactggtactcatcatcttccccttctactacccattctagatccctccccccaccaccctctcaattcatacttctgctgctccaagtgggttaccagataaggtatctggtcatcatgccctttgtaagccatgactgtacttgtccatttatcatcaacattgaacaagggaatactaagagatacccaggcagatgacctggctgccaaatatattctcctctgtctccattgtgtaatgtcagcccttcctcctgatgatcaggatcggttacgcttgccaggatagtgactcttttccttacctcttggtctcttaatagtgatctgaagtaatatgatggcaaccatagtttcaagtttaatgagactcttggtgtgtccactggcggacatattccccttttaagaaccagtacttctaaactctcagagcccagagttgggataagaggcatagtttccctaattgggtcactgggagtaatggtagtgtgaggctgctcctacttacactccttgttttccaaaaccatatattttacttcgggacacaccccactaaacgatggccattgatctagagtatatactgcatcctgcaggatggtgcctcgtccttaggtattatgtctaagctagtgcctcagctgtgccttcaacaagctgtcctaccactctatcaagtgggtagcttctgggtagtggattccatggtcatgtatcttcttgctttaaagtaggtctcttggtctgatgcagtgttatgtaagatcaaatattctgtgaggccttgaatggtggtgtttactgaggctcaccaagcaactgaatgattttcttgagaaatggtgacatatcagagccttagctttggtctctgttactggcaagttgaacattaacaacatcagtagctagatctgtattgatgagtccatgatgttgggcccatgcatagcctctgccatggctcctcctttcatacatccattttgtaagaattggggcaccaacagcagagactggtaagcatcaaagtggctaagtcattcagtctacttggttgtttagtgctgtttctgtggctgatgttcttttcatttattcattctgtaatgcgtatcctttgtagattcaatttccttctctctgaacaacttctttggatatttattgaaaggcaggtctactgtcaataaattccttaatttttattgtctgagaaagtttttatttctccttcatttttgaaggatactttcacagagttcagaattttaggttgactgttttttctttctctcaacactttaaatatgtcagtgcactctcttcttgtttgcatggtttctgaggcgaagttggatgtaatttttatctttgctcctctatggataaagtgtttttccccatctggtttcttacaacattttttgtctttgattttctggagtttgaatataatatgcctaggtgtagggtttttttatttgtttgctcgtttgcatctatctttttttttttttttttttttttgagacagaatctcgccctgtcacccaggctggagtgcagtggcgcgaactcggctcactgcaagctccacctcttgggttcacgccattctcctgcctcagcctcctgaatagctgggactacaggcacccgccaccacagctggctaattttttttgtattttttagtaaagatggggtttcaccatgttagccaggatggtctcgatctcctgacctcgtgatctgcccgcctcggcctcccaaagtgctgggattacaggcgtgagccaccgcgcccagctgcatccatcttctttggtattctctgagcttcctgaatctgtggtatggtgtctggtgtctgacattaatttgggggaaattctcagtcattattgctttaaaaatttgctcctattcatttctgcattcttcttctggcatttccattatgtgtatgttacaacttttgtagttgttgttccacagtttttggacattctgggcccatgcatagcctctgccgttgttgttggtgtttttttttttttcagtctttttttctctttgcttttcagttttgattggaagtttctattgtcatgtcctcaagctcagagattctttcctcagccatgtctcatcaaccaatgagcccatcaaagacattcttcatctctgttacagtgttttgatctctagcatttcttttttattctgtcttagaatttccatatttttccttatgatatacatctgtcattgcatgttgtctactttttacattaaagccattagcatattaatcatagtttaaaaaattcctggtctgataattatgacattcctgccatatttgactctgattctgatgcttgcttgttcagtctcttcaaattttgtgggttttgccctttagtgtgccttgtaatttcttgttaaaaggtggacatgatgtactggctatgaggaactacagtaaataggcccatagtgatgtggtgagatggaaagaaagaaaagatgctcaacatcactaatcattagagaaatataaatcaaaactacaaagagatactgcctcacacccattaggatggctactatcaaaactaaaacagaaaataatgaatgttggtgaggatgtggagaaattggaacccttgtgcactattgcaaatgtacaatagggcagtttctctaaaaattaaacagaattaccatatgatccagcaactcgacttctggctatatatgcaaaagaactgaaatggggtcttaaagagatatttatacatcaattgtattagggttctccaatgaaacagatccgtgtgtgtgtgtgtgtgtgtgtgtgtgtgtgtgtaaatatatgccaatggtaaaagtacagggtctgagtcagaaggcagaaccaagaatgcttatgtccaagggcaggagaagacagatgtcccagttcaaacagggagagtgaatttgcccttcctctgtctttttgttctattcaggccctcagtggaatggataatgcccacccacattggtgagagtgatcttctttaccaattcacatgctattctcttctggaaacatcatcacagacatacctagaaatactgttttgccatgtatctgggcatctcttagcccagtcaagttgacatataaaattaaccatcatatccatgtttataagcagcattattcacaatagctaaaatgtggaagtactgcaagtgtctattgacagatgaatggataatctaaatgtggtatatacacacaaagcattacgaaagaaggaaattctgacacatgctacgacatagatgaaccttgagtatattacgctaagtgaaataagccagtcatgaaaagacaaatgctgtatgattccacttatattgggtacttagagtagtcaaaatgatacagaaagtagaatggtggatgccagagactggaggaggtgagagttattgtttaatgtttatacagtttcagtttacaacataaaattaattctggaggtagatgggagcatattacacgttttctttttggagatgggatctcactctgttgcccaggctggagtgcagttttgtgatcatagctcactgcagccttaactgtctgggctcaagtgatcctcccaccccaggcaccaaagcagctaagaccacaggtgcacaccaccacgcctggctaattattattatttgtagaggccaggtactgctgtgttgcccaggctggtgttgaacccctgggctcaagtgatcatcctgccctggcctcccaaagtactgggattacaggtgtgtgccaccacacctggccagaatatttaatgctactgaactgtatatttaaacatgcttgggctgggcatggtgcctcatgcctataatcccagcactttgggaagccaaggagggtggattgcttgagcccaggagtgtgacaccagcctgggcaacatggtgaaaccctgtctctacaaaaacattaaccgggcatggtggcacacgcctgtagtcccacctactctggcggctgaggcgggaggatcactcgaacccgggaggtggatctcgccactgcactccagcctgagcaacagagtgagaccctgtcaaaaaaaaaaaaaaaaaaaaaagatttacgatagtaaattttatgtgtattttaccacaattattaaaattgaagaaaatccccatgggtcactggtttaccaatttagccattttcaccatttttagattgcattttccttctctatctcagcattctgactaaaggaaaagcaaaatttcttacaagaatgaatgattctccagtgtggctgctcctgaaaggaacaatgagacttttgttatttcaccacaagactgagaaagaaataaacaagtgataaatgcccagaccccttcttattcattccacatcctggtaatctgaggcatggtgtggcttttactccaagcatatgaatacttacaatcagaagctgcctctcctttccctcactttatcattattgccatcatttatgacaatggagggagtgtctcactggatgatatttggggttctttcttcagtggtccgccataccaagcatttatttgtgctgttctccatctttcacatctaccacttttcaaaagtccctgagagtcaataagacatgcgactcgaacaactgcttcacatctaagtgtatgtctttaaaaatctctccttttccatgtttatgtctgatgtgttttgttatggcaaagtggcatgtagtatacggttcataagtgaatcgatgtatatctgtggagggcaaatgctcaattttagatctacacatgaaagcttttttccagggcaggagccttgctttctccaactaagccttaattacccaaatgcccatgtgttgtgcctttggcttgttgaaatgataccaactggtaaaatctgatgggagataaaagttagatgtccagaagcataaaagtcaggaagagaggctctttatggcatagagaaagctgcagaactgctccatggtgtgcaaaactcatcagcacatgaaactagtgagtggagatagtcaccttcaaccactttgtaatttctaccaattcacttggggccagtgtcccttattcaccaagattcacattggtccttttgattatttggcgtgaggaggcccccagacatgctaaactgtcatgcagggagagaggaaaagttgggaaccagcctttgcttaaaagggctttgacaatggaggcaaataataacattttgggaacatttatataagtaattatataatttctgattcagtagctggttcatgaataaatgagtaattgggagtatctgagtggagacaagaatgaacattaatgtaggactgattctgaattacagcttctggcactagtaggtttcaatatacatagtctgctgaaaggtaattttctctgtgatattcctggtatccctaaggagggaagtataattttaggtacatactgacaaaatttgaacacaaggtacttagatgaaagttatagtctgttttagagatgaaattgaaggatgcagtagctattgctttggcaaaggatttttggctgatgcagtgtatggttattgattttatgattcttatcatatggcacctaatgtatcagttgagttgtgaaaacagtgtttcggtttaatggatgttagggatttatatacaacttcaaatttgcctccttgctaatagtagaaaagagtagtatggaagcattacttccagctgctttttgaagtgtccaccaaaatgaacgactttttcctttcttcacgcagatttcctcctagagtgccaaaatcttttccattcaacacctcagtcgtgtacaaaaagactctgtttgtagaattcacggatcaccttttcaacatcgctaagccaaggccaccctggatgggtaatgaaaacaatgttgaatgctatttatgaaattgggtatcttattttctatcacagattccccaatcttgaggttgcagttaaaaagtgcagctgccaaagagaatgtttccctaactgctacctatagggaaatacactgactgcattttctgtctttttgctgggccgtcttcctctgcttggtctatgccaactgcttacctccacttagatgtcaaataaagtatgtaacaacatgttatgacaggacattttctgtcttagaattgttgctgagaattataggtgggaagtatccccttattctaaagagagatatcagcctatcgatttagaacttgttcaggtagtagtccaaaattggttctgcaacccttaggccctgactcacctccaaccttgtataaaaaaaggctaggaacttatggaagactttagatttgaatatttattatttggagagcctcttcggtgttttatgtgttgcttaccccatggggagtgggaggcctgtccctcatgtcaaggtataatgaaggaggcttcaggagaaccacttagaagactggacaaggtacctatggaacttgggagacactgaccactgcctggtttttatctggataaattttcaaggtcagaggccaaaaggacttctcctgatggaatagcagggggagtgggcaatagtgggagctaactgcactaccattgttaggtgtaaggccaggaaggtcactgaatgggacttgtcttacaaagactctgcctgagaggtcttcctgccaggattagataaccccaatagaaaaagcctgtatgggttgtactgccagaagcagaatctgagaggagagatacaagtgaccagctggagaaggtatatcccatgccaagatcaggagcagtggggtgtctccttgttggcagggagaggtctccaaataactcataagttccctaagaaagaaaggcagaattttggtatgtgtcacaactagggagtactaatgccacattatcactgctccttccaagaaagactttgtcattgtgcctatttgtttttaccctcccccctcctttccacttgctcctaccttggcaggtccagagacacaaaggtgagttggggaggaagattaggagaggaaggtgggaaagcagcgaagctgccaaaacaaattacctttacatattgcagatttctggggctgtcagaatgtagctggagaaggaagggaacttgcaattgcagaagacatcaaaaatttggtattagactggactggacttgttagaacctaagagtgatactgttggttaatacctgaaggttactggaaaagatttgggatcaaccaaagtgcaagaaaagggagatctcacataaagtaattaaaagcagtggtctaagaaaaataaggctattttatgtttttatcccactcaatccagttcattcaacagactgtttataggcattttatacttagtgtattcataaaacagagctcttaattttcctcctgattttctgtcatggcctgactaacaacccagttgcacaagccaaaatcataggagttttctttgactcctctctttttttctatctccacatcatatttatgagcaagtcctgttgactgttcctccaaaacaagttccaagtcttcttattttacttcttgtaaaatccaaattcatccaaattcctgtggcctgcaaggtcctacatgttatgtttcctttttgaccatattttctgttactcctctgctgattcactgtgcttcagccacactttacttgactataccaaacttatttctgcctctggacgtttgcatttgttttatctgttttcaatgctcttccactagatctttgaaaatcttgcttctttttcattagtcagatctctactcaaatgtcacctcctcagagaggcccttcctgactactacactgaaagtatcctctacctcctgcctcatcactttctagcagaccactatcttttatatttataacaacttgaaattttcttatttatttctttatgtgcttaatgtcttgagaatatgatctccattatctgtcttgtttgctactgcacctccagtgcataagacagttcctagaatatagtaggaactctagttgaatgaatgaatgaattgaatgattgccagaaatcttgcctcagagcaaccataaggttaggctgatgttggcagcaagcaaatactactttttgtcagtaattacaggggcatgcttctccactgtgaccttgactctaacttttggaataacaggttttctggagtactatccccaagtaacctttggcggacatctcattcttacaggtctgctaggtcctaccatccaggctgaggtttatgatacagtggtcattacacttaagaacatggcttcccatcctgtcagtcttcatgctgttggtgtatcctactggaaagcttctgagggtgagtaaaataccctcctattgtcctgtcattctatgaatagaacagtgagatgtgtgtgctttgtaatggtggcgttacaactcttttaaggtcctaactgaacattatgtgtatttcttaacatttactagattataaatatctcaagatagggaaatccatcttatttattgctgtgtccttagcatataacatattgcctaccctatagtagatactcaatacaagaatgagggtgtagtggacaccagtcattttttcttcctaaaattaaacatttctcacctgtataccccctaggaattgcttttctgaatatacttcaaacagaacctgccattttcttaaagcccatgcctccctagccatagcagttgatctaggagtgagcagttgacacgggtatcccacctccttggccacagttgattggtccagagatgggcaccttacccaagctaggccaatgagagtacttgcactagcattttgaaatttatgagaaaaaggacctattattaccaggtaatcctatacttaggggatggagcccaaatataataaaatcaagattctactacttcatgtatatcatgtgggccatggatcttataggagtcttaagggggtgttggtcttgtccttttcttagttgcctagctctttgcaggcatggtgcaaaggcaggacaatctacctttatctgctccttctataccactgatcctaccctaaacatgtagctgtataatcagagacaggaagccatggcaaatctggagggtctcggcttggctatatcttaaagagttacatgtattcgtagttcaacattggggaaattttccaaaaattggtggagaaacgagtggccaatgcaattttatctttttttttctgctgacatcagggagagataagagctttaaaatcacaattatggggagataatattttaaaatccagctcaagttaaacccatcagaaaaggtaacaccttttgggacccccaaatggccacatcttatccaatgaggggacaccaaccatagagtctatactgcacagttcaaatggtagccatgagctatcaggcacttgaaatgtggtgagtcctacttgagacatactgtaaaatatacaccagatttcaaaggttaagtacaaaaaagactaaaaatatctcattcattgtttataagtacaagttgaaatgcttatatttggatatactaggttaaacgaaatacattattaaaataatttcacctgtttctttttacttttcttaatgtgactaccagaaaatttaaaattacatatgtggtttgcattatatttctattgaacagtgaaatgtttagcatatgttgaagttgctgctcctgatgcagtggctcatctcagatttggccaagttcttctgtccaaggaaaactaggttcaacccattcctggagaggaacagactcaaatctttctgggctgggtcacttaccttggttaaatctgttctccacctattctaccaacaaccaaagggatggacatagctgaaataaaaatcacgcaatcacactgaatggtatctcacctcaggtgggccttcagcattgcctagccattctactgctacatttcccctaatccatttactctccctctccccaagacagctataatgtttcacacattgttagcctctcattgaacctccaacatgtgctcccgcccctgcccccaccacaacgtgagccttgggaaaaagggtatttttttcctaatgaaatatttcaaacaaagataaatacagaaaataatataacaaacaaacatgtgcccatcacctcactttgccaaatcttaacattttgtcatctttgcttaatttattttacaaaattaagcattttacatacagtctgtactcctctatggggctggcaggaaaaggctctcattgtcaaagttcaaagtaattgatcattgaaaaaataatgatcacattaaaaacaacacttatataatagagatacatattgtaatactcataaatgaaatgatatcctgtctaggattggcttcaaacacatccaagctgatgttacaatcattaggtgaattcctgatgtggaatttgacatttgtatggcgccaaaataatatcccagtgatttttttctgattgtaagtggaaatgttaactttagaatggaggtatcaggctaatccacaggtcagttttagtgtcactaaggatgggatggccagatattatctgcccctgatatggcacaatatgagggactcagcatcatctttgatatattttagccaaaaaacttatttaatttgaatctaatcagaacttaggcatattcaatagcatgggatattctacaggactacaagccaaatttctttcaccaaatgagtgtcagaaaaaaagggactactccatactaaaagagactatgggcctaaacaaccagatgcaatctgcagtcttaggttggattctgatttggaccaactagctacaaaggatgcctttgaggcaattaagaaaatttgaatattgcattgatattaggtgatattaactggatcaggtgtgctagtgtcattttgtttatgtgggcaatttttttttaaagatgacttctaaagtatataggagtggactatcatgaaatttgtaatgtacattaaaatgcatcatcataaaaagtgtgttgaaagaaaaaagtgaaagtagcagtgcaattctaagaataattttctaacatccactcacaaaaatattaaattctttatattaaacacatgaaaaagaacacaaatatatctgtctttcaagattcatctcaaattccacctccttcatcaagcattactgaagagtaggaagcttgtttactttttttatccactgtgttgctcgctccaagggcatagagacttctatcttgatctttatattttcagcttgtagctgagtctggtaaagaataagaactcaataaatatttgtgaataaataggtgaatatttccacatggtattataattatatctttatatgtctatgtcccccaccaaacatagtgttgtaccactaggaaagaacaaagtttaagaaattttcttaaatctctctttcttactgttccgtgaccctcactagtgcctaccaaagagtctgtgacaaagtgtatttgttgttgaattgaattaggcaaaaagatgcaataatggaagcaatttattatttaacagaatgtggagatatcaaccagaacctagtttttactgctcatgctagggttagtgatctcaagatcctctggagtatatgaagcttctccccatttgtggctgctgcttgttagtttttcaaattaagatgcagaaagtaggccgggtgtggtggttcgcgcctgtaatcccagcactttgggaggctgaggcgggtggatcacaaggtcaggagtttaagaccatcctgaccaacatgatgaaaccccatctctactaaaaatacaaaattagccgggcatggtggcacgtgcctgtaatcccagctgctggggagtctgaggcaggaaaatcacttgaacctgggaggcggacgttgctgtgagccgagatccagcctgggcaacagagtgagactccgtctcaaaacaacaacaacaacaacaacaaagatgcagaaagtccgtttcttatgtagaacctattggtgacaataaacttgacatgtttctttgagtgtacagtggatatagaaaggacaattttatttcttcctgctataggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaaggtaagtgtatgaaagcgtaggattgagatgaaataagcagagaagtacaaacaactgaatctatctataacagttagcatttgtgttccttcacctgaaagaggcttttttactctagcatcatgctcatggaaaggagaataatccagtttctgagagaagcagatatgcattctatataaccacaataaactctaagctgggatcaggaggagctgagttccagaattaaatctctctcctcaaagcattgctattttcctcttcaaatctgtgggctttatcagtagtgatttctactgtcctctgccttttgcaaactttgagctaggttccttgaaaacttcatggaggtaaacacatccaagtgtgtgatcaatggcatatagactggttcaggtggttagtttgtcatctgtaaaccaaaagtatataaaaatctaagaaaagtcagcatttatttatatgttactgaaaattaattaatttggattgaattaatatattctaaaataattctaatcaaacctgtttttaatttataccttagcataaattagggaagtaaattttgcataatttgtttttatcctattttttatggtgaaatcagcttcactgtaccttttccttgttccatttatcttttactgcataactccacaatttagtggcttaaaacaacaacagtctcttattatctctcatggtttctgtgagtctcatggaatttgtcagtgttttgacttggtggcctatctaagtgtgtctcatgaggctgtagtcaaacagtggctagagctgaaatcatcccaaaggtgactttattcacatgtctttgaccttggcttgatggtactctccacatgatctctctcacatgggttttacagggtagccagacttcttatatggtcctgagatagcccattagaagctgtttcacgatttctaatgtaaccttggaaatcactcacataacctacattctattagttagaatgcatcactaagaccagtctataaagggagactccaccttttgatggggaataggcaaagaatttattaacaggaatcaccatactctttctgaatggtgatgatgaatgtgattcaaaaaaaggatgggagcggggagtggagaagatgagaaaggtttgtagtttataatagtttcagatgaaagtatgatttctcatatactgagttcagtttcatagtcataattaatgagaaagtgccaaaaccacagtgtattatttatgggatgtaaaggctaatggaacaatgagatcatcaaaacattagtgtttacatatgacatataaagaaataagttaaaaacccaaatgattctttgacacagagttgaactaaagagtctacagaggttctagttccaggtgaaatggataaacacactccaccctttatttcccattgaacttaactataaaaccttgacaaaatgcaaagcccagatatttaaaaatttctaaaaagcaaatagaacaagtatatagagaaaagacactagaattgaaagtattaccaaacttgtgggggagtatacctttttccccactctagtattccttaacctgaattaaaacataactggagacttcgaagtgagtactatgttgcaaagagagctccaggacaaaccctctggggtttcaaggagtgagaaaggtaactctaaatgctcagagagcgtgggaggggaaatcccctagggtttttgtcctcttttccaccattctctcaagcttcagtcccaggttgcctgtggcaatgacagtggctggcaacagaaacctgccggagtaaaaacttagggaggggaacattattcttcattcagtacagctacagatctaagacattgggggaaaagcacattactttctctctgtctttccccttccattgcttgaccttagctatgatgtagttgtggaaattggaagcttctggttagaaaaccaaaaaagggagctcacagaactggaaagtttatagatgacagagagaaaagatcccaggaaagtaaacccataaagttgtgcattaactcctggattcacccccaacctacacatccaggtatgtagtttcagtgtcagatctgttttaaaccccttgcagtgccattgagtccaacgcagtggccagtctggtgcttgaggggaaatctcagtttcacagtcttcaacatgttccattagcctttacgtcccataaataacacactgtggttttggcactttctcattaattatgactatgaaactgaactcagtatatgagaaatcatactttcatctgaaactaacgcccacagaattccttaaaacatgtctgatggctgaaagcaaagatagaacattgtgagataggttttttaatgtatggtagatacaatacataaaagaatcatagcataacaagaggagggtaaggaaaactttatggtccattcaacttcattccaattcaaatggtaaaatgttgactctaagtagatgatagtgaaaggttaagtatgtattttgtaatccctagagcaaccaataaaaaattataccaagagacacagtaaaaagtcacaataaactaattacaatggtatatcaaaaatattcaaataactcaaaagaaggcaagtaaggagagatgaaaatcagagagaagaagcagtaaaatcataataaaatgataggcttaaatctaaacatatcaatacttacattaagtgcaaatggctaaaacacaccaattaaaaacagagattagcatactggatataaaagcttgaaccaattatatgttgtttacaagaaactcatttcaaaaaaatgatataggtaggttaccagcataaagatggaaaaggatatatgatgcaaacatgaatatgaagaaagttgaagtagtacaaatctgtaatcacaacattgatttttgccaggagtgccaaaaccattcaataggggaaagaatagtgtcttcaataaacagtgctgaaacaggtgaatatctgcatgcaaaatactgattgagtatcccttacctgaaatgcttggaaccaagaacgtttcagatttcagatactggaatatttgcacatatataatgagatagcttggggatggaacttaagtctgaatatgaaattcattttggatataaatcccttgccagttatgtgattggcaaatattttctcccactctatagtttgttttttcattcttttaatggtgtcttttataaagcaagagttatatggacaaacatatgaaaagatgttcaacatcattaaccattagggaaatgcaaattcaatcaacagtgatgtatctattagaatagctaaaataataatataaaattgccaagaatcctgtcaagaattcagagcaacagaaagtttcacaatgcacaatggtatagccattctggaaaacagaatggcagttttgctgcttggtagagaaacagtctctggcagtttcttgtgaaattagatgtacactatagagggatagcaggagggagttctttttggatattgaaatggatctgtatcttgacgatgatggggtttcatgagcttatatctttgttaaaagttatagacctatacaccaaaagaaaaagtcaatttcactataattgaaaatttatataaaagtaattagaatgttttaagacagctttatacgtattttaaatgtgtctctaaagtttttaatccagtacttctggtaaagatggcacagggtcttcctacttagccatttttccatcctccacctcaaccccaacctcgctgaaaaccaacaacaaagataggtaaaccataaatagagaaaatcgaataggcatggtcagctgaaaaagaagataaatatttgtggaccagaagcagaacaggaactgtgagtagtaaaaggggtggaaattacaggccaactgagatctgggtcaggaagccagctgcggtagccaaggagtcaggatgacaaggataaatagtgctccccaccagagggactgagagcccatatcatagagttgggctcttcttcacttgaaagagagctgagcacagctgctgctcactctttgtttagggccatggctttgtggaaactcagagtcctagaagaggggaaagcaaacccagtcctagaataggaactgaactaagttttcttggttcagtgggggaatctgcaatatccccaaggtttccattggccagtatctccaaaattccattctagggtatgatttgctagatagagaatagtgaacacatcctttgcttaatcaaccaatgatcacaagggacagcaaagatcactatagttcaacaaagtcagatttattggctcatggcaacaagagactgtggacacctccctaaacaaagggaaatactgtatagagttagtaaagaattttggggaagggtggaggttaggtgatatttaaatgaagcaaagtagagttgtgtgtaaagaaataaccatgaggtctagactgtgaagtgttctaaaaagttaacatagacatgaaaggttaagtcaaggcaccccttacctgaagcttgagctttaaattgagctgcttctttgtgtcaaagtaatttagatgacctaggaaagaatgagatgtttcattcttgttgctattagttcaaacatttctggcaggctgtgaattcagagaacaaacaactcaattgagtaagaaagcaagagataatcaaagcaaatagttggcattcagtgagtttatacagtggcaatgtgtccttgggagaaatggtgttgttaactctgcagttagctttatctatgtctcttatcccagcctgatgagtagcagcacacgtactgttgctttcttagtccaagctaatttttatttctaagcattaagggtgcgagagagagaaagaacggcaaaatgtcataaacaaaaatctttctactcaaaataagcctgtaaacaaaagtttccagtcaaatttaaaaaatatataattctaagaaagatagccaacaagctcaacagttaaagcatgaaacaagctagtttgttccattaaaaacttcagctatcgatatacacggtatttatttaaaatgtgagtataattagaagcactgtgggctattgaaaaaaaatcatgagtatagatgtttaatatggacaattgctattttactcaaaacttttaatttacaattgcagaagtataaaaagttacaagagtaacagaaattatctataatttcactattatcacacagtgtgtgagggcttgtattttgtaagtgtttttaatttttttctttagtaattcatttttatcatattttacacaagtagtggtcttcatcaaagttgaaataaaaaaattctttgctccagatagttttagaaacactgctataggagacctgacatcaaagccaagttatcaagagacagaagactacatttgttcttactgtcaagtaactgatgaagaactgtctcctcctagtgacaatttcctacaatgagattttttaaatagaagataaatgttctcacttctttttcagggagtctggccaaggaaaagacacagaccttgcacaaatttatactactttttgctgtatttgatgaaggttagtgagtcttaatctgaattttggattcctgaaagaaatcctctgctactattaagaggaggtgattatagaaagatcataaattacattactgttcaggaatgaaggagatggggttaaaaatgaattccaagaaaacaaaacgtaacctcagttccactggcagctatgaggtaagaagatagaggagctggataacggactggcctcatccccctcattaagactgtcaacaaatactttgggctctactttctaaatactttctcttatcttcatctattattaagtgcacaacctttggcaagttatttaacctctctgtgtctcggtttcctaaatggaaataatagtacatttttcataagattgttgtgagtgctgagtgatttcacttaagtaacctagagcactgtgtggcatagagtaggccctcaatagtgttagtacctccgcctcttcctcctcctcctaatgtaatcactatgtaatcatagtaacataatattcttcttgcccccttatcaatttacattgccatcttcttaattgaggccctcatgatctgtctcataactctcaaaggaagcttactgaagtgagtatctgatcttgtcactctagcctctacaatacttcagtttgccagtttcggtggctcatgcctgtaatcccagcactttaggaggctgaggtgggcagattgcttgagcccaggagtttgagaccagcctgggcaacagggcgaaaccacatctctacaaaagaattaaaaaatcagccggtcatggtggcgggtacctgtactccagctacttgggaggctgaggtgggaggatcacttgagcccaggaggtgaaggttgcagtgagctgtgattgcgccactgcactccagcctgggtgataaagccagaccctatctcaaacaacaaaacaaataaaataattcaatttcaaggtaaagtgcaaaatgcattatctattctctggtgacatttccagccttgttgtgttccatttcctgccttatcttccatgtcacccaaatatgtaatgctttttcttgcatgagacctctgcatatgcagtttcctctgcctggaaaaatctgtctccctctttacactaagtaagcttctcctttttctttaagtctgacttacttcagttatccccttccttaattccttctcccaggatgacctctagtctggattagatgcctgcttatatttccacagcatcttgagcttattccttatcatactatatcagtattttctactttatttaatatttatcttctttgatctcatatctttttcccttcaagcaaagtgaaatttcttctcctctctgctccctgtaacaccctactctcatctttattatatcactctttactctttattataattatcagcttctctgacgattccagctagagtgtaagcatcttgaaagcagaggctgtatcttcctctctatcatcagtgtctacaattagtagtgctcaataaatatgtgtttgaatgaatgaacaaatgaatggctgcctcataaagttttagcactagctaccagtccttcacacaaaggggtaactccagggagtcactgttcaatagtatttccagtgcttcagcccttatcaatttcagagacagtgttagggagctttcaggttcctggggtttcataaatataagctgggatgaagcaattataacggagacagggactgacagacagcctttttcctaggacaattttcttttttcttttcttttttttttgagatcgagtctcactctgttgcccaggttggagtgcagtggcacaatcttggctcactgcaacgtccacctcccaggttcaagtgattctcctgcctcagcctcctgagtagctgagattacaggcacatgccaccatgcccgcctaatttgtgtatttttagtggggatagggtttcaccatgttggccaggctactctcaaacgcctgacctgaagtgatccacctgcctcagcctcccagagtgctacgattacaggtgtgagccaccgcgcccggcccctaggatgattttcataagctttcttttaaataattcagctaataaaaagaattgaatcctgatgcctcaagctaaccaatattctgtcttctattattatccattcccacttattgtcatggacaaatggagggagagaaaatcagtttgagcaagagatgtctgcctttacataattatcttctccctccctcacactgactttgagaggataagtgctgtgtgcctactttgctgacaaaaatgcttaaggtgtgagcacactgggagcagggaaggagaaaggggaggcggtcattcatgagacacatgcttagctgactctatctttgccttctctctcatcagggaaaagttggcactcagaaacaaagaactccttgatgcaggatagggatgctgcatctgctcgggcctggcctaaaatgcacacagtcaatggttatgtaaacaggtctctgccaggtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaccaacaacaacccagagctcacatgtgaggatgagacagttcccggagccacagagaagtgaaaaaactttgagaatcagacttccacatccatgactctccttcctcctattctgcccagcaccaagtgtatggaaaatctcccctcaactcatggtttctacactggaaaaagtgacattgaggtgttcaaccagcttctccaccttcttgggttccctggggggagatttgtccttgccttaacccacagaaaacatcatgactgtctgaaggcagaaatatcccagagtacaggcagagacaaatgagggaggaaggactaccatccccagccctggaaattctgctctataatttggccaaagacatgcaaattcagaatggccgtgcagcagcaccatgctgtagcaggtttatcctacaggtcaccttggcatgaatcactagctggccttccaacactgctatgataatccctttgggacctcacccacttgggacaggcagggctctgaccacttactggaacacctgtaatcccagcacttgagctcagcacaataacaataggagatggctactaccgttaattttatgcagttacgatttaatactggatctttacgtttgtttacatttgtcccaactggcaccttcatcacctccaccctccccaccccagactatggtaaccacgattctactctctattttcacaagatccactcttttagctcccacatgtgagtgagaacatgtggtattgccctgcagtgtcacctatgttgatgcaaatgaaaatattcttttttatggccaaatagtattccattatgtatatataccactgaactgtacacttaaaaatggtaatgatggcaaattacatatgtatattttacatcaataaaaagaaacttaaaaataaggtaacaataggattctatgaaaaacaatcataacaaaacgtgctcataaaaattataaacacaatggtcaaaatagaaactcaatagaaagtactaagaatagataaaatctttcataaggtcaaacaaaatgtggttgagaatatagttgacccttgaacaatgtgggggttggggtactaaccccctgcacagtcaaaaatccatgtataacttttgactccctccaaattcaagtactaatgacctattgttgatcagaagccttatcaataacataaacaacaaatattttgtgtatgtattatatgctgtatattttcaataaagtaagctagagaaaggaaaatgttatttatacttttctctgcttcttgggagtacttccagcatcactagtggcactttatacgggtcccaagtatccttcaaagtttatggagagatgaaatgcttatgcagagatgattagcatcatgcagagttttcagtggatgcctgcagcactcgagctcagcacaataacaataggagatggctactaccgttaattttatgcagttgcgatttaatactggatctttacgtttgtttacatttgtcccaactgggaatggtgccatgtatggttgtaagtatgtaagtttttataaatttcaactttttataatagatttttgtatattttatggtaataaatgataaaatagtctagtatcaacatgtatatgtatatataagtgtgtatacatatatatatatattttttttttttttttttttgagacggagtcttgctgtcgcccaggctggagtgcagtggcgcaatctcagctcactgcaggctctgccccccggggttcacgccattctcctgcctcagcctcccgagtagctgggactacaggcgcccgccacctcgactggctaattttttgtatttttagtagagacggggtttcattgtgttagccaggatggtctcgatctcctgacctcgtgatccacccgccttggcctcccaaagtatatatatatattttttgagacggagtcttgttctgtcacccaggctggagtgcagtggcacaatctgagctcactgcaacttccccctcttgggttcaagcgattctcctgccccagcctcccaagtagctgggattacaggcatgtgccaccacgcccacctaatttttgtagttttagtagagatggggtttcaccatgtttgccaggccggtcttgaactcctgacctcgtgatctgcccgccttggcctcccaaagtgctgggattataagtgtgagccactgcatccggccatctccatatattttttgcattcataacatacctttttcttaatttttttgatatttttaccctatgtggtccatctgacagttttttcaaattgtcataaatttccaaaaaaatctcactatatttattgaaaaaaaactgcatataagtggactcatgcagttcaaacctgtattgttcaagagtcaactgtgtgttttaaagcagattttaacatcaagaaatgatagaaaaatgataagaattaaaagagataaatattcatattagaattgcccatcaggagcttctgagtagctgaacgcatggaggttcctggagagtggctggccccatgccccttcccacatacccttccttatatatgcatctcttccatctggcgtttataagaaaaggtgctgactgctgaattataaggacactgtggtctactagataaaggttgaggagaggggtttgggcttctattgtcttctttccgggccttcatctcctgcttgtgattaagtagtgcatgctgagtggagcaaagtggtggaataggactcttcagcaataatctcctcacagaaacatcaaggtaacaactcgatgcgtgaaattaccttcagaagagttaagaaaacctgaacccatgagcaagactgtgaagcccttttggactgcaaagacgagtaaaaccatagttgcacataaaggggattggttctttatgactgagaccccacccgcaagccactgcagtaccacaggcggaaagtcaccatggacccacggtttttacaccggaaaactctcccgtatggcctgagtgccctctgtggatctccactaattagtagcagagccagcatgagacttgcgtctaacctgggctcagggcgccctctcgtgctaaaaggaaatacaacagccagtcctttcactttctttttgatatggtctctgttgcctaggttggagtgcagtggtgcgatcatagattactgcagtcttgaactcctggctgggctcacacggtcttcccacctcagcctccagagtgggactacaggtgtgtgccactatgcctggctaaattttcgggttttgtgtgtggggtggggaagattggggtattgctatgttgctcaggctgggtctcgaactcctgacctaaagcaatcctccagcctcagcctcctaaagtgctaggttacaagtatgagccaccacactcagccccactcaatttctaaacgagctcactgaaatagagcagtcacaaacaaacccagactgtgaacatgagaataaatacctaattcttcaatgtgtagacagggatgcacatctgcaaagaataagaatagcctaagaaagacagcctcaacaaatgaacaaaaaatcgtgccagtgactaatcctaaagacatgcaggtgaatgatctggtagacaaagaattcaaaatagctattttaagaaaactcaacaaacttttataaaacacagagaaacaattcagaagtttatcaaagaaatttaacagagaaattgaaggaataaaaaaagtcagaaatcctggaactgaaaagtataataaaaaatgacacatgcaatacaagacatcagcaacagaattgatcaggcagaagaaaggatcagcaagctcaaagacaggttatccaaaaatacaatcaggaggggcttcaggatggttgactagatgcatctagtgttcatcccttccatggagaggaaccaaagtagcaagtagataattatactttgaataggtcatctaagagagaacactggaattcaacagagcagtgacaggaagcattgaaagcaagggaggagagagaaataaggcctgtttgcctgggattggctgggagtctggaacagcttcctaatgtggggaaaaggtaagagacccttagtgttcctcattttcaccaaggactcttgcaatcctagccacaggagagcgccttattccttgacagcacagagactagcatagggagttgcctaaagaccgtgtgaaggcattgcaacagagagctcacgctggattctgcaattctcccaagcagctgcagcacagcaccattttgagaacacagcccacacatcctgccctgctatgatggccgtgacttaggcaggagccctgagcagtgatcctgccccacccagcagaggagtgcccatgcattttcacatattccaagaacaaattccactacctacaaccactgctgctgcaggctgctgtggggccaaaacactagtgaaccttgtgctcccaagctacctgcctacagctactccctgagaaagcaaccccaccttcaccaagagcagggctatagcacagctactgctgcaccccaacctgagcattttgctagtgacctcggtatcaccccacccctgcatagcacaaccagcacctcacacaccaccaaggagcctgagggcaggttcacgtagcccagctctacctgcccccagtacccaagcatatcatccaggggcctagggatcacttagccctgtccaccactggtggcacctgagcacctcctggggtctgaggtcaggcccactcaacctgccactactgccacagttagcactcactgcatgcaccacttgagggtctggagactggccatgcgatccatagcagccacaaccaacgccagcacagaccacttgagattcaggttgtttcattgctatgattgccatcaaccatgccactttgctgcccaggaacttgagaacccacccacccatgtgatccatcaataccacttctggcacccaagtaaaccacttggaggcccacaaatcaacctgcctggacctaaaaccagtgcaatcatatgccaccatggtacaccaaagacaagcacactcagcccactgctgccaccattggggcctgaagacaggcctacctggcatcccacttctcagaaaaacttcaccacagcctccactaataaccacaccctaagccactgagaaaatcacaaatatcactgatgctgtttagaatcttatacagaggctactacattcaccgagaatcaaaaccgaagtgctctacccaagcaacaccacagatacatcttcaggaaaaagttctttcctacaaaagcaaattttaaaaattggaaaaagtgattattacaccagatgtgcagatatcaatgtaaggacacaggaaacatgaaaaatcaaggaactatgacactccaaaggagcacaataattctgtagcaagagatccaaataaaaaaaatttaagatgggtacaaaaaaatagaaagaatgaataagacctgctatttgatagcacaacatggtgactatagttaataataacttaattgtacattctaaaataaagagtgtaattggattgttaataactcaaaggataagtgcttgagggtatacatacctcattctccatgatgtgtttgtttcacatcacatgcctgtatcaaaacatctcatgtgttccataaatatatacacctactatgtatccacaaaataaaaaaatcatagtttacaagcaaaacagtatatgtgaccattggtttttaagtaaactggccaacatctctttaaaaatttatgaaatcctggaaaaataattccaaattttgatactaaataaactcagtgagatacaagagaattctgaaaaaaatacaaagaacacagaaaaacaattgaggctatgaaagagaaatttacccaagagatagatatcaaaaaagaaccaaacaaaaattctggaaccaaagaattcattgaatgaaatacaaaatagatttgaaaggttcaacaatagaccggaccaagcagaagagtatcagaactgaaatacagatcttttgaaataacccaatcagacaaaaataaagaaaaaagaattttaaaaaatgagcaaagatttcatgacatattaggcactataaagtgaccaaatatttgaatcttcagtgtcccagaaggcaaagagaaaatgaagaggttagaaagcctatttaatgaaatattagatgaaaaatttccaagtctaccaagagatttagacatctagataaagaaggctcaaaaatacccaaataaatacaatgcaaaaaggtcttctccagggcacattatagtcaaactatcaaaagtcaaagaaaaaaatttaaaaatagcaagagaaaagcatatagtcacctgtaaaggagccgctatcagactaactgtgaatttctcagcagaaactttacaagccaggagagaatgagagagagagaaaaaaaaaaaaaaacacctgccagccaaggatactgtacacagcaaaattatccttcataaatgaaagagagagaaaaatattttcagacaaaaaaaaactgaggaaattcattgcaacctgatctgctttacaggaaatgctaaagggagtttttcaaactgaaagaaaaaggtcctaatgtgtaacatgaaaacatctgaaggtataaaacccacaggtaaaagtaagtatcccgacaaattcagaattctctaacatggtaattgtagaacataaatcacttatatccttagtaggaagattaaaaaacaaaacagataaaaataattaccataacctgttaaagaataagcaatataaaaagatgtaaatgatgacatcaaaaacacaaaatttgggagtcgattttttaaaaaattttcttgcaatcaaaattaagttgttatcagttcaaactaacttgttataactataaggtattctgtgtaagcctcatggtaattacaaagcaaaaatttttataatagatacactaaaaataaaaagcaagggattaaaacatactgatagaagaatcacttaaccacaagggaagagattaagagaggaagaaaggaacaaaggatctacacaacaactagaaaacaagtaaaaatatggcactaccaagttcttacctatcaaaaattaccttgaatacaaatgggttaaattctccaactaaaagacatagagtgtttggttttttgttcttgcgatagtttactgagaatgatgatttccaatttcctccatgtccctacaaaggacatgaactcatcattttttatggctgcatagtattccatggtgtatatgtgccacattttcttaatccagtctatcattgttggacatttggaccgcatattctcactcataggtgggaattgaacaatgagatcacatggacacaggaaggggaatatcacactctgggaactgttgtggggtggggggaagggggagggatagcattaggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaatttaaaaaaagacatagggtggctgaatgaatttttttttaaaaaaagatctaactacatactgcctaagagaaagactttacctgtaaggacacacatagactgaaagcgaagggatagaaacagatattccatgcacatgtaaacaaaaagaaagcaggaatagctatacttatatctgataaaatagacttcaagtcaaaaactataaaaagagacaaacagccagacgtggtggctcatgcctgtaatttcagcactttgggaggctgaggcgggtggatcacctgaagtcagaagttcgagaccagcctggccaaatggcgaaactccatctctactaaaaatacaaaaattaaccaagcatggtggcaggcgcctgtagtcccagctactcgggaggctgaggcaggagaatggcatgaacccgggaggcggagcttgcagtgagccgacattgcaccgctgcactccagcctgggcacacagcgagaatctgtcaaaaaaaaattgacaaacaaggccattatataatagtaaagaagttaatacaacaggagaatgtaacaagcataaatatatatacacccaacattggagcacctaaatatattaatgtttgatctttgtattttctagtctcattaaaagtaagggcaaaaactacaattacttttgcaccaacctaatataaagcaaacattaatagaccaagggggaaatgaagacagcaatgaaataatagtagaaaactttaacaccccactttcaccaatggacagatcatccagacaaaatatcaacaaagaaacactggacttgaactgcactgtagaccaaatagagcaaacagacatttacggaacattccatccaacagctacacagttcacattcttctcaactgcacatggaacattctccaggagattatacattaggccacaaagcaagtcttaactaacttttttaaaatgaagtatttttttcctgccaataatggaataaaactataaatcaacaacaggaggaacaactgtacaaatacatggaaattaaagaacatgcccctaaacaaacaatgggtcaatgaagaaattaaaggagaagttaaaaaatttcttgaaacaaatgaaaatggaaacataacatgccaaaacttatgggatacagcaaaagtagtccttaaagaaaagtttatagcaataaatgcctacatcaaaaaaaaatctcaaataaacaacctaatgatgcatctcatggaactagaaaaacaagaacaaacaaaaccccaaattattagaagaaatgaatgaatacagatgagagcacaaataatcaaaatagaaactaaaaaatacaaaagatcagtataatgagttagttagttctttgaaaagataaaaaaaagtcaataaacttttagccagactaagtgataataaagaagaaaaacagaaataaatcagacatgaaaaaggagacattacaactgataacacagaaatacaaagaattataagaaactactatgaacaactataagccaacaaattgaaaagcctagaagaaatggataaattcctggacacatacaacctaccaaggttgaatcaagaaaaaatggaaattttgaacaaatcaacaatgagcaacaagattgaagcaaaaatacaaagtctcccatcaaagaaaagttcagtacccaatggcttcactgctgaattctaccaaacatctaaagaactaataccaattcttcacaaactattcaaaaaattgaaaaggaagaaactcttccaaaattattttaggaggataatgatcattatcctgatcccaaaaccagacaaaagcacaataacaacaaacaactacaggccaatatcctcaacaaaatactagaaatagaattcaacagcacattaaaagatcatttaccatgatcaggtgggatttatcccagtgatgtaaggatggtttaacatatgcaaattaagaatgaaggacaaaaattatattatcattttaatagacacagtaaaggcatttgacaaaattcaatatcccttcatgataaaaactctcaacaaagtatagaaggagcatacctatatgataaacctacaaacaagatgaaactgagtggggaaaagttgaaagcttttcctttaagaactggaataagacaagcatatccaccctcaccacttctattcaacacagtactggaagtcctagccagagcaattaggcaagacatccaaattggaaagaaggaagtcaaattgtccctgtttggccaggctcaatggcttatgcctgtaatcccagaactttgggaggccaaggcgggcagatcacttgatgtccagagttcgagaccagcctggcaatatggtgaaaccccatctctactaaaaatacacacacacacacacacacacacacatgctagccagacatggtggtgcgctcctgtagtcccagctactcgagaggctgaagcaggagaatcactagaaccccagaggcggagcttgtggtgagccaagatcgcaccactgcactgcagcctgggcaacagagtgaaacactgtctcgaaacaaaaacaaaaacaaacaaaacaaattgtccctgtttgcagaagacatgatcttatatatagaaaactgccaaaactacaccaaaaaactgttagagctagtaaatgaatgtagtaaacttgtagtctacaaaatcaacatacaataattgatagcatgtctatatgccaacagtgaacaatctgaaaaagcaatcaagaaagcaatcacgtttacaatagctacaaaaaatgtccagaaataaattaaccaaggaagtgaaagatctctataatgaaaactataaaatattgatgaaagaaattgaataagacacaaataaatggaaagatatttcatgttcatggattgaagaattaatattattaaagccaaagcaatctacagattcaatgcaattcctatcaaaattccaatgtcattcttcacagaaatagaaaaacaatcctaagatttgtgtggaaccacaaaaaatcccaaagagccaaagaagtcttgagcaaaaagaataaacctggaggcatcacactacctgatttcaaattatactacaaagttatagtaaccaaaacagcattgtgttgacataaaaacagacatatagaccaatagaacaaaatagagagcccagaaatacacccaaacatttaaagccaactgattttctacgaagttggcaagaatacatgatgggtaaagaacagtcttttcaataaatggtgctgggaaaactggatatccatatgcaaaagaatgaacctagaccccctatctctcaccacgtatgaaagtcaaataggccaggcacagtggctcatgcctgtaatcccagcactttgggaggccaaggcaggcagatcacttggggtcaggagtttgagaccggcctggccaacatggtgaaaccccgtctttactaaaaatacaaaattagccaggtgtggtggcacacctgtagtcccagcaacttgggaggctgaggcaggagaatcacttgaaccccagaggtggaggctgcagtgagcctagatcgtgctattgcactccagcctgggcaacagagtgagactctgtctcaaaaaaaaaaaaaaaaaaaaaaaaaagaaagacagaaagaaaagaaaagaacaatagattaaggaattaaatttaagacctgaaactctgaaattattagaagaaaacatagtgtaagcatttcatgacatcaatttgggcaagaatttgttagacaagacctcaaaatcatgagtaacaaaagcaaaaataaagaaattggattacatcaaactagaaagcttctgcacagcaaaggaaacaatcaacagagtgaagagacaacctatagaatgggagaaaatatttgcagattatacatctgacaagggattgatatctagaatatataaggaactcaaacaactcaatagcaaaagtccaaataatcctattaaaaatgaacaaaagacctgaatagacatttctccaaaagagacctacaaatggccaacaggtatatgaaaaatgctcaacatcactaaccatcaggaaaattaaaatcaaaactacaatgagatatcacttacccctgttagaatgactattataaaaaagacaaaataacaagtgctagcaaggatgtggagacaaagaaacccttatacactgttggtgggaatataaattagttaagccattagagataatggtatagagatgcctcaaaaattaaaaatagatctatcatattttctagcaatcccactactgggtatataccaaaaagaaatgaaatcagcatgttgaagaaacatctgcatccccatgtttatgacagcattattcacaatagtcaagatataaaatcaacttaaatgcccatcaatggatgaatggataaagaaactgtgatatagatacacaatggaatactattcatccatttaaaaaagatgaaatcctgtcattttcaacaacgtggatgagcctggaggacattatgttaagtgaaataagccaggcagagaaagacaaatactccatgatctcagtcctatgtacaatctttaaaatttgatctcatagtagttgagattagtgattctaggaagataagggggaagtgggagatggggagagattggtcaatgggtacaatgttacaggtagatagaaggaataagttctggtactctattgcacagtagggtgacaatagccaacaataatatattgtatatttcaaatagaagagaggattttgaatggtctcacaacaaagaaatgacaaacatttaaggtgatggatatgataattaccctgatttgaataattacacaatgtatacatgtattgaaacatcacattgtacccataaatttgtagaattatttatgtgtcaataaaaagtaatacagttaaaaaaataaaattgcccattaggataaataaaaagacccacacacaaaattatcattgtggcatttcagagcacagagagaagatacttaaagcttcttctgagaggaacaggacgcatacaaaagaatgggaattagactggcgatataattaagcaatattgtaaaagatctaagggaaaaattatttggaacctagaatttttagtcaaactatgaatcaattttgggggaagaaaaaagacattttcatatatagagggccttaatagtcactgaatgtgtactatagtaaaaccagaaactacataaaagaggaatttgggagattcagcaacccaagagaataatgaagtatgagggggatgttttctccttagttcttttccgtatttttcaataatttgataataaacatgcataattttataattaaaaaggaaattaattttgacaacatgcaagttcctgttctcacataccttatagtggagggacagattgtagtcaaataagcataataatacatgcaaaattacaaactgagcattactctgaaggaaaattacataattctatgtaagcctataatacaggaatctgacctagactggggaatcagagaaggcttccctaagcaagtaccccttgaacttagctttgaaactgggaaaatgaggcaatgtgagatgaagctgttagaggtattaggaatcaaacctattggggccttctagtccttagtagagagtctggactttattctatgtggaatgacagcctccagtgggttttaggctggcggatactacaatcagatctggaatgcagaaatagtacaccagtttctttgtgggtaaaagtcttagaggggagaatatgaccaactgtagggagacctgtaaaaaaagtttatcagtagctcagacgagataatggtaacttggattaagatagtggtagtagtaacagtgaaaaactagatacatttgaaagcttttagagccaaaataggaggcagctgtgcccttgttgttaccagtgtgggatctgaacacatgactacttgggttcaaatactgagcaaattaattaacctctctgggcatccgtttcctctcctgcaagacatggatgataatggtttctacattcatagggttgttatgaggaatgaatgaattaaaacttgtaaaatactttggacagtgcttgacataaaacaagtgctcaatacatattagctattattgattatattgccctggtcagtgtcaaactgcatatgggagatgagaatggtaacaaggataactctcacttgcatattcaaatgcaggatgctgccattcactgttataaaaaactctggaagagaatgaagtgatgaaaattgtaaatttggttttgaacatgtgggttttttgagatatctaggtggagatgttgagaaagtgattggctgtatgagcctggagttccagaagaggtcagcaggggagacagaagaaggagcagtctgagaagtaggagaaaaaaacccacagagatgttggcacagaggccaagggaagagagagttttaaaaacgaatgaatggtcaacaggtgcaaataaagactgaaaaatgtccattggatttagcagcatgatggtgattggtgaccttggcaagagctgttggtttgatagtagcccaatgttcttgataaatttgtttacaagtcaaggtagcaataaagtgtctaaagtcaatttgtccattctgtcctagcaagtgttttccatttcagattctctacttcatagccataggtgtcttattcctactttacaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatggtaatatcttggatctttaaaatgaatattataaatatccagtcctacttttaataaaatttactggacaatgtacaggaatatagtgtgttgctgaaggggacattatagagttactgtattagacctcagccaagatcccctagtttccagcttccagtgtaaagtttttaccttgactataaaagggcttgagtattagtaggactcatggatttttagttaaatgtctgtgatggagaaaagatggcttatggatgattgaggtgggaaaatgaggagaatagtatgcccttggtttctcagccttatcccattaattacgctccaatattatggagagaggaactgcaagttgtagctgaagagattttttttttttttggagaaatctagggaaatgggaaaaaaaggcattgtccagattgcaactgtaagggctccactatatcattagtaatgcccagagcagtaaatagcaaatatgacaggctattgtagagcttgacttcagacaccagacagccagaggcactctgtagatacctggcagtagatgagagacacctgtgaaactgagggcaggtcaggagctagtgaattttagaagtaacatgggattgaaaggactatttggtgggaactttggaaagggtcaaaggttctgtgtaagcaaattaggacgatggtaactacagttttaaattattgttaatgtaactttatttgtaactgctagttgtgcaaattcagattgcatcatcatttcaccccaattttccttacttttgtatttattctgctaactcttaatcttggatcaacctaataaccctctttctctacccctctcgtggccattgaaggctcttagtcagtttgtgctgcaataacagtataccacagaatgggtaatttataatggacagaaatttattggctcacatttctgggggctgggaggtccaatatcaagttgcctttttctgcgtcttaacatggtggaaggcattatatgacaaaagggcaaagaaagggtgagagagagcaagaggagggtgagctcactcctgtgataacaaatccactcccatgaacactttccccagataactgcattagtccattcatgagggtggaacgcttatgacctaaacaccttttatatgttcacctctcaataccatcacgatgataattaaatttcaatatgagtttcggaggggacagacattcaaaccatagcaagagttattggagaaaaatgtcggagaggcctaatcttttatatttaatagcatttctttcttcctattactctcatattaaccttctcctcaggttccttggttgacttagaaaagagaattgatcttgccatgcatccaccattttcctccttatgttctattagtgaccttgtttattgtcttctgtagtgattaagaatagaaatctctcttccccatgtgtcacataatatttatggaattttgacaagaccttagtggacaaaatgtgtcatactgaatgagtaacaggaagttgatgcacaaacaacattcttgcaggcacagaggaataggtcatttacttgtatatgatcattgtcaatcaatcattgtccagttggaccccgattcagtttattttttgttttgtttttctccttttcacagattctatccactaattttaatctttatttttcagaaaaaaatgctttatcttattgaacctcagaccaaacactttgtttttcgatgcagactgagttatgtttaaggctacatgaaccccagactagttgtttgctgctcctaaaaccttccctgttcctcataatcaagtaaacaggtctcccttcttagaagtatttgatcttcaaaattgccctgtggtataaatagggcaggaattattattatccattttacaaagcatgaagatgagactgagaatgttgaatacatttgccatagggtttacaactagtcacaggcagacatgctcttaaaatatatatctccttgattttaagttgtatcttgtcatggttttatgaacttggaacatgtcttaaagtttatatctacactaacatttttcccaataagctgttattaaatcaatgatttgtggcaagaagggatagtgatgtggaaagggggggtacttaggggagagcctggaaggcctaataagagagaaagaagtcataaaagttaaggcaagtgatatggtttggatatttatcttcactgaaatctcatgttgaattgtaatttccaatgctggaggtggggtctggtggcagatgtttggatcatgggggtgaatccctcatggcttgatgctgtcttcatgatatttggtcattcagaagtgtgtggcaacttgcactctctgtcttgctcctgctttcaccatgtgacatgtctcctcccccttcacctacccccatgattgtaagcttcctgagacctccctgaagccaagcagatgccagcaccatgcttcccatatagcctgcagaaacatgagccaattcaatctcttttctttataaattacctagtctctggtatagaacagcctaatatagcaagacactctgacattgtttggtttgtctgactccagatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacaggtaagcactttttgactattggtactctctcttccccatactcaaaaagttcttaccagttattcaaaccaacaaatcctgaagccatgtttaaggttaggtacaggtatggaatcaaatggcaagggtattaacatttggaaactaacatagctgagcatcagagaagcttgtatttttctcactccttgccttgattgaatcatataagctgttttagagttggatttgagcctacctagaatttttcttcccaacctctcatctttttttctcttatacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttggtaagttgaagaaaagatttaaggtcaggtaagaagaaaaagtctggagagttttgagtttctaaaatacctcataattcagccttgtctccaatggacatgatcttttaaaagctataaatgttacacaaataatagctgattgtatgtatttaaagtttgagtatatagaataaaaatttaatgtcacccactaaactcgacactcctttgaaatactgcttagactttgatacatatccttccagatctttctccattaattatgtcatataggagtcagcagactatggcctgtgaaccaaatttggcttgtggcctgcttttgaacagtccatgagcttagatgagattttacatttttaaaatattgcaaagaaaagaaaggaggatgggaggaaggggaggagaaggcggaggagcaagagaatatgtgacagaggctagatagggctcacaaattttagagtacttactatccagccttttccaaaaaatgcttgcttgctcctgatctaggatattaagaatgagtatggtgtaagtaacagaatactcaatggacagtggtttaaataaataagggtttattttcttcacaagaaatttgaagattggtcgttggttccataaattcagccgctgaagaatgtcatgaagaacactggtttttagatatggagttttgttagatactgccaaactgactttcagcaattttgtaccaatttatatcccctaccataagtatatgactgcccttttccccacaccattgccaacaacatatattataaaccttcagaaaattttccaatttgatgagcaaaatgtttatatgttgtcttcatttgcatttccctggttagtggtcaaattgtatattgtttcatgtttgttggctatttgtataactccctctgtgaattgcctgcttgtaaattttgtccagttttctatttggtcagtcatcttttgcttatgtatttgtaaaaggtctttatagattatggatattgacacattgttatttatctttcaaatgttttcctcacattgtcacttgtactttaactcctttatgatattttttgtccttcaaagatttttcatctttatatagtcaaaacctcctatcttttatcaatcttttcatttatatgtctctggatctttttcacttatgttttctgcctgagaatgtctttgccacccccaagacactacaaaaatagtctatattttattctcttacttgtatagctttatttttacagtgagcaatctaattgccctggaagttacttttgaatgtagtgcataattcaaatagaaattttcccaaatggcagctgacacaaccaatccttttttcattaatttgaaaatgtcttctttatcatatactaaattgctaaaatctgggatttttaattctccttaactaatctgttaccaccctgttttaatgacttcaactttgtgatatgtttgatatctgtatgacatcttctttcattgtacttcttcaaaatttttattagctattattgtacaatttttcttcataaattttgtgtacgtattttttctatttttcattttttgaagattgtataattttattttttattcattaatttttaaaatgcataatgacacaataattttacatatttatagggtactttttgtgtattttgagttacttttactggctaatttaaaaatagataaacaagagcatgcaataaaatgtaaattttcctccctcttggacttccaaccccatagtctgacagacagtcattgctgtgggtttgtatactcccctccagaagtagtgcatacatgtacaaatgtgtgtgtgtatgtgtgtgtgtgtgtgcatttcacacaaaaacaagagcagtgtaaattggtctgtaccttgatttttaaaaggtaacaatatattttgaattagccaggcatggtggcacatgcctgtagtcccagctactctggaggctgaggcaggagaatcgctcgaatctgggaggcggaggttgcagtgagctgagatcgcaccactgcactccaccctgggcaacagagtgagactctgtctcaaaaaaaaaaaaagtaacaatatattttggatatcatttcatgtcaacatatatagatctaccccattctttgatttattcaggttatactctggataccatgctgaatcctacacttaaacattacctcaaaatggatcaaagataaaatgtaagagctaaaactacaaaattataagaaaacaacaggataaatctttgtgatcttgaattagacaatagtttattggataggacaccaaaaccaacaagcaacaaaagaaaaaccatttgacccagccatcccattactaggtatatacccaaaggaatataaatcatgctgctataaagacacatgcacacgtatgtttattgcggcactactcacaatagcaaagacttggaaccaacccaaatatccaacaatgatagactgattaagaaaatgtggcacatatacaccatggaatactatgcagccataaaaaatgtccccgtttgcagatgacatgattgtatatctagaaaacaccattgtctcagcccaaaatctccttaagctgataagcaacttcagcaaagtctcaggatacaaaatcaatgtgcaaaaatcacaaacattcttatacaccaataacagacagagagccaaatcatgagtgaactcccattcacaattgcttcaaagagaataaaatacctaggaatccaacttacaagggatatgaaggacctcttcaaggagacctacaaaccactgctcaacgaaataaaagaggacacaaacaaatggaagaacattccatgctcatggataggaagaatgactgggttttaagacaagagcagaagtggaagttgcatttttatcctcatatcacacacctcagatctggaggtgggattgatattttcagggttcttcgctgcagcttccatgttattgctcttccattctctctctctctctctctctctctctcgtctctgtctctctctctctctcttgagatagggtctcattctgtcacccaggctggagtgctgtggtgtgatcacagctcactactgcagcctcaacttcctgggctgaagtgatcctcccacctcagcctcccaagtagctggtactataggcatgcaccaccacgcctagctaatttttttattttttgtagagatgaggtctcactgtgttacccaggctggtcttgaagtcctgggctcaaacgatcctcctgcctcagcctcccaaagtgctggcatgagccactgcacctaggcctttgttttcttttaaagctggtgcaatcaggcaataccacctgctacccttgcttaatactgtaatcaactgtcctcttggtcatgcctgctcatgcactgaagattttatctcctgaaacactgtctctttctctattatcagtgaatttaatgcccaaatagtaataaaggctgagaggaagcagtgtcctcaccaggcatctaaatttcaattagtgtgagaaggtgcagagaatacttcctgaagcaattgaaacaatttttaaagaagtggaaaggggcctttagagagaaacctaagtactgtcagccctctacattgtcaactgaagaatcctaagtttgtaaatttggagtggaaagggttgcaggctgggaagtgtagcctctggcagcaaatggaagcaagcactttgaagaaggaaggatgagataagaatttatgctgaatgagttggctaagtatacatatttaacaggttccaggaggagctgtgaatatttatgatggggcacctgcaaccacacatgttacatacattccatgttcactttggggtggagacttaacatttagatgcatgaaaattaggctgtatatgtcaaaagatgaaacagaggacacagaggcagcctctgtaaactggccagagccagtccatggtcagtggtctctcatcaggaagcaatgcttctcggttgttatgataaaactgcacaaagggaggggaatccaccacgtctttagaaaggactggtttatgtttaacccttaagaaagaaagtctaacggcagattagggagggagggaatgtaacaaggcatgcccgatctcccatcccatcatggtcagaaactcagtttttaagccatctctggggtctccttggccgagaaaggggtctcttcagtcgtttggggatgcttaagattttatttttatttttcagtatcactggatttctagtctcatattcaaacaaccattgattgaaagtattcaaaaaacaaccccaaaacaataaaagataataatacaacaataaacaataatacaaagaaacaatacggtaaaacaactatttacatagcatttatgttatattatgtactgtaagaaatctagagacgagttaaagtacatgagaggatgtgcatatgttatatgcaaatactacatcattttgagtaagagacttgagcatcacagattgtggtatctgcaggggtcctggaaccaatcctccatgcatgccaaggaacaatttcatgaaaagaccaaatattttgagttttatctagcctcaaattactataatgtagatagaggccacttttatttatctggagttagaccacagttttcttgttgatcctagtcgttttaggatttgatcttagatctcgcttatactttcagattatatttaagaatcaagcaagcagaccatataacatctaccctcacggaatcactgatgtccgtcctttgtattcaaggagattaccaaaaggtaaatattccctcgatttatagctcttttttacctgtagatacagatgagataaatatcatcaataacaactaaaattatgttggtcctttctccagctgttggccggacctcaagctccagtctaaagttataaaaatcaattataggaatcctcaggtgatgtttcatgtaaattcgtgaagagtcgcctgacatgtttttcctattacctagcggtgatgttcaaatattccacagccaattagattccactgcaattggttccactgcaactactgtaaatgccctaaaatcttgaagctggttcttctggcacttaagataatttttttttctgagtacggttttcagctacattccacacttttggtatctagtgtggtattccacactttgggtaactagtttgatattttcaggattctttgctgcagcttccatgttattgctcttccttgctctctctctctctctctctcaacagggtttcactctcacttttggtatctagtttgatattttcagggttcttcgcatattcatttctaaatagttcacaactccagtttttatttactatattgtttgctgtttaaagatttattttttcttttagtagattggatgttatgtatattctttctattatttaattttggatgaatatttatcaaaataatagatgtgtatgcttaaaactacaaaagggctgcctccctagaggcatccatttttaagaatttctgtttttgatttttggtggttatctctacatctctaaaaagttacttatactgctaactctttgtttttcaactttagacattatatacttactttgttttgtgcttttttccattcaagttgtttcagttttatcagtgttttcagttggattggctatcattagaactttaaaaatatactaaacatcaacttttagtaagatattttccaatcatggattgaaaatatcttttgactccatacttcataaattaaggatattaaaaactgtacccctcacttttcctttccccaaacctttcttttctctactgctgctagccattcctttacttttacaaaactaaacttgataacatttacattttgtgctgtaatttgaaataactcttccttgctttgtctatatattttctctaaagcttaaaaaattaaaaaacagcatttgtattattttagtattttagcaagtttcttttcataaatgttaactgcagaactgggtaatatgctatgattgctctcttttctacagctcaagtgattttactattaagataaaataatatgtggaaggaaaaaagttgatctcatagaagtagagataaaatagtggttactagaggctaaagaggggaaggggagggggaaatagggagacgttggttaatggatgcaaaattccagctagataggaggcataagtcctaatgttctatagcactgtagggtgactgtagtcaacaatgacatctattttcaaatagctagatgagaggatttggaatgttcccaacacaaaggtgtatcctgaagtaagactttgttttcttttattcggaaaagaaatgtaggcttcttcaaccctatttcttaggcctttcagcttcttaatcattctatgtattgcttgctatccaaatcttttattttttttttgagacagcgtctcgctctgtcacccaggctggagtacagtggcacgatcttggctcactgcaacctctgcctcccaggctcaggctatcctcccacttcagcctcctgagtagttgggaccacagacgcacactaccatgcccagctaattttttttattatttttattttttgtagaaatggggtgttaacttgttgcccagactggtgtcgaactcctgagctcaagcgatctgcctgcctcagcctcccaaagtgctggaaccaaatctttttcttcttaaagacattcttgtagtgaatagcattaactacttttcccttgtacatttctattttttgatttcttcttttgtttttctggaagtatattctcaagtaacttctaaatatgtggtacatagagggtgaactttctgaatccttcagtatcacatgatgggcagacagactggttataaaaattttcccgctgggtgcggtggctcacgcctgtaatcccagcactttgggaggccgaggcgggcagatcacttgaggtcaggagttcaagaccagcttggccaacatggtgaaaacccatctctactaaaaatacaaaaaaaatagccgggcattgtggcgtgtgcctgtaatcccagctactcaggaggctgaggcaggagaattgcttgaaactgggaggtgaaggttgcagtgagccaagatcaccccactgcactccagcctgggcaacagagcaagactgcatctcaaaaaaaattccttcccctgttttctaatattcattattgccgataagaattctttatttgcatttctttatggaagaatggcatagtgacagagttctggggagattttgaatgtgtgtcccgaaatttggaggcatacgtggatagttactggtaacctgcttttccatggagaattttgaaggctgtaatgcccataatagtgggcaagaagagagggcaagagtggagcagtttaccttcctgctgtttgacatgagtttattctgtaacaagtgaatactgttgaaagtagctgggctttatcccttttgaagatattctacccaagaaggcagttaggcaggctgaggggatagcagaaccaatagagtcttggatatatcactggaagtaagaagagctgatggggagaggagagttgcagaaggatagctgaaagaaacatctctcatgtcatggaactatgtaatgctgaggtccccatggtaactctaaagaaaccatacatgtgtcctatgaaaagaccagcatttgggcacctcccacacagagaacattgatgaccaaatagtgttgtcaaagatagagcagcaggacctgttaaacaagagtctgtttgccctttcttctattacctaccctccctcacccccagctcctggaaaagggaagagaaggctcagaaatattgaaagaacatactacaccattccctttctttctttctttcttttttttttttttttggagacagagtctcgctctatcccccaggctggagtgcattggcatgatatcggctcaacctctgcctcccaggttcaagcaattctcatgcctcagcctcccaagtagctgggattacaagtgcctgccaccacacctggctaatttttgtatttttagtagagatggcgtttcaccatgttgaccaggctggtctcgaactcctcacctcaacaccattccctttctatggatcctctaaccataggtcaggcataacttactgaggtgaggaagagcttagaatgaatataaaattaaaattttgatttagattgtatcttcaggtatgaaacatacccagaatgagacttaattactaaaatcagttcttgtcctgaggacccattaccctgagggcagatctcagttcttgctccctttcctcacagaagtcagagactacaccttaaaactccaatgccaagctctttggcatatattcaggcctgacactttcacagtcaaccggataatcaattacagctttttactttttaaaaaaattgtttgaatcttaaaattataataggtgcgactttagcttccacttgctcagaaacttcatatgtacatacagatttgtagaacccttgcaacaacaacatgattatcaatatgtggcttgttgtactctaattgagctatttatggttttgcttgtgggtaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccaggtgagttcttgcctttccaagtgctgggtttcattctcagtgtatgtccccttataacctgaagaaaatataatggtttgcaatataggtcagtaaaagaaatgagcttagcttttactaaatttgagtttcacgtagtaaacgtgcctgctggatggataggccatagaatgtaggccctagatttttcctatagtactcattcccagtctgggatttagctctctctagctgatcctccccatttttatatgtccaattaccacctattttcagatgacccacagatttatatctacagcctagatttcttccatggacatctcattatgggtgactcaaaagtacctcaaaattaacatgtctgcagcatgtagcactgttgcaggaagtcagggaccccgaacagagggactggctgaagccacggcagaagaacataaattgtgaagatttcgtggacatttattagttccccaaattaatacttttataatttcttacgcctgtctttactgcgatctctgaacataaattgtgaagatttcatggacatttatcacttccccaaccaatactcttataatttcctatgcctgtctttactttaatctcttaatcctgtcatcttcataagctgaggatgtatgttgcctcaagaccctgtgatgattgcgttatctgcacaaattgtttgtaaagcttgtgtgtttgaacaatatgaaatctgggcaccttgaaaagaacaggataacagcgatttccagggaacaagggagataaccataaagtctgactgcctgcagggccaggcagaacagagtcatatttctcttcttgcaaaagcgaataggagaaatatcactgaattctttttctcagcaaggaacagccctgggaaaagaatgcattcccagggggaggcctctaaaatggccgctctgggagtgtttatcttatgcagttgaagataagggataaaatatgccctggtctcctgcagtgcccccaggcttgctaggattaggaaattccagcctggtgaattctagtcagaccagttctctgctcttgaaccctgtttcctgttaagatgtttatcaatgacaatgcatgcacagcaggacatggaacctcattagtaattctaatttcgccctaccttgtgatcttgctctgtccctatttgccttgtgatattttattgcctttgaatcatgtgatctttgtgacccacaccctattcgtacactccctcccctttgaaaatcactaataaaaacttgctggttttgcggcttgggggcatcacagaacctgccgacatgtgatgtcacccctggagacccagctgtaaaatttctctcttttgtactctttctctttatttcccagaccggccgacacttaggtaaaatagaaaagaacctatgttgaaatattgggggctagttcccacaatatagcacagtgcatctcacttagtaagagcttaataggctacgtgcggtggctcacgcctgtaatctcagcactttgggaggccgagacaggaggattgcttgagctcaggatttcaagaccatcctgggcaaaatagtaagaccttgtctacaaaaaaaaaaaaaaaaaaaaaaaattagctgggcatggtggtgtgtgcctgtagtcccacctactcaggaggctgaggtgggaagatagcttgagcccaggaggtcgaggctgcagtgagcctggatgacaaagcgacaccctgtctcaaaaaaaaaaaaaaaaaaaaaaaaaaaagcttaataaatacttttgggcaaaacatagggaaagatataaaatatttcaaaatatggctagaatttggaccatttctactgctttaaaaaataaagctaaattctctgaacaagaaaagcttagttcttcacaaaaactcattgctcggccccagaataactcagtgccatattgctgaggcttgactacatgtccatttgattatatttatgatacataagatccctactagtctgaaaacatttcatatgtttagagagtaaagtatatgaactttggtgccaataaaacacatggcacataaactcagagaagtataaattttgccaagtacttgtcctgaccgatttttcctaactatagttttttcgtcacttttgggaagagaactgaaatattattctatattctccaatctcctctcttcagtattttggtttatatagctataggttataaaaaatgaggtttatacatattagtgaggtttacatatgaaatcttagcagatccaattagcaagcgactaattcataaatctggttcatatacaaaatgctcttctgaaaaaaatttgaatgttttaaacagaaaatttaaggtattagtgttgtttgacatttttgtggttcaccttatctttcttatttgatttctgtttttctatttttaattttttatagccttgtggaaggtcagttgctagatggaagtttaggaaagtcagtatctcatttgacttaactaacttaagaaaggcactgaataaccacttggttctttaaggagttaaatcttctaatctgaacatgaagagaataaggctacagactgtaccaaataaatcagctagcatatggccttgggtgcagaaaaaactaagttcagtgggatcagtcaccctcttgtcctggggacacatttgttgtaagcatatactcactgctcatagcacccaccctcaactcccaagccctggtacatgcctaagaggaaatggaattaaaccaatggattagatatatcacatgcatgccatcgctttcatcatagactgctagctcctacctgacaacatcagtagcatttctttacccctttcaatatatgtaattaacagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagtgagtaaagcagcacttaagtccagtgggtggtgaataaagaaaaattgatgtaatcaaagtgatgtccagataatgaatgaattgtatgtgcacataaatttaacaattatgttacctataaatgtataatttttactcaaacacacgtgatcatataacccatattttaaaaatccagtcaccattttttcctttcaatatttacttgatttccctctcccttttaattccctatctccttctatattacatcttttcaccaaccattccatgcccaggtaacatattttaagacatattttctctataattatataatcatatataaacacatacatacattgtattagtcttctagtgctgccataacaaagtactgcagactgggtggcttaaccagcagatatctattgtcttacaactctggaggcttgagatcaggatgtgggcaacgttggtttcttctgaggcttctctccttgtcttgtagatggctttctcccttgtcttcacatggtttctcctttatatatctttgtcctaatctcctcttctaataaagataccagtattgttgggctagggcccaccgtaatgaccttattttaactaactacctatttaaaaacactatctccaggtatagtcacatgctgaggtactggggtttaggactgcaaggtataaatttgggatgggggaacacaattcagcccattgcatacatacacatgtgtatatatttatatataccacaaatctgaatggtcaaaaatatggtaaaaaattccaattgcactatcctacagggaaatgcgaaatagaataacaataggatagcactttatacccatcaaactgccaaaattataattactagtgggcttgtggataaaagagtgttctcatgctatattagtggataagtagtatagtcttttcaaaaccaatatatgccttttgaaattctgattattaagatgtttaagatggagtgagccacatttccctgtgtgtcccactggatgcaactaaaaatcctgaacaggccgggcacagtggctcacgcctgtaatcccagcactttgggaggccgaggcaggcggatcacgaggtcaggagatcgagaccatcctggctaacatagtgaaaccccgtctctactaaaaatacaaaaaattagccgggcatggtggcggccgcctgtagtcccagctactcaggaggctgaggcaggagaatggcgtgaacccggaaggcggagactgcagtgagccaagatcgtgccactgcactccaggccggcgacagagtgagactccgtttcaaaaaaaaaaaaaaaaaatcctgaacgaaatgcatgggaaccttgaaaagttataatgtgagttatactcacctaccagaatgtggcatatgttacaattctatgcccctcctctcaaagctttagccctttaactttgggttgagcctcatatttagcttgaatttctagtaatagtgatatattattctccagagttaaagtcctttactatccattattctaaaaattttaaggttgtttagtcctttgagttgcatttttattttttacatagttcagggtattgctttccttctgaaggattcagatttcacatttgtgcaagagtctaatgcttagtatttaattctagtggcacagagctttttcttttctccctcttctctccagcctcatggctttggtttagaattccttcagcctgatagaatattgtattttataatttccttattgtgctatttactagatatttgttcttctatttttttctattcataatttctccctttcccaccacatctttttccaagtaggatgtgcacttgccacagtatctggacagttaaactgtctcattttcttggagacggtgatgaaaactagagagatatagtgacataagcagagccagaaaacaatttcactgaagatgatatatattttttttcctctgggatttctaatatagcttttggtggagataagagtctggaattgagaaagaagagattggaattgagaaaaagagtctgagaaagcacagggagagacacaaaggcagagaccaagagacacaggggaaggatcttcagaggaagagtccagggagaaagatgctaagacagagggataagaaaagaagaaaaaaaaggaccaggaggagagagacccaaaccataaatcactcctatttccattagcagtaaaattgataatctattttcatacaatgaaataccatgtgacaatgaagattcacaaaaataaagctatacacaacaatatgaataagtatcacaaagacaatttttagtaaaatggtaagtgtcaaaagaatatatacagtattatattatttacataaagttcaaaaatgggcaaaattaacttatatagtttagggatacagaggaagaaaagtataaaggttagtaaggacatgattataataaaagacaagatagtggctacctcttagaaagagttcatttgagaataaacacatgtgttttgtggggatagcagcaatattgtatttcatgacctagatgtttgttttataattttgtgttttaaaaaattgtaggatttatgatttatttcgtagatggatcctacaaatgatagggaaattgcagtaggaatgaagaggaaggaacatgtacaggatttgtttagaagatagaaggcacatgattttgtaaataattagctatgtttggtaaaggactaagaggattcaaagatgattaccaaatttctgatatgggtaactagaagaagagtgagacaaaatggaagaaagtgtatttaaagaaatgatagcaaaaactttccaaatctggagaaagatgtaaatatccacgtacaagaagctcaaagatctctagtcagattagattcaaacaagactatatgaagacacgttacaatcaaactgtcaaatatcaaagacaaagagagaatcctgaaagcaacaacaaaaaagaagcaaaccacatacaaggaaattccaataaggcagaaactttacaggtcagaagagggtgggatgatatattccgagtactgggaaaactttacctagaaaatgtttccttcagaaatgcagagagataaagactttgccacacaattccagttagacaagagaaataaattaaagacatctattgtacactatggtgactacagttaataaattacccattccaatatatacatatataaacattgtgatgtacatcataatatattctatttttccctgtcaattaaaaaataaatttaaaaagattggatagagaagaatcagccattctagtaattaagcctgaggaagcttacattccagtgatttcagataaccattatgcaagttaaggaataaactggataggatgatattaaaaaaacaaaaccaccaatgagatacaccagaatggctaaaattaaaaaggctgtccataccaagtattggtaaagatgtagagtaatgagaactctcataaatttctggtcaggaaatccaaacatcgaaagccaaacatcggcataccctattgactcaggaaatccactcctagtatacacctgttatgtcctgaatcatgtcccctagaattaatatgctgaagccctaacactagtatttcagaatgtgactgtatttggagatagggtctttaaggggtttattaagttaaaatgaggttgttacaatgggccctaatccaatatgactagtgtccttataagaagaggaaatgtgggccaggcacagtggctcacgcctgtaatcccagcattttgggaggccaaggcgggcggatcacgaggtcaagagatcgagaccatcctggccaacatggtgaaaccccatctctactgaaaatacaaaaattagctggacatggtggcgagctcctgtagtcccagctactcgggagactgaggcagaagattgcttgaacccaggaggtggaggttgcagtgagcagagatcacgccactgcactccagactggcagacagaccgagactccatttgaaaaaaaaaaagaagaggaaatgtgtacacacagagacaccagggatgcatattcacagaggaaagaccaagccaaggagaggtgtcagtaaaaaccaaacctgccaataccttgatcttggaattttagtgttcaaaactgtgagaaaacacattcctgttatttacacctcccagtctgtggtatattgttatggcaaccctagccactagtacagcacccaaaagtagtgtgtacatatttcacaaaagacatgtaactatttaatccatgtggagtgtcaaaaggcaaaaatacaacaaatgtattttaaagattgtaattggcttttatacatgattctagaatcagatagccctcagaaccaaatacagaacagcagccagcaacatagtatggatagaaattggaagtgaggtttagagacagcttaattgattacagttgggcatttttgccttatttgaagctgttagtcgcctgcaattgatggaagttcagctgctataatcggctgagactgagctgtttgttataaaagcatattcctaaattaggctttcagttagttcatcaactaagccaggctgcaactttgttgtgcaaggactcaagtgcaaaggtacccttaggcaaaattcagattaatttaaaaggactttacttttgttagttatgtgaaatgaagtggaatctattttttccaagtggatagtcatattttctattatcatttaccaactagctgatttttttcctgtactggttggagatgctgcctttattatatattaagtttcaacttattatatattaagtttccgcttacatcttgtcagtttctggactccatattttgtttgatatatttatctattctgcattaagactgcatttttaattataatagctttataatatctcaatgttgtataggaaaaaaacttcaattattaattagttatactaagccaatgtctaagtattgcttagtggtttgtgggcaaccatcttacacagtacctagtaacagagtagacaagtgtttattgaatggatggatgaatggatgtgtggaagaggctttcagaaacaattcccttcatagactaaggccaatgttacttttgcttagctctttagtttgaaataatttaaaatgtacagaaaagttacaagaataatacatggaacttgcacacaccctttacccagattcacaaatgtttaacattttgcaattttgtttttcattttcttttctttatatacacacttctgttacttattttctatttgaaaattagttgcagacatcacatccctttacctctcaatactttagtacacatttcctgtgaataaagatatcttttacataacagacacttcaaattgataaagcacatttccataatttacaactggtattccagttgtatcaaccaatgctgtcatttatagcattttcttctttgaagtacagggatctagtacaagtaactacttgtcctgcttctttcatttccttgaatctggaccttcatcagatggtaactttaagcacccaaaggtttttttctggtttctcctctgtgtagtttaagaccatgcaaacatcttgctactcatcaaaatgccccccatataacatccaaattaatctttatcatgatggtttatgactgtctcctcacattgggattggggcccaactgattattaacaatctacttttttggaagatataatatctcttcctgggaataagataatgggcataacatataataattcctaattgtatcatgacaatcacaatccaaaatactaaatctgtgatgtgtctaaatctcttttccccattgtttttgcaggcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggttagttattatatttttcttgtaccaacagctgtgaatgcttcactagccattcgtatgctcttttgcccactagctcacatgctgtcatttatagcattttcttccttgaggtacagggatctagtttctcctctgagtagttattattttcacccttgcaactaataaacagtttgaaggatcacgtagtagttctatttttagttttttgaggaacctccttactcttttccacagtatttgtacttatttacactcccaccaacagtgtacaagcattccccttttgccacatcctcaccagcattttttaattattttgtctttttgataaaagccatttaactggagtgaaatatctcattgtgcttttggtttgcatttctctggtaattagtgatgttgagcagtttttcatatacttgttggccatttgtatgtcttctttttttttttttttttttttttttcagacggagtctcgctctgtagcccaggctggagtgcggtggcacgatctcggctcactgcaagctccgccacccgggttcacgccattctcctgcctcagcctcccgagtagctgggactacaggtgcccgccaccacacccagctaattttttgtatttttagtagagacagggtttcaccgtgttagccaggatggtctcgatttcctgacctcgtgatccacccgcctcggcctcccaaagtgctgggattacaggcgtgagccaccgtgcccagcctgaatgtcttcttttgagaaatgtctattcagatctttgtccatttttaatagggttctttgttttttttgctattgactagagtttcttatatattctggttattaatgccctctcagttgtatagtttgcaaatatttcatcccatcctataaattgtctcttcactttgttaattgtttcctttgctgtccagaagctttatggcttgatataatcccatttgtctacttttgctttagtcccctgtgcttttgaggtcttacctgcaaaatctttcccagaccaatgtcctggcgcattcccccaatgttttcttccagtagtttcatactttcaggttgtatattttagtctctaatccattttgatttgatttttgtatatagtgagagataggggtatagtttcattcttctgcatgtggatatccagttttcccacaccatttattgaagagactattctttcaccagtgcgtgttcttggcactttgtcaaaggtgagttggctataaatgtgtggatttatttctgggttttctgtcgtgttccactggcatatatttctggttttatgccagtaccgtgctgtttttgttactacagctttgtagtatagtttcaagtcaagtagtgtcatgcctccagctttgttcattttgctccagattatttagctgtttggagtcttttgtggttccacacaaattttaagattcttttttctatttctgtgaaaaacttcactggcatttggataggtattacattaaatctggtagcattgatattttaacaatattagtttttccagcccattaaaatgggatagataccttttcagttttttgtgtgttcttcaattccctttatcagtattttagttttcattatagagatatctcagctctttggtttaatttattccaatatatttatttttattatagctattgtaaatgatttttaaaaaatttctttttaggttgttagctcttggtatatagaaatgctactgatttttgcatgttggttttgtatcctgcaactttactgaatttgtttatcagttctaatagttttttgatggagtctttagttttttgtgaaatataagattatgtcatctataaacaaggagaatttgacttcttcctttccaatttgggtaccctttatttctttctcttgcttacttgttctggcttggacttccaggactacattttatagaattggtgaaagtgggcatccttatcttgtttcagatcttaaaggaaaggcttttggttttccacatttggtatgatattagccgtagtttgtcatatatggcatttattgttttgaggtaagctttctatacccagtttgtttagagttttctcatgaagggatgttgaatttaatctttttggcatcaattgaaatgatcatttgtttttgtccttcattctgttgatatgatgtatcacattgattcatttccatatgttgaaccatccttgcatccctgggatgaatcccccttgatcatgatgaatgatcttttactgtgttgttgaatttggtttgctagtagttcgttgaggatttttgcatcaatgttcatcagagatattggcctgtagtttctttttgtgtatgtgtgtgtctttgtctggtttggtttcagggtaatactggccttgtggaatcagtttggaagtatttttcccccttgatttttgggatagtttgtgaagagctggtattagttctttttttttattattatacattaagttttagggtacatgtgcacaatgtgcaggttagttacatatgtatacatgtgccatgctggtgtgctgtacccattaactcgtcatttagcattaggtatatcgcctaatgctatccctctccccttcccccaccccacaacagtccccagagtgtgatgttccccttcctgtgtccatgtgttctcattgttcaattcccacctatgagtgagaatatgcagtgtttggttttttgttcttgcgatcgtttactgagaatgatgatttccaatttcatccatgtccctacaaaggacatgaactcatcatttttatggcggcatagtattccatggtgtatatgtgccacattttcttactccagtctatcattgttggacatttgggttggttccaagtctttgctattgtgaatactgccgctataaacatacgtgtgcatgtgtctctatagcagcatgatttatagtcctttgggtatatacccagtaatgggatggctgggtcaaatggtatttctagttctagatccctgaggaatcgccacactgacttccacaatggttgaactagtttacagtcccaccaacattgtaaaagtgttcctatttctccacatcctctccagcacctgttgtttcctgactttttaatgatcgccattctaactggtgtgagatggtatctcactgtggttttgatttgcatttctctgatggccagtgatggtgagcattttttcatgtgttttttggctgcataaatgtcttcttttgtgaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagttcccatttgtcaattttggcttttgttgccattgcttttggtgttttagacatgaagtccttgcacatgcctatgtcctgaatggtattgcctaggttttcttctagggtttttatggttttaggtctaacgtttaagtctttaatccatcttgaattaattttagtataaggtgtaaggaagggttccagtttcagctttctacatatggctagccagttttcccagcaccatttattaaatagggaatcctttccccactgcttatttttctcaggcttgtcaaagatcaggtagttgtagatgcgtggcgttatttctgagggctctgttctgttccattggtctatatctctgttttggtaccagtaccatgctgttttggttactgtagccttgtagcatagtttgaagtcagggagcgtgatgcctccagctttgttcattaggcttaggattgacttggcgatgcgggctcttttttggtttcatatgaactttaaagtagttttttccaattctgtgaagaaagtcattggtagcttgatggggatggcattgaatctataaattacattgggcagtatggccattttcatgatattgattcttcctacccatgagcatggaatagtcttccatttgtttgtatcctcttttatttccttgagcagtggtttgtagttctccttgaagaggtccttcacatccgttgtaagttgtattcctaggtattttattctctttgaagcaattgtgaatgggagttcgcttatgatttggctctctgtttgcctgttattggtgtataagaatgcttgtgatttttgtacattgattttgtatcctgaggctttgctgaagttgcttatcagcttaaggagattttgggctgagacaatggggttttctagatatacaatcctgacatctgcaaacagggacaatttgacttcctcttttcctaattgaatacactttatttccttctcctgcctaattgccctggccagaacttccaacactatgttgaataggaaaggtgagagaaggcatccctgtcttgtgccagttttcaaagggaatgcttccagtttttgcccattcagtatgatattggctgtgggtttgccatagatagctcttattattttgagatacgtcccatcaataccaaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttttgtctctgcccggctttggtatcaggatgatgctggcctcataaaatgagttcaggaggattccctctttttctattgattggaatagtttcagaaggaatggtaccaattcctccttctacctctggtagaatttggctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagcggtctatcaattctgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccatctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttgttttacatttgctgaggagagctttacttccaactatgtggtcaattttggaataggtgtggtgtggtgctgaaaaaaatgtatattctgttgatttggggtggagagttctgtggatgtctattaggtccgcttggtgcagagctgagttcaattcctgagtatccttgttaactttctgtctcgttgatctgtctaatgttgacagtggggtgttaaagtctcccattattattgtgtgggagtctaagtctctttgtaggtcactcaggacttgctttatgaaactgggtgctcctgtattgggtgcatatatatttaggatagttagctcttcttgttgaattgatccctttaccattatgtaatggccttctttgtctcttttgatctttgttggtttaaagtctgttctatcagagactaggattgcaacccctgcctttttttgttttccacttgcttggtagatcttcctccatccttttattttgaggctatgtgtgtttctgcacgtgagatgggtttcctgaatacagcacactgatgggtcttgactctttatccaatttgccagtctgtgtcttttaattggagcatttagtccatttacatttaaagttaatattgttatgtgtgaatttgatcttgtcattttgatgttagctggttattttgctcgttagttgattcagtttcttcctagcattgatggtctttacaatttggcatgattttgcagtggctggtactggttgctcctttccatgtttagtgcttccttcagaagctctcttaggtcaggcctggtggtgacaaaatctctcagcatttgcttgtctgtaaaggattttatttctccttcacttatgaagcttagtttggctggatatgaaattctgggttgaaaattcttttctttaagaatgttgaatgttggcccccactctcttctggcttgtagagtttctgccgaaagatcagctgttagtctgatgggcttccctttgtgggtaacccgacctttctgtctggctgtccttaacattttttccttcatttcaactttggtgaatctgacaattatatgtcttggagttgctcttctcaaggagtatctttgtggcattctctgtatttcctgaatttgaatgttggcctgccttgctagatttggcaagttctcttggataataccctgcagagtgttttccaacttggttccattctccccatcactttcaggtacaccaatcagttgtagatttggtcttttcacatagtcccgtatttcttggaggcttcgtttgtttctttttattcttttttctctaaacttatcttcacacttcattttattcatttcatcttccattgctgataccctttcttccagttgatcgcattggttactgaggcttgtgcattcatcacatagttctcgtgccgtggttttcagctccatcaggtcctttaaccacttctctgcattggttattctagttgtccattcgtctaattttttttcaaagtttataacttctttgccattggttcgaacttcttcctttagctcggagtagtttgatcttctgaagccttcctctctcaactcatcaaagtcattctccatccagctttgttccattgctggtgaggagctgcattcctttggaggaggggaggtgctctgattcttagagtttttggtttttctgctctgttttttccccatctttgtggttttatctacctttggtctttgatgatggtgacgtacagatgggttttcggtgtggatgtcctttctgtttgttagttttccttctaacagtcaggaccctcagctgcaggtctgttggagtttgctggaggtccactccagaccctgtttgcctgggtatcagcagcagaggctgcagaacagcagatattggtgaactgcaaatgctgctgcctgatcattcctctggaagttttgtctcagaggagtagctggccatgtgaggtgtcagtctgcccctactggggggtgcctcccagttaggctactcaggattcagggacccacttgaggaggcagtctgcccgttctcagatctcaagctgcgtgctgggagaaccactactctcttcaaagctgtcagacagggacatttaagtctgcagaggttattgctgtcttttgtttgtctgtgccctgcccgcagaggtggagcctacagaggcaggcaggcctccttgagctgtggggggctccacccagttcgagcttcccggccgctttgtttacctactcaagcctgagcaatggcgggcacccatcccccagccttgctgccaccttgcagtttgatctcagactgctgtgctagcaatgagcaaggctccatgggcgtaggaccctctgagccaggtgcaggatataatctcctggtgtgccgtttgttaagcccgttggaagagcgcagtattagggtgggagtgacccgattttccaggtgccatctgtcacccctttctttgactaggaaagggaattccctgaccccttgtgcttcctgggtgaggcgatgcctcgccctgcttcggctcacgcacagtgcactgcacccactgtcctgcacccactgtccggcactccccagtaagatgaacccggtacctcagttggaaatgcagaaatcacccgtcttctgcatcacttatgctgggagctgtagactggagctgttcctattcggccatcttggctcccaatgcaaagaccttcaaacaacgtgacttcattttctcactcctaccttttgtgctcttgtcatttatttgaattctacatatattttaaaccccataagacattattattgttttatataatcaatatcatttatatatatatatatatttacacctttcatttctttcattcttttctgcatttcttgcttccatctatgatcattttctttttgtctgaagaaacttctttggaacttccttcagtgtgtgttggctagtaaaaagttctctgtcagtttttggtcagaatgggtctttattttgcctagatacaagtccttggttggatttacatattgtgaatgttttctcccagtctgtggtttgtcttttcactcctttaagggtgcattatggttaatagaagttcttacatttaattaattcttatttttcagttttttatggttaatgccttttgtattctgtttcagaaatttttgcctatcctaagaacatgatgccatccttctatattttctttctacatattttaaatattttcttctagaagtctgattgctgtgttgttcacaattaagtttatgattcatttttaattaattttgatggagtgatgcagataaaagttcatttttccatatggatatttaattgctctagcaccaattgttggaaaaaaataatttcctcactgaattgcactgttgtctttgccatgaatctgatgactgtatcactgtagctttgtttctgtactctatttcaggggtaggttatgatccacaagccaaatttgcagcttgtttttatatggcattgagctaagaatttttttacatttttaaagaattgtcacacaaaacaaaaaaaaagcaaaaaaacaaataaggatatgtatcatggaccatatgtgtctacaaacctaaaatatttactatgttgctttttacagaaaaagtttgccaacccctgatctcttatattccattgacttattggtctatctttgtaccagtaacatactatcttatagtaagttttaatatttgttagtataattcctccaactttgctctctttgatttttatataaattttagaatcatcttgtcaattttatcaataaaaatatcttctgaggttttgatagggattacattgattctgcagatcaatttgggggagcatacctcttgacaatattgagtattcctgtccatgagcatggtttagttatttatttacatcttttaaattttctcttggcaatgtttttgtaaaattttagtgtacaggtcttgcacatttttgtaaagtgtattctttggtatttaatgctattataatattttttatggtatcagtttttgtcaattgtgtttttctagaaatatgtccctttcatctaagttgtttaatttacttgaagtaagttatttgtaatgttcttttatcatccttataatgtctgtactgatgtctccgttttcatacctgatattgttatttatattttatctattttaagtttatcgcctgcacccactaactcgtcatctagcattaggtatatctcccaatgatatccctcgcccctccccctagtgcacatgtaccctaaaacttaaagtataataaaaaaaaaaagtttgtcgcctttgttataggttcatcaaatttactaatcctaccataggatcaaatttttgctttgttcatcaggtcatggaattaaaaaaatttttttgttttgtttattttctatgttgaatttttatttttattttgctttgcatttcatttatttctggtcttttgttattattccaatactttctctggattcagttttctttttcttcttgacttcttgagattaaaacttggttcattgattttcaacatttcttactttttaaaagttcatacaaagcataaatttccctttatatactgctttaaccccatatcacaaattttgatgagtcatatttttattatcattgagtttaaaatattttataaattttacgttatttcttgttttattcatagttattttacagtgttttacttaatttcccaatatatggcgattttctggctctctctctgttgctgatttatttgttttactgtgatcacataacatactctatattatttcaatcatttgaaatttgttgagacttgctatatgcccagtgaataatttaatttgattaatggcccactgcatttgaaacaaatatgtctttgctgttattgggtagagtgtcatatatttgcctattatgtcaagttgctttatcatgtttttaaaatccttataaacttcctgatattttatctgtttcttacagacatggaggaaactgtgacatctctgtgattgttgagtttgttattttgatttttgtatttgttagtaagaatgtttcaaaataaatgaggcaatataaaatcaggtgcttacaactttaaggttgtattcttattaaatcaattctttcatctttgtgaaatgtcctttttgtctgaagtagtacttgttgccttaaacgtctgcattgtctaaaatttatacacctgcactatcatatttattttgcttaatgtttgtgtggtatatatttcccattcttttcttttcaacctatctctatccttatatttacagtgtgtcttttttaacattttctgtagtgcaagtctgttggttaattaattttgtcagtttttgcttctctgaaaagtctttatttctgtttttgaattatatcttcactgtgtatagaattctgggtttgtggttgttgtttttgttttattacattttgttttattggtttttccctcagcactttaaaaatgccgctccattgtttctacttgcatagtttttcacaataagtttgttgtaattcccatttgcattcaactgtacataatgtatctttttaaaaaaatctggatggcttcaagctctttactttgatttttgtgtgtgtgtgtgtgtgtgtgtgtgtgtgtgtgtgtgtgtgttactttggcattctctaggcttattcaatctgtaatttggtatcattaattttgaaaaatatttatcatctgtgtcttcaaatattgcttctaattctttctcttcttctggtattgcatttacatatattatactgttcaattttgtcacacagctcttgaatatgctgttctagtttgttttctaactatttttccttctagttgttcagttttgttgacatttattgacctatttttacttcagtaattgtttcctgggttgttgagttaattgatgaactcatagatgacatacaatttatctttttattcttgtgtcacttgtgcttttgatgtcacatctaggaaggctttgtctagcccaaggccacatttacttccatattttcttctaagagtttgatagttgtagctgttacatatatgtctatgatctagtttgaataaatttttgtgtatggtgtgaagaagaggtctaacctcttttttattttttgcatgtaaacatccagttgtcccggcaccatttgttgaaaatatgattcttttcccattaagtcatcttgacacccttgttgaaaatcaattgaccataaatgtgagagtttatttctgaactctccattctgttccattgacccatacgtcttctataaattcttatagctaattctacattagactttggtttttcagatgtggtcatctcattagattatggtgatatgtttggttacaagttttatcttctccttggcaacattttttttattactgctcttcttttattcgtttttgttgttcctttctctttttgtgagacagggtctcactctgttgcccagggtggagtaagtggtgtgatcatggctcactgcagcctcaacctcctgggctcaagcaatcctcccacctcagcctcccaagtagtgggactacaggcatgcaccatcatgccaggctaacttttttattttttgtagagacagggtcttgctttgttgcccaggctggtcttgaactccaagctcaagcaatcctccaacctcagcttcccaaagtgctgggattaccagtatgagccactgcacctggccttgttgttcctttcttccttttatcttgtagtatcttgatcctttttgcttattatttatcattgaggtgagtttgttctaaataaacttttcgcagaaagtttatgtagatatattaatatcaatgaggcattaggagtgagttttagattagcaggaattctcttatgaaaggtattgattgtatgtgtgagttttcagcctttacttctctccagcccatcaagatcaaagctgcagagttgtttacatttcagaatttctttcctcccctccccaccttgcaaaacagacttacagtgcaaaaatgacttgtcaatgtgattctttcttctggtcccatctttcctaccttttgagacttgtgttgaaaggagtccagtaaaaccaccgatgctagcttgtataccctgatcccattgttataatgaatgactgactgtttttcatatcaaagtataatacttgcaccttgatagaagaaagaaacaaggccaggcacagtggttcatgcctgtaatcccagcactttgggaggctgaagtaggaggaataattagactttgatattaaaaatggggaagatatggcggtataagatatgaggaagtatgtcttcttggacttttctgaaatctgccagccatgagcatccactctttttatcttttgatacctgttttatattaactatacttctattttgtggtttcatggcttcagatatcttccagcttaattgtactctgtctttaattatttgcagcaatttctgaaaggagcaagaagaaaggccagccctttcttcactaccttaaaaactggtcatcttttgaaaccccatgaaaggcacagtgggtgaccatctacatcaggagtgggcaaactatggcccttgggtagtctggtctctgtccgtttttgtaaggttttattggaacccatacacacacaaactgatcatctcttgttatgtgttaagttttcttataattattcttttctatttcatccagctgaattaccatttcaccttgtgtatgccctttccagtcttaaattatagaagctatgtctttgtggttttaaattatggaagctgtgccttcttgtgttttagtatggcaagatatttgttcttacttttcctctagaatctgcagtggattactttcagaagtaggtattgcctctaagtttcctgacttctgtttccttctccctgttctgtagtatatttatagattgcatgttttctcgtccttaaacaaggtacaaatatgttctgatcaaggtttgctagccgagaggataagtggcttgctcttagcctaactctctgtctacttaatggatgtcgaattcccttctcaactcaacagctagtaactagttccaagatcggataatagcttacagaattaattagttcagtgaaagccctggtttgatcacagaggcaggagactgatctatatatttgtagtgctgactagaccccaacttggccagatagcttatacctatgtcagaagttggaggaggagattgacagctgaggtgtctccaagggaattacaattattttcattttctttgtgtctgtaattatgtctcttttcttacttcaaattttgtatatgtgaaatttcttaatttttatttggttatttattttattgactttttcatcaaacaaccaactctaagttcttggattgaaatttatgaattaattataatgttttaaatttaccattagtcacacatacaatacaaaaagatattttcattacaaaattttaacccaagccattaaaactaaactccagcttggtcaccattcctaataccaggcccctctcagaggggagggtaaataaaagtccattttggtaactagtttgacgagaatctctaattgtttccctgtttttcttataatgtctgcctttgaattatcctctttttttcaagagttccatcatataatgtattcctttttgcttacagattgacctcctagaggcatgcatccccctgctccagtctgagctggttctctctaggcctgaggctcagttatcaacttgggacttttatttaccctccctcaggataggtacctggttcttggataccaggtcttactcttgtttgagatactcctttattttggtggcaaacattccataatcacttcctgataatggtgacatttgaggtagattttctgagtctttatatgttagaatatgtttttattctcctttgccacttgattgataatttggctgcacatagaatgtaagcattcacagggcttttgggagcagcttcccttgagaagaaggtggatgcagttaagatcttccctgaaaagactgtgtgaaatgacaaggctattgaggtacccaacgggtagcttggtaaaggtgtatcttgtctcttatgtttatgcatctactttaccaccatgtaattagcctattataacttgttgcattccttcactcagctaatcttgttcatggtagaaattaatattgctagtaccatggtagaattttatattagctggatcctagacctaaatgctccttccttgtgcttacatattctgcaagtgggtgacagtggatgctaggtattgtgttatgtgatttcaatgtattatatgatggggtagatactattagcctcatttgaaaattagaaacctattgttcagaaagtttaagtgactttctcaaagtcacacagctggtaaatggtagaactgggatttgaatccaggcaatctgatggatttaagaggaacctgtgccactatgtgatatagcaataacatctagccaatataaatactttcctgaattaaatcactgtcatattcagagagttctgtgtcactattaagaccctccattattgtgtatattaattacatttccctattttaatcccaatatctattcatttttatcacagtcctttcttatggtcacaaacaggcatagtacaacagcagcaatgcaaaaaccacttttatattacatgttccagggatttaacccaatgacctgtgatataatgatactgactagtattttttcatttatctgggaatgggagagaacctctaacagaacgttttagaatctgtgttatgagtaaccagagtcttattcttcctcatctccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacaggtatgaatgcattggttattcctttgctctgctcttgtgacatttgactttaccagatgatgacaccaacaatgagagttagaggatgaaaaatcaaggtgtcttgaaactcttactctggtgagatagagagaagagaggtttacaagagggtagaggaatcagggacaagaaggagcaatggggagcaggaagaaagtcaacctcacctatcaaccttatgagctgcaggggaaatcttagtctcatcagagaactttaagcaaggcagaaggaagaagcaagttcgtgttaaagaggttaaggacttggggaggattggttttcatgatactggggatccagagggcaaagtaggatgattttatttttaggtgagtagagggaggttgagcagtcaagtagtacagagaaatgtggaatataaacataaggagagtcagtcagtcacaaatatttatggaacacctactacatgccagacacttttgtacacattggagtgcagcacagcaggagcttatattctattggaaagagcaagagacaagttagtacaaaactaaataaggcaatctcaattgtgttgttcagaagatagaatagaataatatggtagagagaataatatgatagagtaatacggtagagtgttacattagctgtggtggtcatagaaatcatctttgaggagttgagacctaaatgatgataacaggccagctgatggagctctgagagaagatgtttccagacagagggaagagaaaatgcaaaggccctgagaatggaaaaagtttaccatgtttgaggaacaagaagggacaagcatgacttgtcactttcccaccttgctttctagctcaagtaagcccttattgctgcattgcaaccatagactatttccctagtccactgactttctcattctcctggacctctatcttagattttctgtgttttccttaaatctcgagcaccttttttccattctccaatgcccattttcactcttagctgatgctgtgcaatgaacctccacagactcccaacatcacatttactggcatttgtacccatatactctgcctgcacacttattacaataaatagagtgtctgtgctcctaaggccaacctctccagttttgtacttgattcccatctcttctcccttcataaaaaatgttgctccagcaatttctccttttctcccttacatcatcaatttatctctccactagattaatctcatcaacatcaatcatgctattatttcctcccctatctttacagaaaccgtcttaaaataattgtccctgcttgcagcctttgcatcttttcctgccattctctcctctttaacccactccaaagaagcttttatctctattatttcataagaactacattttcaaggtcattattgatctttacattactgattactagccctcatcttatttgaattctcagtagtatttgagaggtgattactccatcgttgatacaggttctcacttggtttctctaacaccacttttcttcacttttctactaaacttactgccaatctttgtcaactttgcgagtccttcttcatccccctaatctttaaaggttagagtgctccagggattagttctccaacttcttctttattctatttatactcactctgtgacgacattgtttagcctcatgattttaagtactatctatctgcagataattccagttgaatatctggagatattctcagatctctctcctgaagtcaaaatttacatatcaactccctaccttaacatgcacacaattagactcttaattcctgccccttcccaaaacctgctgattgctcagccttctccatggcaatcaaaaaccattcctggccgggcatggtggctcactcctgtaaccccagcacttggggaagctgaggcaggtggattggttgagccccagagttcaagatcagcctgggcaacatggcaaaacctcatctctattaaaaatacaaaaattagccaggcgtggtggtgcacacctgcagtcccagctactcaggaggctgaggcacgagaatcgcttgaactggggagacggaggttgcagtgagctgagatggcctcactgcactccagcctgggcaacagagtcagacttgatctcaaaaaaataaataagtaaaaccattccctatttcagttattcagtcacagatcttgaagttttccaactctttttttcttacattaacatctaatctgtaaaggatcctgtattagtccattttcacactgctaataaagacatacctgagactgggcaatttacaaaagaaagaagtttaatggactcacagttccacatggctggggaggcctcacaatcatggcagaaggcagggaggagcaagttatatctcacatggatggcacaggcaaagagagagagcttgtgcagggaaactcctctttttaaaaccatcagatcttgtgagacttattcactatcatgagaacagcaagggaaggacctactgccatgattcagttacctcctatcaggtccctcccacagaacatgggaattcaagatgagatttgggtagggacacagccaaaccatatcattccaccccatcccctcccaaatctcgtgtcctcacatttcaaaaccaatcatgccttcccaacagtcccccaaagtcataacacatttcagcattaactcaaaagtccacagtccaatgtctcatctaagacaaggcaagtcccttccacctatgagcatgtaaagtcaaaagcaagttagttacttcctagatacaatggggtataggcattgggtaaatacagccattccaaatgggagaaattggccaaaacaaagggcctacaggccccatgcaagtctgaaattctacggggcagtcaaatcttaaatctctaaagtgatctcctttgactccatgtcttgcatctgagtcatgctgatgcaagaggtgggtgcccatggtcttgggcagctccacccctgtggctttgcagggtacagcctcccttgtgtctgccttcatgggctggcattttctgtagcttttccagatgctggtgcaagtttctgatggatctaccattccggggtctggaggacggtggccctcttctcacagctccactaggtggtaccccagtagggactctgtgtgggtgccctgagcccacatttcccttctgcactgccctagcagagtttctacatgaaggcccacccccgcagcaaacttctgcctgggcatccaggcacttccattaatttctaaacaacaaagcattcaagaggcgacttgggtgctattaagggcattcagtttcataagggaagcagagcataaaagtttggaaaatttgcagcctgataatgttagagaaaagcaaatcccattttctgaggagaaattcaagcaggctgcagaaatttgcataagtaatgaggagccgaatgttaatccccaagacaatggggaaaatgtctccagggcatgtcagaggtcttcacaccagcccctcccatcaccggcccagaggcctaagaggaaaaagttgtttcatgggctgggcccaggatccccatgctgtgtgcagcctagggagtcggtgccttgtgtcccagccgctacagccatggctgaaaggggtcaatgtagagctcaggctgtggcttcatagggtacaagtcccaagccttggcagcttccacatgatgttgagcctgcgagtgcacagaagtcaagaactggggtttgggaacttccgcctagatttcagaagatgtatgaaaacacctggatgcctaggcagaagtttgctgcgggggtgggccctcatggagaacctctgctagggcagtgcagaagggaaatgtgggctcagagcacacacacagagtccctgctggggtaccacctagtggagctgtgagaagaggaccaccgtcctccaggccccagaatggtagataccctaaatcatctctttcaaattcgaagttccacaaatctctaggacaggagcaaaatgccaccagtatctttgctaaaacataacaagagttacctttgctccagttcccaacaagttcctcatctctatctgagaccacctcagcctggatttcattgtccatatcattatcagccttttggtcaaagccattcaacaagtctctagagagttccaaactttccacattttcctgtcgtcttctgagccctccaaactgttccaacctctgcctgttacccagttccaaagtcgcttccacatttttgggtatcttttcagcagcaccccactctactggtaccaacttactgtattagtctgttctcacactgctgataaagatatacctgagactgggaaatttacaaaggaaagaggttttatggacttactgttccacatggctggggaggcctcaaaatcatggcagaaggcaaggaggagcaagtcttgtcttacatggatggcagcaggcaaagaaagaaagcttgtgcaggaaaactcttttttttcttttcttctttttagacagagtcttgctctgtcacgcaggctggagtcagtggcgtgatcttggctcactgcaacctccacctcccgggttcaagtgattctcctgcctcagccttccaagtagctggtactacaggcatgtgccaccacatgagatgagattttggtagggacacagccaaaccatatcattccccctgtcccctcccaaatctcatgtcctcacatttcaaaaccaatcatgccttcccaacagtcccccaaagtcataactcatttcagcattaactcaaaagtccacagtatttttagtagagatggggtttcaccatattggccagactggtctctaactcctgaccttatgatccgcccgccttggcctcccaaagcactgggattacaggtgtgagccaccatgcccagccaaaaactcttctttttaaaaccatcagttctcatgagacttattcactatcacaagaacagcataggaaagatctgcccccatgattcaattacctcccaccaggtccctcccacaacacatgggaattcacgatgagatttgggtggggatcctcttggctatcatttcaaaaaatagtcagggttgattatggacttagtattgaataagatgaaaatgtactgaaatggaacgatgaagataattgaccagggaaagcaggttacaagccaagagaggatacagtgtcacttcagatgctataaaagtgatgtttttattttttgaatgttatttggctatattttcaaattatctgcactgcatatgcactgcttctgtaataataaaagggtattaaaataataaaatcaagtctataaatcacacacacacaccccagcctcttctctacacctcagtgactaccaaccacatctaaattatcatcatttctcatctgaattattgcaagaagccattgcaataattcagatgagagttgatacaaagccttcctgtttccaaccttaccctcatatagtcttttcccaacattgcatctaaagtaatttttcaaattgcaattctgatcactgttctctgcttcagatcctccagtggattttcatctcactcagtaaattccaaagccttcaccatggccttcaagaccctacgaaatttgaccctctgcaacctctctgccttcatctgttaccattgtctcctgttaatcctgcctcagccacactgacctccttgttcttctcaaatggactagatgtgtgcctatctctagaccattacagtttctgttctctctacttaaaattatgtccctgatactctaatgcaagttctcttacttccttcaggacgctgctcaaatttcattttatcagtgaggctttccctgaacactgtatgtaaatattgctcccaccattttttttcaatgcacttaacagtgcctgaaatattatatatttatttctttattgtctatcttctctgactataagttaagctcattaagaacacaaactttggaggtattgttcaatgttgtgtccccagaactttgaacagtgcctggcacgtggcagatgttcaaataaatgtatgttgaatgaattagaaaatgataaatgtagggagacaaaagcaggtctcccatttatatccaaactctaggactctaggaaagactgattatatggaatcgtgtcacacagcatccatgggcaagagtggaggcagagataccagttaagatgctattgcagtcatacagataaaagaagacagttatttagaccagtgtggtggtgacagaaatggaaagaaatggaaggatgttgggtataattaaagataagcatataagactggctgttaattgagtatgggaagaatgaggagagaggatgtaaagaacatttctttttgtttgtttgttttgttttgtttttgtttctttttattatactttaagttctagggtacgtgtgcacaacctgcaggtttgttacatatgtatacatgtgccatgttggtgtgctgcgcccattaactcatcatttacattaggtatatctcctaatgctatccctccctcttccccccaccccccaacaggccccggtgtgtgatgttcccctacctgtgtccaagtgttctcattgttcaattcccacctatgagtgagaacatacagtgtttggttttttgtccttgcgatagtttgctgagaatgatggtttccagcttcatccatgtccctacaaaggacatgaactcatccttttttagggctgcatagtattccatggtgtatatgtgccacattttcttaatccagtctatcattgatggacatttgggttggttccaagtctttgctattgtgaatagtgccgcaataaatatacgtgtgcatgtgtctttatagcagcatgatttatagtcctttgggtatatacccagtaatgggatggctgggtcaaatggcatttctagttctagatccctgaggaattgccacactgacttccacaatggttgaactagtttacagtcccaccaacagtgtaaaagtgttcctatttctccacatcctctccagcacgtgttgtttcctgactttttaatgatcgccattctaactggtgtgagatggtatctcactgtggttttgatttgcatttctctgatggccagtgatgatgagcatattttcatgtgtcttttggctgcataaatgtcttcttttgagaagtgtctgttcatatcctttgtataagattattagtggatttctcagaagaaatattgtagaccagaagggagtgaaaatatagatttaaaatcctgaaaggaaataaaaactagcaatgaaaaatactatatccagtaattttatctttcagaaatgaaggggtgataaagattttctcagaaagacaaaagctagatctgctttataagaaatgctagtaggagttcttcaagctgaagaaagaggatgcttattagtaatatgaaaacatatgaaaggataaaactcactagtaaaaataagtacattgtcaaatccaaaacactctagtagtgtaatggcagtgggtaaattaattatatctttagtataaaagataaaagacaaagaaagctattttaaaaactaaagctataataatgtgttaaggaatgcaaattattaaaatatgtaaactgtcacatcaaaaacataaaataggctgggcacagtggctcatggctgtaatcccaacactttgtgggggccaaggtgggaggatcacttgagcccaggcatttgagactaacttgggcaggatagtgagatctcatctctataaaaaatttaaaaattagtaaagcatggtggtgcatgcctgtagtcccagctactcaggaggtggaggtgggaggactgcttgagcctgggggggtcaaggctacagtaagcaatgatcacaccactacactccagcctgggcaacagagcaagaccctgtctcaaaaaaaataataatatgtaggaggaagggaataaaagtgtagagtttgtggatgcaataaaaattaagttgttatcagtttaaaatagcctgctaattttgtgtaagcctcatagtaaccacagagcaaaagcctatagtagatacacaaaacattttaaaaaggtccaaagcataccactacagaaagccatcaaactataaaggaagaatgcaacagaagaagaaaggatcaaaggatctaaaaaaaaaaaaagaaagaaagcaattaacaaaatgacacaagtatgaccaaagtccactgcttctttattactgatatagaatatctttcagatcttaagggactgattaattacttgggagagaaagtttgtgttgagaagatttgcttgtgttgcaatgagaaggggaagttctactcaacagaagctgtacaggcacatatgacaaaagctggtgtaagctttttacagatggtgatgctgctttggaatttgcagacttgtatgagtttaggagtagctacccagatcacaaggaaggggaggaccctaatgaggctgaggagtcgcccttaggaaaggacttagaatatgatgatgaaagcatggaactgattctgccttctgatgccagagtgggtcatcactccttgatgagatactacaaacagtgatttggcttgtcaagagctgtggtagttgctaaatattgtgaggccatgggccgagtgcttcagtaatagagagccctgggatagactggcaacacaggagcagctgttacatgaaagtgagacatgcattatatccaaaggatgaagtcaaaatggatgctgaagacagaaatgaagaacaatgccaccaagcagatgcactttagggtccaagtgagattctgagagtctgccaggattgagtgattgtctgctgcccaagtttcctccttgccctgaggaccagggaaagccagattgtatgatggacacttttgctgctacttcacttgctctaacataataataaaaatgaaaatctaaaaaatattttattgaagaatgaaggtgaaagaaatacattttcagacaagcataaacagagaaacttcaccattagcaaaagtccactaaaatattctaatgttatacttgagacaataaaaaagtgatacagaatggaaggcatgagagacaagatgggataaagagcaaacaaagttaaatatgtggataaatagagataagtatcataaaacatggtcaaatgttttatgagcgttaagatatatagaattgctttattcacagttggtttgctgtcataacacaagtatcatgaaaatcactgctaaatctaagccaaaattgggaaaggaaaaggttcatgtcactatcatcaacgttggacatgtagactcaggaaagttcaacactactggtcatctgatctataaatgtgatgtgatcaacaaaggaaccattgaaaaatttgagaaagaacctgctgagatgggaaagggctcatttgagtatgcttgggtcttggataactataaactgaacatgaatggaatatcaccattgatatctcctaaagaaacctgaggccaaaaatatcctgtgaccatcattgatgccccagcacacaggggctttattaaaaaaaaaaaaaaaaaaaaaaacatgattagagtgatatcaccaaaatggtggatagaagcaatctggcttcactctcctccagaaaaaccaaaaacaactattcagtgtctagcttatcaccaggaatatcccataactcaaaacagaggctgtgaggatctgagtggccacatagaagagaaaaactgcaagcagaagataacaaaaatgggcctgtttaactgcagcatccccttcccaagctgccaggcaccatgcagaaaagttcccccagactgacagtatgtacatcagaaaaagtgacatctagatgaagagccagctttcccaccatcttgggttcctttgcagaaaaatcattcctgcctcaatccgtgggaagcagcctgattgcctctagggtaaaaaaatcctgagggcagctagagacaaaggatggaggcggggctagcaaccccagcatgcaaaacacattggctgctcttcatctaagccaaagaagacaccaaatgagagagaatgttcagcccgtggttcctctggacacaaaatcctaaccagatgtctcacccaaccaggatatccagtttgggacctcccccaaatcgggaataggcagtaatccaagccgttgcaagagctgcagcaaatctgggcttacagcaccatctagtgccaaaaaagaggcagtaatctcagagtaaggaagctctaattcatacataacctttagacaggcatactcctgaaaaaccaaactaagccagacacaaagactggaataaataacttagcattcatacaaagacatagatatatgtgcataaaaaacaagagcaaatagggagctatgacctctccaaatggaaacagcatggagccagtgaccaaccctaatgagatggcaaattgtagctctcaaatcaataattcaaaataaaagttctgaggaaactcaaagaacacaaaaaagcaactgagaaatttatgagataaatttaacagagaaatcaaaataataatttaaaaaaccagaaatgctggagctgagaaatacaactgaacggaaaaaaaaaatgcactggaaagtctaaacagcggaactgatcaagcaaaacgaacaatcaatgagctcaaagacaggctatttgaaaatacacagtcaaaggacaaaaaataattaaaaggaatgaagaacacttgcaagatctagaggactgcctcagtagaacaaatctaagagtcatgggccttcaagagagaaagagcaatgaataaaaagctcaaagaaataacagaaaatatttccaaacctacagagagatgtaagtatccagttataggaaggctgaagatcaccaaacagattcaacccaaataagactaccccaaggcatacaataattaaactctcaaaggtcaaagacaaagaggggatcctaaaaagagcaagaaaaaagaagcaaataacatataaaggagctccagttcatccgggaatatactctggaccagatgaacctacctgacattttacagaacattttatccaactactacagaatatacattcttcttatcagcacatggaacattctccaggatagactatatattaggccagaaaacaagtctcaacatttaaaaaaataaaattatattaagtatcttttctgactacagtagaataaaactagaaatcaatgacaagaggaacgtttgaaactatacaaatacatggaaattaaacaacatgctcctgaacaaccaataagtcaatgaagaaattaagaaggaaatttattgaaacaaatgaaaatggaaacaacataccaaaatgaatgggatacaacaaaagcggtactaagagagaagtttatagctataaatgcctacatcaaaaaagaaagactcaaataaacctggtaatgatgtaactcaaggacatagaaaaacaagagcaaaccaaacccaaaattagtagaaggaaaataataataataatcatagaaataaataatattgagaaaaagaaaacaatatgaaagaccaatgaaatttttaaaatggctttttgaaagataaaatttaaaatctttagctagactaaggaaaaaaaatgagagaagacccaaataattgaaatcaaagatgaaaagagtcattaaaactgataacacaaaaatacaaagtttcactagaaactattatgatcaactatatgccaacaaactggaaaaactagaagaaatggataaatttctggacacatacaacttaccaagattgaactatgaggaaatagaaaacttgagcagaccaataactagtaatgagattgaagcagtagtaaaaagtctggcattaaataaaagtccaggacctgatgacttcactgctgaagaaaaacttacaccaattatactgaaactatttaatattgcaaaaaattgaagagaaaagaatgtttccaaactcattctacaagaccagcattatcccaatacccaaaccagacaaagacacaacaacagcaaaaagaaaactacaggccaacttcgctgatgaatatagatgcaaaaatcctcaacaaagtactagcaaactaaattcaacaacacattaaaatgagtatttgtcatgcccaagggggattcatcctaggaacacaaagatagttcaacatatggaaatcaataaatgtgatacaccacattaacagaaggaaagacaaaaaccatatatttatttcaataaatgtcaagaaagcattgaataaaattcaacatcccttcatgataaaaactctcaacaaatttggtttaaaggagcatacctcaaaacagtaaatgttatatatgacaagcccacagctaacattacaccaaatgggaaaaaattgaaagcctttcctctaagatctggaacaagacaagcatgcccactttcatcaattctattaaatgcagtcctggaagtccaagatggagcaattaagcaaagggccttcaaattagaaaaaaagaaatcaaattccccttgtttgtagacgatataatgttatatttagaaaaacctaaacactccaccaaaaaactgttagaactgatcaacaaattcagtagagttgcaagaagcaaaaccaacatacaaaaatcagtagcatttctatataccaagagctaacaatccgagagagaaatcataaaagcattttcattttcaatagctataataaaaataaatatctaggaacaaatttaaccaaagaggtgaaagatctctatactgacaactgtaaaaccctgatgaaaggaattgaagaagacacacaaaaaatgaaaaggtatctatcccatgttcatagaatggaagaattcatattgttaaaatatcaatactactagatttcatgtattacctatcaaaataccaataacatttttcacagaaatagaaaaagcagtcttaaaatttgtacagaaccacaaaagacccagatatggtttggctgtgtccccacccaaatctcatcttgaattgtagttcccataatccccacatgtcgtgggagggacccagtgggaagtgattgggtcatgggggcagttttcccccatgctgttctcgtgatagtgagtgagttctcatgaaatctgatggttttctaagtgtttggcatttcccctgctggcacttattcccactgccaccttgtgaagaagatgccttgcttcccctacgccttccaccatgattgcaagtttcctgagacctccccagcaatgcggaactgtgagtcaattatacctctttcctttatagattacccagtctccagcagttctttatagcagtatgagaacagactaatacagtaaattggtaccgaggtagggggggcactgctataaggatacctgaaaatgtggaagcaactttggaactgtgtaacaggcagaggatggaacagtttggagggctcagaagaagacaggaaaatgtggcaatgtttggaacttcctagagacctggagggctcagaagaagacaggaaaatctgggaaagtttggaacttcctagagaatcattgaatagctttcaccaaaatgctgatagtgatatggacaatgaagttcagactgaggtggtatcagatggagatgacgaacttgttaggaataggaataaaggtggctcttgctatgctttagcaaagagattggcagcattttgcccctgccctagagatctgtggaactttgaacttgagagagatgatttggggtatctggcagaagaaatttctaagcaacaaagcattccagagtgacagagcataaaagtttgaaaagtttgcagcctgatgatgcagtagaaaagacaaacccattttctggggagaaattcaacccagctacagaaatttatataattaacaaggagccaaatgttaatcaccaagataatggggaaaatgtgtccagggcatgttagagaccttcgcagcagcccctcccatcacaggcctggaggcctaggagggaaaaatgctttcgtggcctgggtccagggctcccctgcagtgttcagcctgggacttggtgccctgtgtcccagccactccagctataagaggccaaagtacagcttgggctatagcttcagagggtgcaagcccccagcctttgttctgtgggtgcacagaagacaaaaattgaggtttgggaatgtccacctagatttcagaggatgtatggaaatgcctggatgtccaggcggaggtgtgctgcagaggcagagccctcgtggagaacctctgctagggcagtgaggaaaagaaatgtggggtgggagcccccacacagtcaccactggggcactgcctagtggagctgtgagaagagggccactgtcctccagaccccagaatggtagatccactgagagcttgcaccgtgggcctggaaaagccacaggcactcaatgccagcccatgaaagcagccaggagcagggctgtaccctgcaaagctatgggggtggagcttcccaaggctgtgggagcctgccttttgtatcagggtgacctaaatgtgagacacggagtcaaaggagaacattttggaactttcaggtttaatgactgccctattggatttcagacttgcatggggcctgtagcccctttgttttggccaatttctcccatttggaatgagtgtatttacccaatgcctgtacccctattgtatctaggaaggaactaacttgcttttgattttacaggctcataaacagaagggattttccttgtctcagatgagactttggacttggacttttgggttaaggctggaatgagctaacactttgggggactgttggaaaggcatgattctgtttttaaatgtgaggacatgagatttgggaggggccatgggtggaaacatatggtttggctctgtgtccccacccaaatctcatcttgaattgtagtatattgtttgtaaaaattcctgcctatccagagattttttaaaaaaaaacaatactttcttcaattttctcttacaatttaattttttacatttaactttttaatacttcctgtagactaaaagttattttggtgcattgtgtgaaccaaagatcaaagtagttttatttttttctgaaaacatctattcattttttcaattaattgattgtttatattaaggatctaggaggatctaaaattatggaattgtgggcaagggcaatttttgccttacatttcatgtaaggcaaaataatccccatgtgtcatgggagggacccagtaggaagtgattggatcatgggggcaggttcccccatgctgttctcatgacagtgagtaagttttcatgagatctgatggttttataagcatctggcatttccccttctgtcacctctccctcctgccaccttgtgaaaaaggtgccttgcttccccttcaccttccaccatgattgtaagtttcctgaggcctctccagccatgtggaactgtaagtcaattaaacctctttcctttataaattatgcagtctcaggcagttctttataccagcaggaaaacagactaatacagaccctaaatatccaaagcagtcctgagcaaagagaacaaagctggaggcatgatgctactttatttcaaactatactacaaagctgtagtaaccaaaacagcatggtactggcataaagacagaaacatatgccagtggaacacaacagagaacccagaaatgaatccacacatttagagccaactcatttttgacaaagtgccaagaatatgcattggtgaaagaatagtctcttcaataaatgatgttgggaaaactggatatccacatgcagaagaattaaactaaacccctatctctcactgtatacaaaaattaaatcaaaatggattagagacttaaatatacaacctgaaagtatgaagctactggaagaaaacattggggaaatgctccaggacattggtctgggaaatattttatggcctgggaaatatcaaaagcacagacaactaaagcaaaagtagacaaacgggattatatcaagctataaagcttccgcacaacaaaggaatcaattaacaaagtgaagggacaacctacaggatgggatgaaatatttgcaaactatacaactgagagggtattaataaccagaatatataaggaactcaaacaagtcaatggcaaaaaagcaaaggatcctattaaaaatgaacaaagatctgaataaacatttctcaaaagaaaacatacaaatggccaacaggtatatgaaaaactgctcaacatcactaattaccagataaatgcaaaccaaaagcacaatggatatttcactccagttaaatgacttttatcaaaaagacaaaaaataatgaatgctgatgaggatgtggcaaaaggggaatgcttgtacactattggtgggagtgtgaattagtacagatactatggaaaagagtatgtatgttcctcaagaaactaaaaatagaacgaccatgtgatccagcaatcccactgctggatatatatccaaagacaggaaatcagtgtatcaaagagatagttgcacaccaacatttattacagcaccattcacaatagctaggatataaaatcaacctaagtatacatcaacagatgaatggataaagactgtgtggtatatatacacaatagactattactcagccattaaaaagaatgaaatcctgtcatttgtggcaacatcgatgagcctggatgtcactgtgttaagtgaaataagccaggcatagaaagacaaatatcacgttttcacttacatgtgagagcttaaaaagtggatctcacggagatagagagtagaatggtgcttaaaggagtttgggaatggtatgggggggtgggatggaatgaagagaggttgattaataggtgtaaaatgaaggggtggcctgcccctcgtcacccacagtgacgagaaacactgtgggtgtttctcgtcaggtgggacgagagactgagaaaagaaataagacacagagacaaagcacaggaaagaaaagtgggcccaggggaccggcgctcagcatacggaggacccgcgccggcactggtctctcagttccctcagtatttattgatcattatctctaccatctcggagagggggatgtggcagaacaatagggtaatagtggagagagggtcagcaggaaaacatgtgaacaaaggtctctgtgtcataaataagtttaaggaaatgtgctgtgccctgatgtgcacgtatacaaacatcttggtgcattaaagagcagtattgccactagcctgtctcacctccagccttaaggcggttttctcttttctcagtaaatagaacatacaatcgggttttacaccgagacactccattgcccagggacgagcaggagacagatgccttcctcttatctcaactgcaaagaggacttcctctttcactaatcctcctcagcacagaccctttacgggtgtcgggctgggggacggtcaggtctttcccttcccacgaggccatatctcaggctatcacatggggagaaaccttggacaatacctggctttccagggcagaggtccctgcggccttccgcagtgtattgtgtccctgggtacttgagattagagaatggtgatgactttttttattattattattatactttaagttctagggtacatgtgcacaacgtgcaggtttgttacacgtgtatacatgcaccatgttggtgtgctgcacccactaactcgtcatttacattaggtatatctcccaatgctatccctccccccaccccatgacaggccccggtgtgtgatgttccccctcctgtgtccaagtgttctcattgttcaattcccacctatgactaagaacatgcggtgtttggttttttgtccttgtgatagtttgctgagaatgatggtttccagattcatccatgtccctgcaaaggacatgaactcatccttttttatggctgcatagtattccatggacaagcatactgccttcaagcacttttttaacaaagcacatcctgcatagccctaaatccattaaaccttgactcaacaccgcacatgtctctgcgagcacagggttggggctagggttacagattaacagcatctcaaggcagaagaatttttcttagtacagaccaaaatggagtctcttatgtctacttctttctacatagacacagtaacagtctgatctctctttcttttccccacagtaaaattacacttaaatagaagggataagttgtagtgttcgatattacagtagggtgactatagttaacaatgatttattgtatgtttcaaaatagctagaagagaagactgggaatgttcccaacacaaataaatgacaaatggttgaagtgattgatattccaattaccatcatttgattattacacattgtattcatgtatcaaaatatcacatgtatccccaaaacatgtacaattatcgtgtatcaatttaaaaatacatcatgataggcacctctcaggttgactgtactgtcctgattattgctagtggtgttaacaaatttgaagctagtatctttaagaacgggcagacccatgagcatgcccttctggtttacacactggaagtgaaacaactaattgttggtgttaaaaaatggatttcactgaactatgccatcgccaacagagctatgtggaaatcaataaggaagtcagccctacattaagaatactggctacaaccgcaacacagtagtatttatgccaatttctggttggaatgctgacaacttgctaacatgccttggttaaagggtggagagtcacctgcagagatggcaataccagtgtagcacaccgcttgaagctctggattatatcataccaccagctcatccaactgacaaggcttgtgcctacctctccaggaagtctacaaaattggtagtattggtaatgtctttgtgggcctagtggtgactggtgccctcaaacccagcatgattggtcagctttgctccagttaacattacaactgaaataaagtcttttgaattgcaccatgaagctttaaatgaagctcttcttggggacaatgtgggcttcagtgtcaagaatgtgtctgtcaaagatgtttatcatggcaatatggcttgtgacagcgaaaatgactcgccaacggaagcagctggcttcctgaaccatccagcccaaatcagtgctggctctccacctctgttggattgtcacacagctcacattgcttgcaggtttgctgagctgaaggtggttgatttccttctggttagaagctggaagatgacccccattgtgatttttattgctatggtttctttctaatttagtcttgaggtctctcccttgagaatggtcataagccaagagagccactttctaggagagtcctgaccagggggaaagttaagtttgagtgtgtcagcttggtgagacacaatgaggaagtaaaaacaaaataaatagtggaatagaatactaacaagtacctagaaataagtctagctaaaaatttgcaaaatgtctatggaaaaaaaaactatggaaatttactgagaaactttaaagagtacctaaataactttcaagatataccacgtacatgaattggaaaacatgatatttgaaaatgtcggttattcccaaactgatttatagattcagtgcaacctgaatgaaaatcccaagacgttccttttgtagagctcaacaagctgattctaaaattaatatgaaaatgtaaaggtttatgaatagccaagtccttcttgaagaggaagaataagatgagagtaattgctgtctaatatattgagacttattttaaagctataataattaaaacaatgtagcagttggtatagggataatcaaacaggtaaatgaaatagaatagaaaatccaaaactagtctaacacatatagaaacttgatttatgacaaaggtgtcacagaagtagagtttcaataaaatgctggaaaatgttggtatctatatagataaaacattacattggattcctaactcacaccatacacaaaaatccattcacattgcattacaagtctaaaagtgaaatataaaatcataaacattttagaaagaaaatgtaaaagaatatatcaataaccacagggtagggaaagaaagagaattgacatcaagatacaaaaagccctagccaataaggtttttttttataaattccacacattaaaattacaaacttatgctcatcaaaagataacataaaaacaatgaaaagattagccacggaatggtaaatgtttgcaatacataacacaaaggacacacaaaggaaacttatataatagattttaacaggcttctctgtgtccttcttctccagcaatcaaggaatatataaaaaagcatatcaaggatatatagggtactcttttgattcaacaagaaaaaagcagattatccaagagaaaacttggcagaaaaaagcttggataggtgctccacaaaagaggacatccaaatgactgctactcataagaaaagatgctcaacctcatagaacatccaaaaatgtaaaaacacagtcaataccagatatttgtaataatttggagcaaatggaactctcatacattgctaatgaaaatggaaaatggtccagctgctttggaaaacagtgtggcaatacctaccaaagccaaacacatgcatacctagtaattccgcccaacagaaatgcacatatatgttcaccaaaagatatgcaccagaaggttatagcaggtccatatgaaagtgccaaagattataacaactcaaatgtccgtgattagggtatattcatataatactatacaacaatgggaatgaacaaactatagctacatatgataatatagatgaatctcacaaccagaatgctaagtgaaagaagaaacaaaagaatatatgtagtatgttttatttacacacttcaaaacaggcaaaactaaactatatttttaaaggatgtatacgtaactggtaaaattataaagaaaagcaaagaaatgattatcataaagatcagaatggtggttaccttcagtgggaagggagaaagtatgattgaaaagggacatccagtgagtcttgtgggttgttggcaatgttactgatctgggtgatgattgcatttatgtaccaaaggcatttgtgttttatgcactttattgtatatgttttagttcacaatttttttagttcacaattttaatagggctttaaaaagtaaaaagaaaagagatccaagggcttgaccatgggactctcttatatttggagtatgtttataaactttacattcattcaacattcgacaaatattttttgagcacctactttgtgccaagcaccgttacaggtgctgggaatacaacagggaacaaaacagacaaaaccccagctttcatggaacttacatgctaataaagcttggcaagagtatttcaaggaagatgaagtggttaactatgcaaaatgcttctcaggcacctaggaaaatgaggatgtgaggcatttctacccacttggtacataaaattattgcttttcctctgctttttttctccagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtgagttaaggacagtggaattacaagaaaattaattttatatatttattttcttgctgactataatgtattcccacttttggaaatttttaaagtatagaaaaataattccataattatctttgtgtacgttctatttttcctatgtatttttctccttatgtattcaaattataccatgcagaattctgattcttgtttttttactaaatatcacatcataaacatttcttacgtcattaaaaacacttcctatgtatgtttttaaaatactgcataatagtctattatatgaatttatggaaccatagtttatgtaaccatttattttgaacaagcttttagacagtttcttttttcactatataaataacgctgtaatcacaacagtttttctaagataaaattccagaagtgcaatgtatttgagcatcttaagagtttttcttattaattatttggtaatgtcccttgcacatttgtctttcatggaggaagtgcttttcttattgattatgttaccttatatattagatagtaaaccactgaacattttaatgagaggtactttttcaagtttttgttttctcttaattttataaatgatggtttttgaaataaaacaggttttaatttttaggtagtaacccatcaatctttactttttgacactttcattgcttttatgtttataaaaattcctgcctatccagagattttttaaaaaacacctatactttcctcagtttttctcttacagtttaattttttacatttaactttttaatacttcctgtagactaaaagttattttggtgcattgtgtgaaccaaagatcaaagtagttttatttttttctgaaaatatctattcgttgtttcaattaattgatggtgtatattaaggatgtagaaggatctaaaattatggaattgtgggcaatttttgccttacattttattttactttccattatattctatgataaatatgtataatttttaatctggaaagtaagccttttttaaaagataatatgcattcattctagaatttgtcatgaagaaccttaacttacatatcaactcctggcgttatggtctcttataacccctgcagtaacattttcccttttactctggaatggcttttatgtgtttaggaattttctcctttgcaactttgagttcataccttaaatttagaatacaaaacctcctcaggattaggtttgagttctaacagcatccatcttctgtaccacttcttccagggtattaaaaactttgataaagaccaaaagacaggtatttcttttagggatgtaaaccctaaggaccttaagatcctagaagattattcttgcttttttttttttgtcgttattgttctacaggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggtaagcaggtgtctattgtgctgaccactttttggtttaaaagaaatggtctttgtgtactaagaattttgatatttatcctacgtgcaataagaagctttaaataggagagttgatcattatatttgtgttttagaaatgtcattctggaatctactgaagaggatggattatatttttggaaggtgggaggcaggttggactggcataaaaattgatgagaaatccactctggttcataggtgagagagcttatactcataggattgatgtcttccctccctaggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatggtaatatattccacatccaaacattatcactgtgaaatgcagattgcactttgacaaatgagacttgatccagggacttgaacattgtatttatttagagtatatctgtgggagtggaatcctcatagatgtcagtttttttggtggagtggagagaaagaaacttatataatagattttaacaggcttctctgtgtccttctccagcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtatgagcttgtttgtgctctttcttctacctactctatttgttgagtacttactttaaatggtctaggcactgggaacacaatcagtgatcaaagcagacaagctccatgctcttaagtaatactttttcaaatgctttttaaaccatttgttcaaagcaaatgaacaagataatttcagatatagaaaaattgctaaaaaggaaatagaacagaataaatggataattaatgtcacagtactttcctagggaaaaggaatttattcctttatcatttaccatctcaaatcccatagggcaccagtagtcatccaaagagtcatttgtttatgtatgtaaccagtatattgattaagcactactcataatgttgatcacaacacaattttattttggttcttcactgtccctttaaaatagatttggccaggtgcgatggctcacacttgtaatcccagcactttgggaggccaaggttggaggattgcttgaggccaggagttcaagaccagcctgggtgacaaagcaagacccccatctctacaaaaaataattagccagacatgtggtatatacctgtagtcccagctacttcacctacttgggtggctgaagtggaaggattgcttgagcccaggaggttgatgctgcagtgagctatgaaagtgccactgcactcaaacttggacaacagagcaagaccctgtctctaaaaaaaaaaaaccatccagtttaatagcgggggtaaactttccttatttcttcgtaaaaattctgataagccctgtaacttttctgctcacccttaagtaataaacaggactaaagtcactttatgtcacaaatacagttcaaatcagaaattacaatgtccatcccaagatattaatcaaaattgtaaacttgatttaacttcaatctcccctcctccaacttgagcctgcatcaggctggaagtctgcattggaaaagggagacatggttgagtcctctgtttctgtaccttgtgatgatcgtgcttccccacaacccctttatagctgctgttttgaactccaacatggataggttaaaggtaaggggataagatagttcttacctatttacagctggcaccattgttgtaaactagcttaacactgtttgtgcctggcaatacttgttgactctttctcctgcagggcactttcagggaactctttagagactcccttacgtgactgtcatgaaatccccttgacatgatttcttccacctttactctgggtggtcacttgtgactcatttctcagccctcagtgttcacctgcagcttcttgttgctggggtaactttacccttgtaggcagctctagtggactggatccagagggaactcaccctgacttatctgtttcacagagtccacatctggccaatgggaaacacaccttttgctcagaaagaccctgggaatgtaggtcaatcataatgcagtagcattctcctgtcccaaccatcaaagaattcagtcaccctgtttctcatctcctggggggaggggagtggtcagaactcaatctccacaacccccaactgtaagggtcacgtagcaagcactttgcatttgaggggtccaaaagtagtggaactaccaaatttggtaggtctactctgatatttcgcataaaccaatgtatctcatgctcattttttagtgaaaagaaataatttctgttcctgttggtttttataaggtgtttttgagacagtggaaatgttaccatccaaagctggaatttggcgggtggaatgccttattggcgagcatctacatgctgggatgagcacactttttctggtgtacagcaatagtgagtagcaatgtgggcagaggttccctacctactcagcctacttctttacagctttcttcctttctggaatggttgcttgtgtcaggaaataaatacaagtttacatcattatcaaatttaaaatgaatattgctggtagaaatcatcagagttctcagagtagggcagatatacttgaagctttgaacactttgtacctgaagctctaaataattgacaaaaaaaaaataccacctcattttcacaacttggtaaagctcgaagatctccagtagcagattttggaatttaatgttgatttagttaccagataacttagaaatactacttggaagagtttggagatttaaccctaaacaagtaagagagccactggtctatttatgtacggaccccagtttcttcagctgtaaaatgtgaatcattctagcacctgttaggattaattaaatgaactaatacagtaaaacgttgagtacagttcttggcacatttaaacactaaaaaatagcatttgttgacgttctcccattttcattgacttacatttgagaagctgaattttgtgcacttctagttactgtgttccacccgtttcatttcagagtgtcagactcccctgggaatggcttctggacacattagagattttcagattacagcttcaggacaatatggtaaatactattatttttgctccaagaacctgggctgattatatctttttttaataatctggtggagaatctcagataatgaatccatctccatgcttctattagttctattccataagtgcctctcaaatacatctcctcctctccacttcccactgtggccatcttaactcaggtcaccatcatttcttacctgggcaatgacactgcctccttaaatatcctccctaccttcagtatttcttccttgagtcaattcttttcagtgcagcaggaagctatactttcctatgagcagtaatggtaaagtttgactagggtctatagagaattctcagaaattgttttagagcactactgcccacaggctaaatgcagcacactgcctgtttttgtatggcatgtgagctatgaacagattttccatttttaaataattgtcaaaaagatgaagactatttcatgacatgtgaaattataaaattcaaatttcagcatccgtaataaagccttattttggaacacagccacgtccattaatttacatatcatctatggctacagcagcagtaacatagttgcaacagagaccatataatatgcaaagcctaaatgatttactatctggccctttacagaaaaagtttgccaacctatgttgttgtgaggtaaaaaaaaatcctcttgaaaaggaggcgtgagagttttacaccaaaatagtaacatttttcactaggtggaagggttacattttaaaatgtcttttatttgtatttttactaatttttacttttcattttctgatttttctacaatgaacatacattgcgtaataaataataggcggggcacgttggctcatgcctcccagcactttgcaaggctgaggcaagcagatcacctgaggtcaggagttcaagaccagcctggccaacatggtgaaactccgtctctactaaaaatacaaaaattagtcgggcatggtggtacgcgattgtagtcccagctacctaggagactgaggcaggagaattgcttgaactcaggaggtggaggttgcagtgagccaagatcatgccattgcactccagcctgggtgacaaagcaagactccatctcaaaaaaagaaagaaaagaagaaataatattattatttggtagtgttggtaacaaattgcagtatcagctagttagaggtgctaacaattaacaaaattataaattttagaaaataaaatggacaacaaggataagcaatatccttagatagtaattgatactggtatgccataaagcctttatgtttttctctattttcaccacagcttagattaacctttctcaagacaataattttattctcaagtgtctaggactaacccagctgaatttaatctctgtttctttacttgggcaaaggacagtgggccccaaagctggccagacttcattattccggatcaatcaatgcctggagcaccaaggagcccttttcttggatcaaggttagaaaatgtaatcaatgatgggaaatgtatcacattcaatcaattgcattacttattcctcttgcaagctcaaaggattctatgaatatgagaaaactaaagaacagaatgccttaatgatttgtacaaaagcagtcatgaacaaagagatatggggatagaattgagtatattgatatgtcctgtttctgtattttagtccttctactgggattagaacatctgaatattttctataatattgaactcgtcatctctcaagacagtatatgttattattagatgcttccaactgcccacgtgtccttaagtactccaatcccctttattttaacataaaacaaatggttcacaaatgcaaaccacatgtgtacttttacattttctgtagccacgttttcaaaaatgtgaaattcactttaataatacattttatttaactcaacatatctgaaaatactatcatttcaacatatgatcaatgaggccccttcaaagacagacagatggaaactcttgggtctcttccatgcctcacaaaagctgagggcagcttggaagtgcctgctcagcctctccacctaaacataaggctagatgccttctagaagcccaaacaggaaatggagaaaacattttggtttccatctttgcaaatagcatgtctattaatgccacagcattgttttgtagacactgccaattttgactcaatctgagctgctgttcactaatccctaagtattttttgttggtttgtgcttctgccaaacaacatgttatgttcttcaccttgtatttctatggttattttcaaccttaagtgtatccctatatagagaacatgtttatctatttggccaccctgtgtctgtctgtgctatttaattttttgtaataacattcttatttgggagggcggaattatatcttcctcactagatacaacctgataagactagtaaatagagtgtcctgtctgtgcctagccaatgaaccctgaatgatatactctgttgtttccacttactagatttggcccattgtttcagcttgccgatcttcagtgtcccaaagtatttcctagtttttccagttactgatttgatcagtaaactttctaatactgcagcaaagtcatgatcaaaatattgaagtagacaagacttccttagtatgtgcacaatacaaatcaagctgttaagtccttactacaaccttgtgaggtagatgttactatcatcttcatttcagataatgaaattgaagcatagagaggttattgtggcccaagtcacatggctaataagtgactgagccaaaattcaaattctgatagttgggctccagaaccctaactggtaatcgttgtactacactgtttccggaatgctccctttaagttgataaccatctattaactgtcactgttcacttgtggtaattaaaccagttacaaatccacctagttatgttatcatctaccactattgaatcgccttatcttcaaggtggttttgccatctgtcctactaaggtccagctagactttttatagatctcgtaactttataaaataaaccatggagatggagttgaaagggggtgctgacaaggaagggagttggagaaggcatctattctcgtgagaaggcctgaagagtgcacaacagcctggccccaagacacaagagcactgggctggcttgaggagcaccaggtgaccaagaccaggcaatgcacagggggaagtcagcaggccccatggagatacgcagctgcagtgtttgtacttttatacagtgaaactcattaccaccttgcttacttcctagtagagagatgtgtcttgtagttacactgaaacacctggctgggcacataggtgaagctgttgagtctgtaattgtcaaactgctcccaggtgccaattataatgtagaagaggcacaagaagatgaagtggataagcctggcagtttgtcaagcattcatcagttgtcaagcatttgtcagttgcagaatgtaggtaggctgccaaggctttattgtagcctggttctattgcagctttattctagcaaggctgctggaaaatacaataatcactggtccaagaaagaactcttatactctatctatatgaagaaacagtaaaagtcaattcagtagaaatcatgatttttgtgcctggtgctttcacttttttatgccacaataccaagaggttaaaatgaagtgtctttgattgggaataccatctatctgggaaaagacagggctgcaacttctgaagaccttgacactctgtcctgttaccctgcttcatttttctcctgcgcttatcactacttgatgctataaacaaataaaaacatatatgatataaggtctatttctcctactcaactgtaagttccatgagggcagggctttctttcttgtttactactctattccctgtatctaaaacagtgcttggcacatagcaagtgctaaaaaatattctttgaatgagtgtatgaatggaacttacagtcagctgaaggagacagttattaagcataagagtgatgaccagtccaattgtgtgtgtcaggcatgtgtgaaaacgtgctaaatttgacttgcttattaggacagtaactgatacttctaatgttcttgcagcccatgacctcttctttaagaagtgtccattctgtactactttcccattattcactcattcattccaaagcatttgctatacagcagtattataccagataccatattaggtgctggggctagagagaatataaaagctaacattgattgagtgtttagtatgcgccaggccctgaactcagcacattacatgtattaactctttaacccctatggcagccctttgagataaaaactaatattatcttcactttacagataagttgagacacagaaagttaggtgactcaaatgggttcactgccttaaggatctcagtctaataaggaaagcagaaaagcaaagcaaccttataatatggtgcaataatttgctataatgaagttatatacaaagtgaagtagaagcatagaagaagcagcactaaatttgtctgggtgagtcagagaaggctaaccaggaaaaatagtttctgaactaacacttgaaggaggtgtagcagttcatcactgacagtgatgttggggtgggtctggtttcaggagaggggaggaaattggctttggtctgaggctgaggtgtgggcaaagcattagcttatgtgggtccattagcttatgtgagtccacaaaaggtgtgtgtgtgtttgtgtgtatgtgtgtgtgtgtgtgtgtgtgtgtgtgtgtacgaaatgggggctcaatgatttggtagtggtttggtttgtcaagaagcaggctgggaactcaataagcatctttccattcatttctactgtgtatcccacagcttcacacacacatgcacatttcaacattggtgactgcttcacttgcacacctaaggtaatgatggacacacctgtagcaatgtagattcttcctaagctaataattagtttcaggaggtagcacatacatttaaaaataggttaaaataaagtgttattttaattggtaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtatgtaattagtcatttaaagggaatgcctgaatactttaaagaattttggcagatttcagatattggacaaacactcttagcttccacaaacttaattccaaaaaataatttttcacttatgagcaatagagttattacggacatatcagcaaaaatgtagtagtgtcaaggctcatagatgatagaaatgaagagatgctgtattgatagaaatatgtgattcaggactgtgtggattgatgattgtgagcttgcttatggatatcctaggtttgaggttatagtaggacaatcaggttgaaatgtccagcaggcagtaggtgaaagacaagtttagggggcaaaaccatggatggagatgaagattcatgacttccacataaaaggatgggtgaaactttgggaattgatgaattctctagaggtgagctcaagacccttaaaggcttaaaacctcagcgttattgtctactcttccctcatttttatgcccacaaatctggtcaatcctttatttgcaatgcctctcacatctctttcttctgtttccatttataccgctgttgccacagcccagggtcccatcacctcacacttgatctattgtattacattcctaactagtcttcccccgtttctaatctgttctccgataaaagctgcacatcattttcaggataatcatcagtcgcctgcctaaaacttttcaatgtcttcccattgtctttagaataaagttcaaagtcttcaaatgaccccaagcaagataacttttgtttgcccctttagatccattttcctgcttctctaccctgcttcttgttctgtgaggtgagcttgtatagaatacatcaacaggttaccttgtcctccagcttttggttggatttcaccaacagggagcactggcaaaagattggcatatttattcttctgactttctccttgcagaggagttcactgtatctccccacttaaggtcactgtttccctcagagtggctttttctacctgtactagctactattgctgtgtaccaagccacttcaaaacttgctgtcataacaataaccattatgttttgctcacagattctgtagatcaagactgggacacagtggggatgggtggtttctggagcctcagttaggattatttaacagctgggtgctggaatcatctggaagttccttctcttgcttttctggtggttggtactgactgtcagctaggacagaatctggggttgttgactgatgtaactttacatggattatccctgaggcctggccttccttacagcatgtttcaaggtagttggacttctttttgagggggggtaggaaggtggggggaggacagagtctcactctgttgcccaggctggagtgcactggtgtgatctcggctcactgcaacctctgcctcccgggctcaagtgattctcctgcctcagcctgctgagtagctgggactacgggctcatgccaccacacccagctaatttttgtatttttagtagagacagggttttgccatgttgaccaggctggtcttgaactcctgacctcaggtgatccgcccacctcagcctcccaaagtgctgggattacaggcacccggcctgtagttggacttcttacacgtcattttagggcctccaagtgtgagtgttacagttaacaaggtgaagactacataaccttttctgaccgagtcttctaagttatgtagcatcacttttgttgacaaaaagtgttgaactctataaaatatttgaagagatttattctgagccaaatatgagtgagtatggcccatgacacagccctcaggaggtcctgagaacatgtgcccaagatggtcagggcacagcttggttttatacattttagagaggcttgagacatcaatcaaatacatttaagaaatacactgatttggtccagaaaggcgggacaactcaacctgggggcttccgggctataggtgaatttaaacattttctggttgacaattggttgagtttgtctgaagacctgggattgatagaaagggaatgttcaggttaagataaacattgtggagaccaaagttcttttgaagtcttatagtggctccccttagagacaatagatgacaaatgttttgtattcagatcttagttaatctctttaggattgggaggggctgggagaaaaagatctagctatgttaatagagattctttacagttgcaaatttccctccacaaagaacagctttgcagggccatttcaaaatatggcaaaaaaacatgttttggggtaaaatattttgattttcttccttgtctcataatgttatgccagagtaaggttggaaagtaaatcatgacatataaggttaaataaaacccatctgatgagaatttatgatttgtagggcatgactccccagaccccttagataggaatttgggcaagataaaaaaaaatcagagtttagtcctcactttcaatacattctattggttataagcaaatcgcatatccacccagattcaaggggaagagacatagaccctaatttttaatgggagaaatgttaaataattggtggtcattttttaaagccactacaataatctatccaattctctctttcaggatgtttctctcttctgatcctttcaggtttagggattgtcaacaaacaaaaagttaaaccctgtaaaatacttgaagagatttattatgagccaaatatgagagaccaatggcctgtgacacagccctcaggagatcctgagaacatgtgctcaaggtggtctggctacaacttggttttacgcattttagggagacataagaccgaaatcaatagatggaagatgtacattcattgagtttggaaaggcaggacaactggaagcgaggcggggcttccaggtcgtaggtagattcaaagattttctgattggcaattggttgaaagagttaagttattgtgtaaagacttagaatcaatagagaggaacatcggggttaagataaggggttgtgaagaccaaggttctgtcatgcagatgaagcctccaggtagcaggcttcagagagaatagattgtaaatgtttcttatcagacttaaagagtctgttctatcagtctgaaggtctgtgttgatgttaatgctggtcagatttttctgaattccaaaagggaggcgggtataataaggcatatttgatccccactttcccatcatggcctgaacgtttttcaggttaactttggaaggccctttgccgaaaggaggggggattagaattttattttgggtttacaggatggtaatactctgttcccaccctcctaactagtatctttattaaaccttccacaaattatcctaatttccatgttttctgttccttgctggatcccttgtttcatacagtaattggtgctagaagaaaccccaggaaacagattttcaaaatgcaattctaaggttatgttgctaatatattcaagaaacacagagataacatatttgccaaggaagaaaatgagcagttagggaatccatgacatgtgttagtattatagtttctcagattatcaccagtgatactatgggatgagttgcagatggcaagtaagacactggggagattaaatgacagtggcatttagtcactgtggcaacaaacgtagcattacctgattgtagagtggtctgtcttcttacagccctagagggcatacacatggaaaaagaaatgaaatgttatgaatatatacaaaataagaacactgatgaacatacatggaaaatcaggatgcatgcatagagcttttgaggaatactccgtatcctgtggttgtaggcagatacgacttaggggctgagcataagttgcagagctgcagtgacaattaaatgcttaactccaccagatctattatgctgtggtaagagtaccggtgggaaggagtgaaactctgaggcctgagatggaggcatttaggcagacatggatgaggctgagaattgcaaacctccaaattcccctgaacctcctttgcctgaggaggcaaccactccccagtctctgaagcagtcatccctcttttgtgtaaaagcctttcagtggctataactgagataggtgcctcacaaaccagtgactattctccttagagaccctgtttggacactacgaaagccaggcgagtcacagaaaatgacagcagatcacaaatttaatcaggtggtgatgccaaaaaacaattgcaattccagatatcatatctctgttgaagcaaatttacacagccccaggcacctgatatggaagtattgacctagagaatgttttttcttcatttccatacattagtaaaatcagaatacatttgaatttaccaagtaggaacaagagtattaagtttactgcccatgcatcagggcaatgttagctctcttgttttctatcataatatagactcaagggacctcaaacatctttacatcccacaagcacaatgcctgtccattacactgatgacattatgctgacaggatctggtaaacacataacaaataagcctgtcttgctcttgactttaatgagaatgtaacctgtgtttcactgtttaatataatgttcactgttagtttcaaatactttttatgatgtttaaaaagttttctcctatccctattttatttgcaatggcaactgaattttatcaaatgcttttccagcatctttgacatggtcacatttctcttttgtgttgtcaaattatacttaacattcaatagtgtgctgacaagaaattaacaacccacaggggagcaaagtgagaagaggttaagaagtaaaggccttgatttatagcattggcagatttccctgacataaatactactcccatcatgcctggccccagggatgggaagagatgcttacttacaattggctctcacagaccagtgcaagagcactactgtgctccatttctgggaaaactttcgtcagtcatagtgtgttagttatttaaaacttagctggatccaatttgccaacatttcatttataatttctatatctatattcatgaatgaaatgggtttagctttttcagtagctctacttaccaggttttggcatgagggttatattaaacttgaaaataaagtgggaaagcttccatttttttccatgaagactattgctctagaatagcttatttaatgtaggaatccagtatttaatgagagtaaatgaaaaagccatatgagccatgtgctttatttagtgagagatactaggctatattttccaatcgttatatgattattgctattctcatttgtgttgccttgagttaatgtctgcaaatgtgcacattagagtcatatatcccttcctgtgccatacatctatatctgtatacacacatatgtcttttctccttttttcccttctgtatcaagagttggcaagtgtttgtctattctattaatttttcaaagaatcagctcagttttaaacccaaacgtggttttgaaagagctgtttctagttcatcaatctctgttcaaaactttaaaaattctattttcctttcttttggtttgtttcctacaatctggaggtgaatgcttagttcacttattcttcaatctttgtattttaacgataaggataaattacttacagttattaactactctcatgaggttcattccttgaacagtcactgagcaactactatgtcctgggttctaattcaggggtgggcaaactatagccccagaatttggcccatagcctgcttttgtacggactgtgagttaagaatagtttttacacgttgaaaggattgcaaagacaaacatacaaagaaacaaagaagactgtgcaacagagaccacctgtggtctgtaaagactaacacatttctatcccgcccttgacagaaagagtctgtgggctgctggtctcctctaacggtggtagagatgcctgcacggttaacattaatccttggcaccagaatcctcagcacctaggaaccagatcttgcctaacacgctaatttcagtcttgaccaccttcctccggcgtagcggttctcaaacgtctttgtctttgtactattcacgtataaaatattctttcataagcaacatttatccttttgggaatacctcacaatggggagaaggggaaccccaacagcctttaagggttcactgcttcgctgccaccatttccgacggtttacactgttttaagtgtgaatttggaattgttttcaagttaaaaagcaaactaatcatgtcctctgaaagtatttgcttttggcatgctagaaatcagtgttgacttttgatactgatgtgatacattacgagggaattctcaaaactgctgaaatctggcctcggcccagttatcactgctcttaagcttctgagggagatacatgaatgagcccacggcaaatggaaaacgaggagttttagtgtttcctagaattatgctcagatacccactacctgaccgtctggttatccttcccctcacctccctgacgcaaggagtttggaccagaggcctaaggaggcttctcctgaagcccaaatcccaaactggtcaccagtcatgctccgtaactcctgaacctgacaagaagccagccggccaggtctgcagcccgggttaagaggagcataccaggaaagagccaaagagcaaaggagcatgagcccttcaaccgcttttacaataatttgggctaggcgttcagggctccgtaggacccttcctggcagccaagtgagagaaagaggaatgatggtggaatgggcctctcctgtgcttcccattacttccacactgtcgaaatagaaatagaagcagaaaagaacaccctacaagtcccacccatttggaggcactcaactcacagtgacaaccctccacacctctcccctgcaaaaagacgcaaaacaaaaacacctactccaaactgtgtccttacatctcagccccgaagatcaggattgtgtgcaacttcggcccaaaggatgcatttccccagggttgaaagtttgagaaagaggctatattctgaagagttcttgttgtcaccatcaaaaggattaaaaagacgcaataaataagaaaacagcgtagttggggggcatgctccatttgagccagaaagccttggaaacttaagtgttctcaaacggaacgccatcctgctttgggggaacacggaggctgccttgcagtcacgtgatcgcacaacaccaaagggccacgcactctgatttcacctacttaactaaaagttgcagcaaaatccctattacaggccaggcgtggtggctcatgcctgtaatcccagcactttgggaggccgaggagggtggatcatttgaggtcaggagttggagaccagcttggccaacatggtgagaccccatctctattaaaaatacaaaaattagcccagcgtggtggtgcacgcctgtaatcccaggcaccctggaggttgaggtaggagaatcgcttgaacccaggaggcggaggttgcagtgagccgagatcacgccactgcgctcctgcctgggcgacagagtgagactccatctcggggggaaaaaaaaaaaaaaaaaaaaaaaaaatccctattacaaataaaagctgttgtgatccagactgcatatacctctgcgaatggaaccagaaccgtgaattccaatgcaaatcgatgcatcggcaccagacccgctgcactggatgtatctgcattgcagtcacccgagtacggagcacatcatagatgatctctgcaggttcgttgcccacataggaggcatagcgcaaatttcaaaggaacgaatacatcctggagcccaaacagctatctggttctgctgctggcctcctgacaagtaggtaagagagtcacattttatagacgacggacaccaaaaccacacatgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttaggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggaataacaaaacgcagaagcgggaacgatgtctttttattcctccccagacgcaaacgtggatgcatgaggtttggtaacaggcaaagtcatctggttaacgtgactgatgcaaaaagtccaggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctgatgaggtgcaaagagcgggatcggaggcggggcctggccgggctgtgagcggcgtatgcaaatcgagggtctcggggatgcggatccaagaccctgggaaggtacgcggggcctggcggggcaccagctgctgctagctcggctgcaatgcaagtggtctaggttgctaaaggcatcccacagcctctccatctgaacatgacccaaacgaaactcgtgaccctaattccatgtctgcgcatttctagactgttgtccccccccccccccgccccgactactcagtcctccgtcttccggtccagggccccttgccaagcaccgggtccacctctccgtccccaccccggttgccttagaagtccgtcctgtcgcaacactgcagtcatggtcttgaggcccacccgccccaacgaacaccatcatgctgaggactttcccgggcaggccctgacttgctcagaaccagcgggggtgtccccttcccacccagggccactcccctgcactgtcacccggagagactgctcctctgtgccatccctggctcccacccaaccccagacccccaccacctctccatccctccagctgtggaggtctcacaaccccccaacccatctcaccgcccccccacccccaccccaaggcaaagtgactgaagcgggcagatggcttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgaaaagggtgctcagtagcctgtcgttgtgaaccaccatgtccagcagcaggggagtgatgttccgctctccgctgttctgggcctcgttgcccgccagctccgggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggaggaccctcggcgtctcctcctcctcggcatgctgggcgttgagtgtgctatctcggcttggcccagctaggcaagatggctctcaagaggacagttaccgcgtccagtactgtgtatcctagcgaccagggcccagcccctcattggctagggagccgagaccaatgggcacgcacatccggcgacgggcacgcatgtggtgacggcccctcacaagggacacacgtccgtcaggtgacctcatcactttcccattggcctcgagggagcaggcctgggcctagaagtggctggagggccgtgggggtggggtggggcggggcagggggaatcgcgctggtgaccctctctttgccagtgggaactttccctttctactggatgggaacaccgtgggaaagacaaaggggtgggcgaggggaggacgggtaccacgccttcacaatgttgcacatccatcacgaccacctagttccaaaacgttttcaacaccccgaaaagaaaccgaaacccctgtacctataagcagtcacttgccgcacgcctccttccacaccaccactaccagcccccacaccctcccacacacaccccctgcccccgcccatacacacgttcccgatagtccctggcaacccctagtccatctgctttctgtccatagaggttagcctgttctggagatttcctatagatggaattatacgaccaaatgtgaggccgtgtgtgtctggctgctttcacttagcgtaatggtttcatcagggtgcatccatgtagaggcatgaatcactacttccttcctttgaatgactgagtacgattctgttgtatgaataggaggccacattttgtttacccactcgtcagttgatggacaggttatttcccccttctggctattgtgagtggcactgccatgaccatctctctacaggtttttctttgaatatctcttttcagttcttttgggtctatttctagcagtcaaactgctggctcgtgtggtaattctgtttaacttattgaggaaccaccaaactgatttccacagcagctgtaatctttcgcattcccaacagtagtgcatgagagtcccaatttcttcacagcctcatcaaaacctgttttctgtttgcctcattttgttttgtttacagtagccatcctactgggtgtcaagtgctatctcatggtggttttcattcgtatttcccaaatggctaatgatgttgctgtggtttgagtgcatcccccaaattgtgtgtcttggaaacttaatccccaaattcacatgttgattggaggcgcagcctctgagacggtaattaggattagataaggtcatcggggtgagacccccaggatgcgactggtggctttataagaataggaagagaggcctgaaacgacatacacgctcttgccctctcgccgtgtgataccctctgccgtccccagatgccgggtcacttcccagtccccagaacggtaagaaataaatttcttttctttataaattgttcagtgtcgggtattcaattatggcaacagaaaacagactaagacatcttttcatgtgcttcttggccctctgtacctctgctttggaggaatgtctattcaagccctttgcccattttttaattcggttgattgtattttggctgtgggcttctaaaacttattcatatattctggaaaatagactcttatcagatatgtgacttgcaaatgtttctcccattcactttctggatagagccctttgttgcccaaaagatttacatttggatgtagtccaacttgccaaatgaaaagatatctgtggctttgcctttggtgtcatactgaaggagctgttgcctaatccaaggtcgtgcaaagttacatctccgttttcttcttagagttttatagtttcagcccttacatttagatctgtgatccattttgaattaattctttacatgatgtgaggtaggggtccaggggccttcttttgcatgtggctatccagttgtcccagcgcagtttgttgaggggattattcttcccctccacccattgaggggtgccggaactcttactgaaaataaactttacataaatatatgggtttattcctgactctgagttctgtaacattgacctaatgtatcgatcacgatggcagtaccacccttttcggattactgcggttttgtagtacgttttgaaattgggaagtgtgagtccttcaacttttttcttttctgagattgttttggctatctgagccccttacattttcttatgaattttaggatcagcttgtcagtttttacaaagaaggcaggttggattctgacaggcatcacgatgaatctgtatattgccttggagattatgggcatcttaacaatattaagtgtcccaatccgttaacacaaaatgcctttcgatttatttaggtcttctttaatttattttagcaacgtcttgaaattttcagagtatacatcttgtacacctttagttaaatttattcctcgacattttattgtttcgatgctactgtaaaatgaatcatttccttaatcttattttcatgttattcattgctagggtgtagaaatacaaccgactgttgcagattgatcttggatactgcaactttgctgagccgaatatgctttgctgagcatactcagacagggttggcatattagtccgttcctacactgctataaagaactgcctgagaatgggtaattcctaaagaaaagaggtttaattgcctcatggttctgcaggctgtacaaggcttctgcttctgggcaggcctcaggaaacgtgcaatcatggcggaaggcgaaggggaagcaagcaccttcttcacatgttggagcaggaggaagagagagagaacgcacgcaaagggggaagcgctgcacattttcaaacaatcatcagatcttgtgagcgctctatcagaagaatagcaagggggaagtccgcccccatgattcaatcacctcccactaggcccttccttcaacaggtggggattacaattcgacatgagatttgggtggggacacagagccaaaccgtctcagttttttttttttttcttttgttggactctttagtgtcctctatataagaacatgccatctatgcatctatgaatagagatggttttacttgttcctttccgatctggatgccttttatttctttttcttgactaattgccctgactagaactttgagtacgatgttgagttacaagtggcattcctgatcttagggggaaatcaaccagtctttcaccattaagtatgatattatctctgggtttttcatggatgccctctatcaggttgaagaagtttctttctgttcctggtttgttgaatttattttcatgaaagggtactgcgttttgtcaaatgatcctttttgtacatgattaagatgaccatgagccccctcccccgcccccgctccgccatgcattctgttaatatggtgtattatataaattgattttcacatgttgaaccaaccttacatttgtgggataaatcctatttggtcatagtgtataaagagtggtcaataaacatttcgttgaaagaataggagtggatctggcaagcttcttggaggacaatgtgtgtgttaaagaatctgtagcatgatgagaagccaaggcaccggtgggaggaggggagttgcaaccaattcattaaggctggagagtacgatgccagtggagcagtagtggttgatgtggctgggaaagaggtaggcaggagccaagacatggaggttctattatgccatgctcaggttttagaataccctgtaggctacactgaacccactgtggtctttcagcttgggagtgacgtggtctgatttgcctctagaaatatcaccctggaagctgtgtggagaatagaacagagaggattgtgtgtggagaatagaacagagaggactgagattggaattagaaagctgctgtattataccagtcaagaaatgacagatatctcaactaagacaatggcattggtagataagactaggggacagagtccataaaaagtttaggtagtaaaatggcacacagtagacactcactacatattactcatactggtgaacctagctggagacatgataattcatgtgctcattcttcaaaaaatattgaagggtagtgccaggtatactgtgttaagcattgagacaacaccaacgagaaatattctgttgtataaataggccacattttgtttatctactcatcagttgatgaacagttcattaaatgatttccatggcaggggaggtaaatgttgtcctctatcctcttagattctccagctaggacttaaataagatagattaacaaaagaaaagcatacaaaattttatttggcattttttacatgtacatgggagccctcataagaaatacgaagactcaagtgattaattacagctgaatacttacatactagggtgggaaaagtatggtaaattgtgaaaacataacaagacattggggtttgggctaggagagttaattgtggaaaagtcactaagaaggtaagagttgtgtaacaaggttttttggtgcagctttccctcaagcctggactccccatctctggcaataagaatgtgtttcttcttcctggtatacagataatacctttcacatcagagtttcatctcttcctttcatgaaaaaaaaaggaaggtcagtgtgcccttcttgcatctgctactttcaagtgcctttaaacacaaaataatcaatatgccaaagtggcatattttgaggtggcatttgatcccctacattactgattggatagtgtgaatagtgctgccatgaacgctcctgtacaagtgtttgtttgaacagatgttttaaattgcagacgctcctcaacttgggatggtattatatcctgataaacccattgttagttaaaaccattattagtgtaaattcatttaatacagctatattagtccattctcacactgctataaagaactacctgagacttggtaatttatgaagaaaagaggtttaatggactcacagttctgcaggcttaacaggaagcatgactgtgaggcctcaggaaacttacagtcccagcagcaggtaaaggggaagcaagcacgccttaccatggtggagcaggagagacagagagtgaaggacggaaatgtcatacacttttaaaccatcagatctcatgagaactcactcactgtctcaagaacagcaaggggaaatccacccccatgatccaatcacctcccaccaggcctctcctctgacacacggggattacaattcgatgtgagatttgggtggggatacagagccaaaccatatcagcggctaacctaccaatcatcataatttagccaggcctaccttaaacatgctcagaacacttacaattaggctacagttgggcaaaatcatataacgtaaagccaaatttataatgaagtgttgactatctcacgtaatttattcaatattgcactgaaagtgaaaggcagaatggttgtatgtgtactttaagtacttttatgcatatggattctactgaatgcatgttgctttcataccatcataaagtcaaaatattgtaagtccaaccattataagctgggaaccatccatatttgaggtacatacccatgaatatatttatgggtttatttcttgcttcttaattctattccatttatatatatgtctgtccttatgccagtaccacaaagcattgataactgtagctttatacgaagttttgaatttgggaaatgtgagttatccagctttgttattttttaggattattttggctatttgaggtcttgcacaattacacatgaattttaagattggcttttccatttctgccaaaaaaaaaatggccattgggattttgatgcagattgtattaaatctgtagatcactttgggtagtactatcatcttaataatattgtcttccaattcatgaacacaggatatattttcacttctttatgctgtctctaatatctttcagcaatgttttgtagttttcagtgtacaagtcttttacctccttagctgaatttattcctaagtattttattctttttgatgctattttaaatagaattattttttattttgttaatttcatctcagattgttcattgctagtgtgtagaaatacaactgatttttgcacgttgatcttatatcttgcaactttgctgaattcgtttattagctctatagtgttttgtggattcttcggggttttccatacataagctcatgttcatctgagaataagatagctttacttattccttttcaatttggatgccttttatttctttttttcctaattgctctggctaagacttccaatacaattttgaatagaagcagtaaaagcaggcattcttgtctcgtttctaatgttagggaaatatctttcagtcttctaccattgagtgtgatgttagttttgggtattttatgaatgctctttatcatgttgtggattttctcttccatttctagtttgcttagtggtttttttttttttttttttttttggtcatgaaaaggtgctcagctttatcaagtgatttttctgcatcaaccagaatgaacttgcaggggtttttttccctatattttattaatgtggagttgactgggggattgattgtcttatgttgaaccagtcttgcattattgggataatttccacttgagcatgggctataacctttataacatgctgctggatttggtttgctaatattttgttgaagatttttgcacctagatgcataagggaatattatactcacatattcaattacatgcaatttgtaattttcttttcttgtgatatatttgtctggctttgatatcaagatatggtggcctcatagtatgagttgtaaagtttactctccttttctgtctcttggaagagtttaagaaggattaatgttaatccttccttaaacatttagtagaatttaccagtgaggccttctagcacaatgcctggcacataatatatggaatctaggatttgtatagtcagtcattaactatttgttgaattaataaattgtctccccaagcaggtttctaatcaaggcacaaagattgagtaacgaatgaaggcaaagccaatgtatacagggtattagttttctaatgctggggtggcaaattaccacaaacttaatatggcttaaaacaacacaagtttattatcttacagttcgatagggcagaagactgacccaagtcttactgggctaaaatcaaggtgtcatcagggctgcatttctttctggaagctctagaaaaggatcctttttcggtcgcctgtagtcccagctactcgggaggctgaggcaggagaatggcgtgaacccgggaggcggagcttgcagtgagcggagatggcgccactgcactccagcctgggcgacagagtgagactccctctcaaaaaaaaagaaaaagaaaaggatcctttttcctttcttttccagcttctagaggccacacacattcattaactcatggcttccttcctccatcttcgaagccagtaacattgcacctttgtgactattcttaagtagtcacgtctccctttgactctcctcttctgcctctctctctcactttcaaggcctcttgtgattacattgggccgacctggataatccaggatattctccctattttgacatcagctaattggcaaacttaattccatctgcaaccttaaatccctcttgccatgcaacataacacagtcaaatgttctggggattaaaatgtggacatcactgagagatcatattcttcctagcacatacggtttagtcacaagttaatgatcaacatttattagctatataatactcttaagttcaacataaactttttggatgctgataaaacggaatggcattttacattgatatatacttcatttcaaaacttcttctacttctcaatgattattctgtagcaacaaatttcttttaaatcagaaatttggaaacataacgagacctatctcaaatcaaagatgactatccccttttggagtcagactacacattcattattttagtcaaaatgagacataaaattcaggcccccaagagctgccagtacccacttacgcaggaggtagctagacgaaacaggtagctttctacaaatgattttgcaccatcccaccccagagaggtggtttggagtgtttacttattacctgggatttaattatactagctcttgcaaaagccaaatctaaaggccataaatagaaggtcaaattttctcctatatagaaaggagagcagcagagaaaacaaaatccttggtaaatctttaaacaaagttatatggtttgaatatgttattcattctattttaaccccccaatacagatatatttataaaaaagaatattgtgatttctggtataacttgtttaggaacaaagccacaaatttattaatattttctattccctgggaagaaaaaaatgctacatggcagaataattttttaaaatttccagccgggcacggtggcttatgcctgtaatcccagcactttgggaggccgaggtgggcggatcacaaggtcaggagattgagaccatcctggctaacacggtgaaacaccgtctctactaaaaatacaaaacattagctgggtgtggtggtgggcgcctgtagtcccagctactcgggaggctgaggcaagagaatggcgtgaacccgggaggcggagcttgcagtgagccgagatcgcgccacggcactccagcctgggcgacagagcgagactccgtctcaaaaaaaaaaaaaaaaaaaaaattcccatgatactaaactgatgtgtgatcatataatagacttacactgatacctattttagtgtattcaagcagataaaaaatcccaggtgttctatgagtgatatcattttcagtatttcttatgctgtatgccatggtttaaatctaggcctttcgaattggcattactaccatatttctcaaactgtattccctttctcttgaatatgttatgtaattttgtccagaacccagacatgtcaaggtgtcaaatcccacgttttggatactaacgtgtctcattaattcatacagtgggatcattcattaatgcccacattatagactctctctctctctacacacacacacacacacacacacacacacacacacactacattcttagaagatcattctgagaccagggtggaggataggctgtgcattcccagtactctttcacagctgactgtgtcctctgccagtgttttcaaactttactgcttatgaaacagctaagggtcttattaaaatttagattctgattcagtagaactgacatggtgcccaaggaactgcatctcttttaaaaaatctttatttaggtataattgacaaaagttgcatatatttaagaggtacaacttgatgttttgatatattttgtttttcatatatgatgtttgatacattgtgaaatggtcaccacaagcaagctaattaagatatatctatctctttgcctagctacctttttttgtggtgagaacatttatgacctactcttttagcaaatttcaagtatacaatattgtttactatagttactatatcgtacattagatctccagaactaatttatcttgcataattgaaattttgtaccctttgatcaacatctccctgtttcccccacaccacagtccctagcacctaagattctactgtctgcttttatgagtttgaccatcttagattccacatatgaggtcatgaagtatttttctttcagtgtctggcttattacacttagcataatattttccaggttcatccatgttatcacaagtgggaggattttcttctattttaaggccaaataatattttataattgtgggaatattccatcagatatatatatatcagattgtctttatccctccatccatcaatggacacacttaggttgtttccatatcttgactattgtgaatactgttacagtgaacatgggagtgcagatattcaacatactgattttgtatcctttggatatataacagaagtgagattgccagatcacatggtattcatttttagtttttttgaggaacctctatgctgtttttcataatggctgtaccaatttatttttgcagcaacagtgtacaaaggtttccttttctccacattaccaccaacatttgtcatcttttgtctttttgataatagctatttgctatggtttgagtgttttccccaaaaaacatgtgttggaaacttaattcccaatgcgacagtgttgggaggtagggccgaatgggagatgtttaggttatgaggactccaccctcatgaatggattaatgccgattacaaaagcacctaaggctgtgaatttgaattgctctctcttgccctctttttgcccttctgccatgttatgatatagaaagaaggcctttgccagatgctggcctcttgatcttggactgcccagcctccagaactgtgagccaaatacatttctgttcactacaaattactcagtctgtggtattctgtcatagcagcataataaattagagtccataataagttatagtccataacagactaagacactattctaatagatgtgagggaatatctcattgtgttttgatttgcatttccctgtgggttagtgatgctgagcatcatttatctgttggccttttatatttcttcttttgaaaaattctatttgggttctttgcccatttttaattgggttgtttcttactaatgagttgtttgagtttcttacccattatcagatatacagtttgcaaatattttcatccattccataggttgtcttttcactctgttgattatttcttttgctgtgcagaaagtttttagtttaatgcaatcccagtttctatttttgtttttgttgcctgtgcttttggtgtcatataaaaaaattattgcccaaatcaatatcaggtagcttttttcctgttttcttctaggagttttatagtttcaggtcttatatacaagtgtttaatcaattttgagttgaattttatgtatagtgtgagaaaagggcccaatttctttcttctgcatgtggatattcagttttcccaatatcatttattgaagagactctcttttccccgttgtgtgttcttggcacccttgtcaaaaatctgttgactgtaaatgtgtgaacttatttctgggcttttctattctgttcccttggttgatgtgtctatttttatgccagtaccatactattttgattactggagacttgtagtatattttgaaatcaggaagtatgatgcctctagctttgttcttcttgcttaagattgctttgccaggctgcatgtggtggcccacgcctgtaatcccagcactttgggaggctgaggtgggtggatcacttgaggtcagaagtttaagagcagcctggccaacatggtgaaaccccgtctctactgaaaaaatacaaaaattagccaggtgtggtagcaggcccctgtgatcccagctaatctggaggctgaggtggagaatcacttaaacctgggaggcagaggttgtagtgagccaagatcgcaccactgcactccagcctgggcaacagagcaagactctgtctcaaaaaaaaaaaaaaaagattgctttgcctccttggggtcttttgtgatttcatattaattaaaattttttttttatttctgtgaagaacaccattgagattttgatagggatcacatcaaatctatagattactttgggtagtgtggacattttaacaatactaattcttccaatctaggaatatggaatatcttttatttatctgtgtcttctttaatttccttcataaatgttttctatattttcattgtacaagtctttcatttctttggttaagtctattcctaagtattttattcttttgttgctattgtaaataagattattttctaatttcctttgggatattttatagtgtatagaaacaccactgatttctgtatgttgattttgtatcctgcaactttacagaattcatgtattagttctaacaatttttttttgagtctttagagttttctacatgtatgatcatgtcatctgcaaaaagagataattttactattctcttctatttggatgctttttattttatttattttttaaattatattttaagttctgggttacatgagcagaacatgcagttttgttacataggtatacacgtgccctggtggtttgctgcacccatcaacccgtcacctacattaggtatttctcctaatgttatccctcccctagccccccaccccccaacaggccccagcgtgtgatgttccactccctgtttccatgtgttctcattgttcagctcccacttatgagtgagaacatgcagtgtttggttttctgatcttgtgatagtttttgagaatgatggtttccagcttcatccatgtccctgcaaaggacaggaactcatccttttttatggctgtatagtattccatggtgtatatgtgctacattttcttaatccagtctatcattgatggacatttgggttggttccaagtcttcgctattgtgaatagtgccacagtaaacatacatgtgcatgtgtctttattgtagaatgatttataatcctttgggtatatgcccagtagtgggatttgctgggtcaaatggtatttctagttctagatccttgaggaatcgccatactgtcttccacaatggttgaattaatttacactcccatcaacagtgtaaaagcgttcctatttttccacaacctctccagcatctgttgtttcctgactttttaatgatcaccgttctaactggcgtgagttggtatctcattgtggttttgatttgcatttctttaatgaccagtgatgatcagcattttttcaaatgtctgttggctgcataaatgtcttcttttgagaagtgtctgttcatatcctttgcccattttttgatggggttgtttgtttttttcttgtaaatttgtttaagttctttgtagattctggatattagccctttctcagatggatagattgcaaaaattttctcccatcctgtaggttgcctgctcaccctgatgatagtttcttttgctgtgcagaagctctttagtttaattagatctcctttgtcaattttggcttttgttgccattgcttttggtgttttagacatgaagtctttgcccatgcctatctcctgaatggtattgcccaggttttcttctaggatttttatggtcctaggtcttacgtttaagtatttgatccatcttgagttgatttttgtaaaaggtgtaaggaagggatccagtttcagttttctgcatatggctagccagttttcccaacaccatttattaaatagggaatcttttccccattgcttgtttgtgtcaggtttgtcaaagatcatatggttgtaactgtgtggtgttatttctgaggcctccattctgttccattggtctgcatatctgtttggccccagtaccatgctgttttggttactgtagccttgtagtatagtttcaagtcaggtagcatgatgcctccagctttgtccttcttgtccaggattgtcttggctatgagggctctttgttggttccatatgaagtttaaagtagtgttttccaattctgtgaagaaagtcagtggtagcttgatggagatggcattgaatctataaattactttgggcagtatggccattttcatgataatgattcttcctatccatgagcatggaatgtttttccatttgtttgtgtcctctcttatttccttgatcagtggtttatagttttccttgaagaggtccttcacatctcttataagttgtattcgtaggtattttattttcttagtagcaattgtgaatgggagttcactcatgatttggctctctgtttgtctgttattggtgtataggaatgcttgtgatttttgtacattgattttgtaccctgagactttactgaagttgcttatcagcttaaggaggttttgggctgagatgatggggttttctaaatatacaatcatgtcatctgcaaagagagacaatttgacttcctcttttcctatttgaataccctttattgctttctcttgcctgattgccctggccagaacttccaatactatgttgaataggagtggtgagagagggcatccctgtcttgtgccagttttcaaagggaatgcttccagtttttgcccattcagtatgatattggctgtgcgtttgtcataaatagctcttattattttgagatatgttccaccgatacatagtttattgagagtttttagcatgaaggggtgttgaattttatcgaaggccttttctgcatctattgagataatcatgtggtttttgtcattggttctgtttatgtgatggattatgtttattgatttgcatatgttgaaccagccttgcatcccagggatgaagccaacttgattgtggtagataagctttttgatgtgctgctggatttggtttgccagtgttttattgaggatttttgtatcgatgttcatcagggatattggcctgaaattttctttttttgttgtgtctctgtcaggttttggtatcaggatgatgctggcttcataaaatgagttagggaggattccctctttttctattgtttggaatagtttcagaaggaatggtaccagctcctctttgtgcctctggtagaatttgtctgtgaatccgtctggtcctgtactttttttggttggtaggctattaattactgcctcaatttcagaacttgttataggtctattcagggattcaacttcttcctggcttagacttgggagggtgtatgtgtccaggaatttatctatttcttctagattttctagtttatctgcatagacgtgtttatagtattctctgatggtagtttgtatttctgtgggatcagtggtgatatccccaatatcattttttattgcatctatttgattcttctctcttttcctctttattagtgtggctagaagtctatctattttgttgattttttcaaaaaaaccagctcctggattcaatgattttttgaaggtttttttgtgtctctatctccttcagttctgctctgatcttagttatttcctgtcttctgctagcttttgaatttgtttgctgttgcttctctaattctttaattttgatgttagggtgtcaattttcaatttttcttgctttctcttgtgggcatttagtgctgtaaatttccctctaaacactgctttaagtgtgtcccagaaattctggtacgctgtgtcttcattctcattggtttcaaagaacatctttatatctgccttcatttcattatttacccagtagtcattcaggagcaggttgttcagtttccatgtatttttgtggttttgagtgtgtttcttaatcctgagttctaatttgattgcactgtggtctgagagactgtttgttatgatttccattcttttgtatttgctgaggagtgttttacttcgaattatgtaatcagttttagaataagtgtaatgtggtgctgagaagaatgtataatctgttgatttggggtggagagttctgtagatctctattaggtctgcttggtccagagctgagttcaagtcctgaatatccttgttaattttctgtctcattaatctaatattgacagtggggtgttaaagtatcccactattattgtgtgggagtctacgtctctttgtatgtctctaagaacttgctttatgaatctgggtgctcctgtattgggtgcatatgtatttaggatagttagctcttcttgctgcatttttccctttaccattatgtgatgctcttctttgtctcttttggtctttgttggtttaaagtctgttttatcagagattaggattgcaactcttgcttttttttttgctttccatttgcttggtaaatattcctccatccctttattttgagcctatgtgtgtctttgcaagtgagatgagtctcctgaatacagcatactgatgggtcttgactctttatccaatttgccagtctgtgtcttttaattggggtatttagcccatttacatttaaggttaatattgttatgtgtgaatttgatcctgtcattatgatgctagctggttgttttgcccattagttaatgcagtttcttcatagtgtcaatgttctttacaatttggtatgtttttgcagtggctagtaccagttgttcctttccatgtttagtgcttctttcaggagctcttgtaaggcaggtctgatggtgacaaaatccctcagcattcggttgtctgtaaagaatttcatttctccttcacttatgaagctttaagaggtttaattgactcacagttctgcatggctgtcccataagtcccatgttctttcctcaggaaacctacagtcatagcagaaagggaaataggcacatcttacatggcagcaggcaagagagagtgtgtgaaggaggaactgtcaaacacttataaaaccatcagctctcataagaactcactatcaggagaacagcgtgggggaaaccatccccatgatccaatcacctcccactaggtccctcccttgacatgtgggcattatggggattacgattcaaggtgagatttgagtgggaacatagagccaaaccatatcagtatctaaaaggaaaaaccttcagtttttccacatttggttatgatatcagctgtgagcttttcctatatggtctttattgtgttaagttccttctgtatctatcttgctgaaagtttttattatgaatggatatctagttttgtcaaattctttttctgtattgatcgaaataatcatgtgtttttcatctttcattctgataatgtggtatatcacattgattgatttgcccatgttgaaccatccttgcatcctagggataaataccacttgttcatgatgaatgatccttttaatgtgctgttgaatttggttggctggtgttttgttgaggatttttgtatccgtgttcatcagggatattggcctgtagttttctttcttttcttttcattttctttttctttctttttttttttttttttttttgagacagagtcttgctctgtcacccaggctggagtgcagtggtggtatgatcttggctcactacaacctccacctcctggattcaagcgattctcctgcctcagcctcctgagtagctgggactactggaacatgccatcacacccagctaatttttgtatttttttagtagagatgagttttcaccttgttggccaggctggtctcgaattcctgacctcaagtgatttgcctgcttcagcctcccaaagtgttgggattacaggcttgagccaccacacctggcctggcctgtagttttcttttctagtgttgtttttgcctggatatggtatcagggtgatgttggctaataaattgtattttgaagtgttctctcttgtattttttggaagagtttaagaaatactggtattaatacttcgttgaatgtttgatggaattcatccatgaagccattggtcctgggcttttctttgttggaaggtttttgattactagatttaatatccctatttgttgttagtctgttaaggctttctatttctttgttattcagttttggtatgttatatgtttctaggaatttatccatttcctctaggttaaccaatttgttgacacttataatagtcccttatggttctgtctgtttctgtgacatcagttgtagtgtctcctctttcatttatattttatttatatgagtcttctctctttttttcgtagtctagataaggacttgtcaattttgtttattttttcaaaaaaatcaactcttagttttgtcagttatttccaattgtttttttattctcttttttatttatttctgctctagcatttattatctcctttgttctgctacctttgggcttagttttttttttcttctttttgtagttcctggaggtgataagttgggttgtttatttcatatgtttcttctttttaaatataggcatttattgctataaatttccctattagtatgcttttactgcatcctttaagttttggtatattatcaagattttggtttcttctgtgacccaatggtcgttcaagaatgtgttgtttagtttccacatatttgtgaattttcgtgttttcttattgttattgatttgtagtttcaatccattgtggtcagaaaatatacttggtatgatattaatcttcttaaatttattatgacttgttttgtgacctgaaaggtgatctgtcctgaagaatgttttgtgtgtgcttgataattctactgttgggtggaaagttctgtatatacattttaggtccattgggtctattttattcttcagttctgttttgtccttattgattttctgttgggatgatctattcattatagagagtggagtattgaagtcaactatattatattgttatctatttctccttccatgtctgtcaatgtttgctttatatatttaggtactttcgtgttgggtacatatatatttataattattacatcttcctgttcaagtgacccttttattatataatgaccttctatgtctcatgtcacagttttttacttaaagactattttttctcatacaagtatagccacccctgctctcttttggttacagtttgcatggcataactttctccaccccttcactttcagcctatgtatgtccttaaatcaaaagtgagtctgttatcaacaacatgtagttgggtcctgtttatttttgtttcttacttcccatctctgaattgttggctttttaaaaagcccattcagttactctgtgtcttttgactggggagtttagtcaatttacacttaaagtaattattgataggttaggactttctgttgccattctgttaatagttttctgttttgtagttttcttgttcctttcctctttttctttctttgtggtttgatgatttttgcttggatgtgttttgattcttttctctttatcttctgtatatctactgtgtgggggggcggtcgggggggttaccacagggatcaaattgaacactttatagttatggcagtctgttttaagctgacaacaccttcaatcacatacagaaactctatactttactcattccccccgccacaactttatgtaatcgacgtcatattttacttccttctatattgtgtttccattgacaaatttctgtcactatagttactattactatttttgtcttttaatttataaattaatattaatagtgatttataacaatcattatagtgttacaatagtctatgtttctctttatatttacctttagcagtgaaaggattcatatgcttttgtgttactgttttttttttatttcaacttgaagaactattagcacttcttataaggcaggtctcatggtgacaaaccccctcagtttttgtttgagaaaggctttatctttgtgttcattcttaaaggacagtttttccagataaagtattgttgattggatttttttctctcagtactttgaatatatcatcccactctttcctgacctgcaaggtttctgctgagatatccactcatagtcttatggagctcccctataggtgacaattcactttcttcttactaccccaaaattctcttttgtctttgttgaaaatttaattataatgcatctcactgtagacttctgtgggtttaatgtatttggttatctttgggcttaatgaatccagatggcacttcccctccatagatttggggagttctcacctattatttctttaaataagtttcctttctctctctcttctccttttaagatttctataatgcatctatcattttgcttgatgatgtcccataagtcctctgttcttccttcactctttctcattgttctttttattccgctaactagataatttcaaatgacttgtcttcaagtttacaaattctttcttctgaatgattgagtctgctattaaagatcgctattaaattttttagttcagtcattcttcagctatattcagcaatattctttagctacaggatttttatttggttcttttttatggtttttatttctttattaaacttctaatgttgttcatgtattgttttcctcattttgttagtcgtcttcctgtatcctcttgtagctaattgagcttctttaaatgattattttgaattctttgtcaaaaatttcatgaatctccatttcttcagggttggttactggagctttattagttccctttggtgatgtcatatttgcctgattcttcatgatccacatagcctagcattggtatctgtgcattggagtgagctgacacctcttctggtctgaagttgggtactcagacaatgggcccattaccagggctttggataggtgtagctctcactgggtccttgagtgggcaggactgcctgcagaccatgatgcagtgggcctggagctgggtcaaagggctgcttcagggtccccacttgggcccacagtcagtgggcctgttatgggggcacaggtaagtgtggattcaggcaggactgtctccagaacatggtacagcaagactggagttggctcacagggttacttctgagtccacagtcaggtctagttggtgggcctgcttccagaggtggactggcatgactcccacctgtttcctaagtaggcaaaacttccccaagaccatggtagtgtggtactgaagctgctttaggtacagggctgcttcagagtccacagttgggagccctgttactggggttgccaatgggagttgctcctcccagattcctgggcagatagggatagtggtaggaccacatacaaacaactctggagctaagtccccagggtggtgggctgcttctgggtccacaaccagaactacagttgacaggcctgccgctagaatgtgggcctgccttattaaagtattcatctttgttcttgagctctaccagggtttctcaacctcctacctgaatcccaaggctcccacaaagacacttttgtccatagatcattgtcaaattattgttcctgtgggggaacaagagctagggacctcctatcccatcaactcactgataccgttctcctgatgctgcattttgaattgccctcaggtgatgctgctactcctggtctgtggaccatgctggagtagcagagcccaaatggcttcctcaacttttatgagccttttacaggaactcaaagtagaaaataacttcacttgccccagacctaataatttcctttgttcccacttcttcttggtgctttcctcctttgtgtctaccatcgtaacatccatctaaccatagttgtcttatgtagatgttggatgctgttgagaaacgcacaaagcaaattagaaggaagatatgattgacagaaattgctttttactctgtattcactttccatgtatttgtgctaatctctccatacaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagtaagtgccaagtcatcccatatccttcttccctcaaccatgggtagggtgactaactgttctagttatcctgagactgggggaggggttcccggtatcaggacacaaaattgtcagtgctaaaaccagcatagtcctgggcaaacccagaaataccattcaacccagcagtcccatcactgggtatataatcaaaggaatataaatcattctgtcataaagacacatgcacgcatatgttcatttcagcactattcacaatagcaaaggcatggagtcaacctaaatgcccatcaacaacagattggataaagaaaatgtggtacatacataccatggaatactatgcagccataaaaaagaatgagatcatgtccttttcagcaacatagatgcagctagaggccattatcataaatgaactaatgcaggaacagaaaaccaaatatcatgtgttctcataagtgggagctaaacattaaatgcacatggacacaatgatggacactcaggaggggagaggttgggaggggggtgtgggttagaaggttatgtattgtgtactgcactcactacctgagtgaggggatcattcatacaccaagcctcagtgacatgcaatttacccatgcaacaaacctacccatgtacccctagaatctaaaataaaagtagaagaagaaaagaaacaaagaaaattaaagagtcacacaaagtgggaagagctggctggaaaacagatagcaataacagaattggccgggcgtggtggctcacacctgtaatcccagcactttgtgaggccaaggcgggtggatcacgaggtcaggagatcaagaccatcctggctaacatagtgaaaccccaactctactaaaaatacaaaaaattagccgggtgtggtggtgtgcgcctgtagtcccagctactcgggaggctgaggcaagagaatcgcttgaactcgggaggcagaggttgcagtgagctgagatcatgccactacactccagcctgggtgacaaagcgagactccatctcaaaaaaacaaaaacaaaacaaaacaaaacaaaaaaccaataacagaatctgtgcaaaagttaaaacctgagaaatgatattatgatgacagtagccctagaatatcagtggaagctgctcagtataactgaggctgaagcatgtccttgtgataaccttcttttttcttttctttgaggttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtaagaggcaacagatttactgtttaactgactcagagcagtggttggggaaaaaatcggggaaggccttgactgtttcttctgaggtatttctgtcaactgttagttctaaaaagtgtgtcaaggaagtttggttatgggcagacaaccacacaggcatttgggggaaatgatctctaattgaacctcctggaagaagaatctctatatctagtactgagctaatatctgtcaaagaattgtagaagctaaagtccattttacagataaatatcaacaattagctttctttccaggtttctcattacatcaatgaaaagtaaacatttactgcacatcttagtatccctaggatgagcctagggatacaaaggtgaattgtgaaaaattttggccctgaagttgcttagagttgaataagagagactgactagccaatagaaagtggaggctgggtgcggtggctcatgcctgtaatcccagcactttgggaggctgaggcgggccgatcacaaggtcaggagttctagatcactcttttgctgaggcaggataatcgcatgaacctgggaggcggaggttgcagtgagctgagatcatgctattgcactccagcccaggcaacagtgcctgactctgtctgaaagaggcagagagagagagagagagaaagaaaggaaagaaggaaggaagaaaaagaaagaaaggaaggaaggaaggaggccgggcagagtggctcacgcctgtaatcctagcactttgggaggcctaggtggcagatcacctgaagtcaggagttcaagaccagcctggccaacctggtgaaacctcatctctactaaaaatataaaattatctggacatggtggtgggcacctgtaaccacagctactcgggaagctgaggcaggagaatcggttgaactcgggaggcagaggttcagtgagctgagatcatgccattgcactacagcctgggtgacagagcaagactccgtctcaaaaaagaaagtagagtgagaagtgctgtggtatggttaagagggatttgggaatttctgggagtaaatggtgaccaagaggctactagtccaactctattgccctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtaagctggtctccttggaaagaaagaaagaaagaaaaaaaataccacctctcctagagcttaacataacataaaaaggttgatatatgaccaaattttcagagcaaaatttattaagtacctatggtagcaagacattgtaaaaggcattctgagagaacacagtgactttaagaaaaaggtaaaatactgagaaaagggcagagtagatccaagagttaattctcctcatcagcaccttgattcccaagcctttttgacctttaagtttagtggtccaggaagtcttcattcttaatctgggtttgctggataattcaacaaattgtcctgattaaaagacatgacataaagtcttatcaccccatgagtaatgggggaaggaatagttcctctctttggtattttttatattcttttttcaccaagaattaaccatgatgtggtccttaccaatctctctaatacagtctcttgccacttggctctttaagctccatccatactaagaaattctcaggtcactaaatacagccattatatctcataccaggcttttaaatagatactatttcttctacctggaacatttttctagctaccctctactgccactttcacctgactcattcgttaagtctcaggtaaacatcatgtccaagaagaattcccttatccatcaaggctggatgaaagacttcaccaaactggcagtttggtgaactgaagtctagacattggatattctagaagaaaaattcccatttaaaaaaggttatatctctgattagtgccacaacatgatgaactttcaaaatatgctaagtgaaggccgggcgcggtggctgatgcctgtaatcccagcactttgggaggctgaggcaggcagatcacgaggtcggtaaattgagaccatcctggctaacacagtgaaaccccatctctactaaaaatacaaaaaattagccaagcgtggtggcgggtgcctgtagtcccagctactcgggaggctgagacaggagaatggcatgaacccgggaggcagagcttgcagtgagccgagatcgcaccactgcattccaacctgggcaacagagtgagactccatctcaaaaaaaaaaaaaaaagaaaatacgctaagtgaataggccagacataaaaggatagatattatatgattctacttatatgagtgtgttagtcagggatatccaaagaaatagaaccaataggagattctgtctgtctgtctctctctctctgtctctctggatgagctaaactgttttagttcaagactgaaagcaggaaaaagctgatgttccagtccaaaggcagacaggcagcaagaatactttcttacttggggaagactcagtctttttgttctattcaggccttcaactaattggatgatgcctcccacattagggagagcaatctgctttactcagtctactgacttcgatgttaatcccattcaaaaacaccttcacagaaataaccagaataatgtttgagtaaatatctgggcaccttatgaccaagtaaagtagatacataaaattaaccatgacaagtccaccccttgtcaatgtagcacccatcatacacatctcctttatctctaagtagagacaaaaatgaggtcataattccacctaacatgatataacaaaacttggctggtattgataactaccttcttctactacccattctgtattgactttgccttcagcaagcatctcagctgattgtggttctttacctgatgaggtgacccaaacctttattcctgaagagcctgggccactagtagtcctgcatggattgggttgctgtagtttcccattgaccagaatcatagggcctggtaatactaagagacactctaagggatctattgtattccagacacactcttccatacctccattgtgaagcagtagttcagtttccttccaggaaggacaaaacgctgccccttccatgatgaacatattccaatgtaatcaacctgctgccagatagctggctgatcatcctgggaaatactgccatactgaggactctgtgtttgtctctactgctggcagattgggcacttagcagtggccatagccaggtcagccttgttgaatagaagtccatgttgctgagcccatgcatagcctctatccctgccaccatggctactttgttcatgagcccatcaggcagtgacataggtggctgagtaaaaaggatgactggtatccacagaacaggtcatcatatctactttttttttgagatggagtcttgctctgttgcccaggctggagtgcagtggcacaatctcagctcactgcaacctctgcctcccaggttcaagcatttctcgtgcctcagcctcccgagtagctgggactacaggcacgcatcaccatgcctggctaatttttgtatttttagtagagacagggtttcaccatgttggccaggctggtcttgaactcctgacttcaggtgatcctcccgccttggcttcccaaagtgctgggattacaggcgtgagccactgcacccggcccatcatatttacttgattattgaaatccttatctgctgaggtcacccttcgttgagcactcacatgggacataaatatattcacatcctttgcccattcagagagatctgtccacatacctcttccccaaatttctttgtcacctgttttctaatcatgttccttccaagtccctatctggacaaagcactgactacagcccattacttgacatataattgcacacctggccatttctccttctaagcaaagtccacaaccaggtacactgcctaaaattctgcccactgtccttcatgggtatctcagatcgggactgtccacttttgtgtagtacctgcatatcgtgcagaaccgtctgtaaaccaggcccaagactcctcttcctctgtaaactgatcatagggaactcccaatggggccataagtgcaggctgggagagagaaggcagggtagcagaaacaggcaccatggacatttgggctacttcttcatgtaatttacatgtgttttcagtacctgctcagacatgatcatgtatataccacttccatttgatgatggagtgccattgttcatacccaactttatggcttggtgggtcagataacacctagttcatgatgggcagttcaggtcacatggcaacttggtggtctgtggctaagcattcagtatctactaaggcccagtagtaggccaagagctatctcacaaaaggagaacagttattcacagaggattacaggaggatttctcactacagtagcccctgctccataggtcagggaaccaatgtgaagatcctgctagctgctcaatatatctgttccaattacgcattccaggactggggaaataaccacaagatagtctcacagatcctctgcatccactttgagatggacttgagctaaaattccattgatcatttgaccctccataagcccatactctgactggtggaccacagtgacattttgggtctcctgaaattagtgccagttcagagccattgtccagtagtccctgaaaggtctgattaattatttttcttcagtgcacatttattctgatagaaaggccatatgtccctttggggaaggctgagagaaagagtggcagtattcttggcagtgtaccagagtccttcctcaaggagactgagcctccccttcattcaaggagtgctgggtctgtaaacctgctcaagtctgggaattgattgagaggccgtgactctgtttttattattcaggttagacttttgttcacttgacctagaacttttccacttatgcagttcaagaatttggtaggcattctatctatatcacatctaggaacactataatctactagccaacaccataggtctgtgcaagtcatactattctaactgctgctttgactctgctgtcccttatggtaaccacacttaccttgcctttggcagttgagtgctgcccattggccccttccaccccaggatccaattattcccattgtatttaggttttctaattcagtgactgcaggtcctgctgtaaggtgtcacctacagagaagagtgatcacagagcccttcaaggatgctgaggttcccctcacaaatttattcctcaaagtaatagtgagatctgtgtcttctgaactctcccagtgttggtgagtatgtcttaaatgacaaattcactctagcatttcaatctcctttcttctacattaaaccagggcaagtctgaaatttctagtttgctcactgtgggccatcttttggtctgtgtttcagccaaccaattaaactgttagaggccttcctaattccctgagatgcaacattaagtccagaatctctgcttagtgggcccatgtcaataaatttggcctaatccaactttacgtgccttccaccgttatctcacatccttagtacccattcctatacatattctctggattcctgcttgtgtaaattagaaaactcaagtcatgattttggagtgtagtgcaccttgtcatgggtcaccttcatacctcacctcgcctgctgggacttgagtgtagttatagatctaataacaaagaggggtggtagggtgggtcctgaaggaatcagcattatcttgcatggcagttgcctcaggggaagccattacagtttcctcaggcagtgcagggttaatccacttagactggagtagagatactgccaccacagggctggagagaaaactttcactgacaaagaagactcatcaatatttaggagctcaatgtccccagcttaatcagggtcttccacacatacctaatccaacttgtagtgccccattctttcccaatcactgcccttgctttaacagtagacaccctgcaaagctgggagtttggcttgctttgtaattcagttagtcacaggatgagatttggcatttgattttcagcaatctcagctctgtggctacagtagataagggtctccttcagggcatacatagaatctgtcaagtcatttatgcagctcttgagctgggaattcaaattcctgagctcctccttttctttcatcactttttccagcaacattaggagcaaccgactaatcccatcatattcattagtttgacaaatatgttcacaagtgtcaatatacatagtcaccaagacccttgcttcttaaaagtagttgattaggagtatccaatggagatattttgcatatacatattttttgagatggagtctcgctctgtcacccaggccggagtgcagtggcatgatctcagctcactgcaacctccatctcccaggttcaagcgattatcatgcctcagcctcccgagtagttgggattacaggcacctgcctaatttttgtgtttttagtagagacagggtttcatcatgttggccaggctggtctcgaactcctgacctcaggtgatccatccacctcggcctcccaaagtgctgggattacaggcgtgagccaccgcgcccagcctggcctacatatttctattgccagatcatgccatggacaatttttactactgaaaatagtcattagtgtctttaaatttcatcaggttacagaaccaattccagaaatccaataacaaatttataaaatttatccttaaaattctgttcctttagaatcactcttggtgtgaaaatctgtattagtcatggttcccaaagaaacaaaaccagaaccaagaggagatacatacacacacacacacacacacacacacacaaggaattagctcatgtgattatggagtctgccaagtctcaagatctgcagggtgagttggcagcctagagaccccagagagctgattcgtagttccagttcaaagaccagcaggctacagacccagaaagagttaaaatgttttagttcgagcccaaaggcaggaaaaaaactgaagtcccagtttaaaggtagtcaaatagaaggaactgtctcttactaagaggacagtaagcctttttgttatatttaggccttcaactgattggataagttctacccacactggggagaacaatctgctttacttagtctaccaattcaaatgttaatctcaccaaaaaacactctcacagacacacataaaataaagtttaatcaaatatatgggcaccccatggcccagtcaagttgacacataaaattaaccaccataatgaggtatctagagcaggcaaattcataaagacagaaagtagaaaagaggttaccagggtcttggaatggggaagaaatggagagttatttttaatgagtacagagtttctgtttggggtgatgaaaaagttctggaaatggatagtggtaatgggtgcacaatattgtgagtatacttaataccactaaattgtacacttaaaaatgattaaaatggtaaattttatgtatattgtacaacaataaaaaaggctatatcactgacaatgcattgttgtatttagcaaagaaaggggaatctccagcctccccatcaacaaaaacccccacaaacttctattttaaaataatgagctgaaatcatagcggagaggtgaataatgagcaaatataaaaaggaagacctttcctcagacagaatgcccatattaatgttgttactggaagactaagccttgagcaaaatgcaaggagaactcagtgtgagaattctgcattgtcatgaatcccagaaggaagctagagaagttgcagataaatattatcctctggcacctggaagaaccattctcaacctactctagaaaaaaagcacctccagtttaggcctccaggattcctacatattaaaattataagatcacagacatagatcagcaaacatgcaagacaacaagacaacttgagtacaagtgaacagaaacaatcaattcagatttaaaacttgaagaacaccagatattgacattatcggatacataatatgaaataattatgtataaaatctttaaagtaataacatatggaaacatgaaaataaaagacaaattatccaacattattaggcagttgaaaaaaaccattgcaggttacaaagtcaacatgcaaaaatcaattgtatttttatatactaacaattacaaatatgaaaaggaaaacagaaaagtctatttacaatagcatcaaagataatacaatatttaggaataaatttaacgaaggaggtgcaagtcttgtccactaaaaacaaaaaaacccagttgaaagaaactaaagaactgtctggtctgaagacagcaaatatggaaaattagcaactagaaaaaaattaaaaattaaaaattaaaagagaaattaaataactaaataaatgaaaaggcatcctggatttatggatttgaagacataatattcttaagataagaatattaccacaaaccatttgcagattcaaagcaagcattctgggtttttttgtttgtttgtttgttttttgatttgagacggagtctcactctgtcgctcaggctgcagtgtggtggtgcaatctccactcaccataacctctgcttcctgggctcaagcgattctccggcctcaaagcattctctatcagaatcccaaagacatttttttttttgaggaatagaaaaatctatcctaaaattcagatggaatttcaagggaccctgaatagccaaaacaatcttgaaaaagaacaacgttggaggagtcatacttcccaatttcagaacttactacaaagctacaagaatcaaaacagggcagtacttacataaatatagacacatagatcaatggaatagaattgagagtccagaaataagcctatacatctatggtcaattgattttcaataaaagtgccaagaccattttgtgggaaaagaatagtctcttcaacaaatggtgctgggacaattggatatccacatgcaaaagaatgaagttggatctttaccatatacaaaatttaactcaaggctggatgtggtggctcacatctgtaatcccagcactttgggaggctaaggctggtggatcacttgagctcaggagtttgagaccagcctgggcaacacagtgagactctgtatctacaaaacaagaaaaaaaaattagctggcatgatggtacacacctgtagtcccagctactagggaagctgggataggaggatcgcttgagcccaggaggtggaggctgcagtgagccatgatcgcaccactgcactccagcctgggtgtcagagcaagaccctgtctgtaaaaaatcatttaactaaaaatgtatcaaaaaactaaatataaaagctaaaaccataaaactgtaagaaaaaacaaagaggtaaattgttatgatactggatttggcaatggtttcttagatgtgacaccacaatcacaagcaacaactctataaaaatatatatagtaggcatctttaaagttaaaagcttttgtacatcaaagaacactatcaagaaagtaaaaagatgatctacagtataggagaaaaaaattgcaaatcatatatctgataaagggcctagtatcccagaatataaaaagaactcttacaactcaacaacagaaagacaaccaaattttaaaatgggtaaaggacttcaatggaacttctccaaagaagatatacaaggatccaacaaactcatgaaaagatagacaacatcattagttattagggaaatgcaaatcaaaaccacaatgagatagcatttcaaacctgctaggatggctaaattaaaaaaaaaacaaaaacaaaatgtcaagcgggaaaataacaagtgttagcaagaatataaagaaattggaaccttccttgatgatgagaatgtgaaatagggcagccactgtagaaaatattttggcagttcctcagtaaggaaaacatagaattaacatagacccagcaattctactcctgggtgtggacccaaaagaattaaaagcaggcactctaacaaaaactaatatacaaatgcatatagaagtactattcataatagcaaacaggtgaaaacaattcaaatgttcatcaagtgatgaacagataaacaaaatgtggtctatccatatatggactattatttattcataaaaaatcaaagtactgatccatgctaaaacatggatgctccttgaaagcattatgctaagtgaaagcagccaggcacaaaaggccacattccacttatatgaaatacccagaatagcaaatccatagagacagaaaacagattagtggttgccagaagctggcagaaggagtgaatgtggagtggcttcttaataagtattgaatctccttttggggttatagaaatgttctggaactagatagtggtgatggctatataacattgtgaatgtactaaatggcactgaacttcacactttaaaattgttaaaatggtaaattttatgtttgcgaattttgcaatagataagtcagaagacatgtacattaccataatgagtaacaaactgacagctgatttctaaataatagcaaatatcagaaaataatgaatgatgtcttcacaatgctaaaataaacaatgtgaacccctctctcaaaaagaaaacctaatgaaaatatcttttatgcgttaaagcaaaagaggaaattaggacacagacaggcacagagggacgaccacatgaagatatagaaagaggacagacacctacaagccaacgagagaggccttacaagaaaccaacccttagccaggtgtggtagtgtgcacttgtagttcttgttacaagggtgcagtgagctagggttgtgccactgcactccagcctgggaaacagaacaagaccctgcctctaaaaaaaaaaataaagagaaggagaagaagaagaaaaggaaaagaaaaaaaaaaagaaccaagcctgctggccaggcgtggtaactcatgcctgtaatcccagcactttggaaggctgaggcaggaagatcatctgaggtcaggagttcaagaccagcctgcccaacatggtgaaacccccctctactaaaaatacaaaaattagctggacatgctggcatgcgcttgtaatcccagctactcgggaggctgaggcacaagaattgcttgagcccaggaggcagaagttgcagtgagcccagatcgcgccatcacattccagcctggactacagagggagactccatctcaaaaaacaaacagacaaaaaaaaaatacacacacacacacacacacacacacacacacacacaaaacaagcctgcctaccccttgatcttggacttgtagcctccagaactgtgagaaaataaatttctattgtttaagccaggtgtgcgtgtgaaaatttagaacatatgacaacagcaaaaaagtcagcatgtggataaatagaataaaggattctaaaatccatgtattatctaggaggtaaagatgttaatattaaaccttcataatttgattaatgttgtagtttataggatagccagtaagtaatagaaatacacacaatgtaagactcccaaaatggtagaagaaaaaatatgaaaggataaaatatactcaacaaacctaaatgaaagcaagcaaagagagataaagaaacataaaacaggtaggaaaaatagcaagataagatggtatatttaaattgaaatataacagtaatcatatgtaatatgaatggaccaaatatttcagttaaaagacaaagattgtcagattgataaaaaagcaaaagtagctgggtgtgatggctcacacctgtagtcccagctacttaggatgctgatgtgggaggatcacttgagcccaggaggttcagcctggacaagatagtgagacttgtctctttaaaaaaaaaaaaaaaaagcaaaagtaaattgtgtgcattttatgagtcatatctaaaacattagatacagaaaagtagcaagacaaaaatgggaaaagaaattatgcaaatatctaaaagatatcgattacagctctattgatagcagaaaaatagactttaaagcaagaaagtattgctgaagattaagaatgtgatttcatggctggacgcggtggctcacacctgtaatcccagcactttgggaggccgaggcaggtggatcatgaggtcaggaaattgagaccatcctggctaacatggtgaaaccccgtctctactaaaaaaaaatacaaaaattagccgggtgtggtggcggacacctgtagtcccagttactcaggagggtgaggcaggagaatggcgtgaactcgggaggctagattttaacacatctctcgtcaattgatggaacaatgtatagaaatagaacaattaacatgattcacaagtttgatcttatagacatatttagaaaatagcaccttgaaattgcaaaattacaagggtggttccaacatggccgaataggaacagctccagtctacagctcccagcatgaatgacacagaagacaggtgatttctgcatttccaactaaggtaccaggttaatctcactgtggcttgtcggacagtgggtgcaggacagtgggtgcagcccaccgagcatgagccgaagcagggtaaggtatcacctcacccgggaagcacaaggggtcagggaattccctttcctagccaagggaagctgtgacagatggcacctggaaaattgggtcactcccatcctaatactgcgcttttccaatggtcttagcaaacggcacaccaggagattatatcctgcacctggctcagagggtcccacacccacggagcctcgctcattgctagcacagcagtctgagatcaaactgcaaggtggctgcaaggcagggagaggggcacccgccattgctgaggcttgagtaggtaaacaaagcggccaggaagctcgaacttggtggagcccaccgcagctcaaggaggcctgcctgcctctgtacgctccacctttgggggcagggcaaagacaaacaaaaagacagcagtaacctctgcagacttaaatgtccctgtctgacagctttgaagagagtagtggttctcccagcacagagtttgtgatctgagaacggacagactgcctcctcaagtgggtccctgacccccgagtagcctaactgggaggcacgccccagtaggggcagactgacacctcacacagctgggtacccctctgagaccaagcttccagaggaacgatcaggcagcaacatttgctgttcagcaatattcgctcttctgcagcctctgctgctgatacccaggcaaacagggtctggagcggacctccagcaaactccaacagacctgcagctgagggtcctgtctgttagaaggaaaactaacaaacagaaaggacatccacaccaaaaccccatctgtacatcaccatcatcaaagaccaaaggtagataaaaccacaaagatggggaaaaaacagagcagaaaagctgaaaattctaaaaatcagagtacctctcctactccaaaggaacgcagctcctcgccagcaacggaacaaagctggacagaaaatgactttgacgagttgagagaagaaggcttcagatgatcaaacttctctgagctaaaggaggaagttcgaacccatcacaaagaagctaaaaaccttgaaaaaaaaggttagatgaatggctaactagaataaccagtatagagaagtccttaaatgacctgatggagctgaaaaccatggcacgagaactatgtgacgaatgcataagctttagtagccgatgcgatcaactggaagaaagggtatcagtgattgaagatcaaatgaatgaaatgaagcgagaagagaagtttagagaaaaaagaataaaaagaaatgaacaaagcctccaagaaatatgggactatgtgaaaagaccaaatctatgtctgattagtgtacctgaaagtgacagggagaatggaaccaagttggaaaacactctgcaggatattatccaggagaacttccccaacctagcaaggcaggccaacattcaaattcaggaaatacagagaacgccacaaagatactccttgagaagagcaactccaagacacataactgtcagattcaccaaagttgaaatgaaggaaaaaatgttaagggcagccagacagaaagttcgggttacccgcaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcttgccctacaagagctcctgaaggaagcactaaacatagaaaggaacaaccggtaccagccactgcaaaaacatcccaaattgtaaagaccatcgatgctaggaagaaactgcatcaactaatgagcaaaataaccagctaacatcataatgacaggatcaaattcacacataacaatattaaccttaaacataaatgggctaactgctccaattaaaagacacagactggcacattggataaagagtcaagacccatcagtgtgctgtattcaggagacccatctcacatgcagagactcacataggctcgaaataaagggatggaggaagatctaccaagcaaatggaaaacaaaaaaagaaaagcaggggttgcaatcctagtctctgataaaacagactttaaaccaacaaagatcaaaagagacaaggccattacataatggtaaagggatcaattcaacaagaagagctaactatccaaaatatatatgcacccaatacaggagcacccagattcataaagcaagtccttagagacctacaaagagacttagactcccacacaataataatgggagactttaacaccccactgtcaacattagacagttcaacgagacagaaagttaacaaggatatccaggaattgaactcagctctgcagcaagcggacctaatagacatctacagaactctccatcccaaatcaacagaatatacattcttctcagcaccacatccaaaactgaccacatagttggaagtaaagcactcctcagcaaatgtaaaagaacagaaattataacaaactgtctctcaggccacagtgcaatcaaactagaactcaggattaagaaactcattcaaaaccgctcaactacatggaaactgaacaacctgctcctgaatgactactgggtacatagcgaaatgaaggcagaaataaagatgttctttgaaaccaatgagaacaaagacacaatataccagaatctctgggacacatttaaagcagtgtgtagaggaaaatttatagcactaagtgcccacaggagaaagcaggaaagatcaaaaattgacaccctaacatcacaatttaaagaactagagaagcaagagcaaacacattcaaaagctggcagaaggcaagaaataactaagatcagagcagaactgaaggagatagagacacaaaaaaccctttaaaaaatcaatgaatccaggaactggttttttgaaaagatcaacaaaattgatagaacactagcaagactaataaagaagaaaagagagaagaatcaaatagacgcaataaaaaatgataaaggggatatcaccaccaatcccacagaaatacaaactaccatcagagaatactataaacacctctatgtaaataaactagaaaatctagaagaaatggataaattcctggacacatacaccctcccaagactaaaccaggaagaagttgaatccctgaatagaccaataacaggctctgaaattgaggcaataattaatagcttaccaaccaaaaaaagtccaggaccagacggattcacactcaaattctaccagaactacaaggaggagctggtaccattccttctgaaactattccaatcaatagaaaaagatggaatcctccctaactcattttatgaggccagcatcatcctgataccaaagcctggcagagaaacaacaaaaaaagagaattttagaccaatatccctgatgaacattgatgcaaaaatcctcaataaaatactggcaaaccaaatccagcagcacatcaaaaagcttatccaccatgatcaagtgggcttcatctctgggatgcaaggctggttcaacatacgaaaatcaataaacgtaatccagcatataaacagaaccaaagacaaaaaccacatgattatctcaatagatgcagaaaaggcctttgacaaaattcaacaacacttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgttcgcagacgacatgattgtatatctagaaaacaccattgtctcagcccaaaatctccttatgctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatatgaaggacctcttcaaggagaactacaaaccactgctcaatgaaataaaaggggatacaaacaaatggaagaacattccatgctcatgggtaggaagaatcaatattgtgaaaatggccatactgcccaaggtattttatagattcaatgccatccccatcatgctaccaatgactttctttacagaattctaaaaaactattttaaagttcatttggaaccaaaaaagagcccgcattgccaagtcaatcctaagccaaaagaacaaagctggaggcatcacgctacctgacttcaaactatactacacggctacagtaaccaaaacagcatggtactggtaccaaaacagagatatagaccaatggaacagaacagagccctcagaagtaataccacacatctacaaccatctgatctttgacaaacctgacaaaaacaagaaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattgacaaatgggatctaatgaaactaaagagcttccgcacagcaaaagaaactaccatcccagtgaacaggcgagctacaaattgggagaaaatgtttgcaatctattcatctgacaaagggctaatatccagaatctacgaagaactcaaacaaacttacaagaaaaaaagaccccatcaaaaagtgggtgaaggatataaacagacacttctcaaaagaagacatttatgcagccaacagatacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacgcttttacactgttggtgggactgtaaactagttcaacaattgtggaagacagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaggatctgttcatgtcctttgtagggacatggatgaagctggaaaccatcattctcaaaaactatcacaaggacaaaaaaccaaacaccgcatgttctcactcgtaggtgggaattgaacaataagaacacttggacacaggtaggggaacatcacacaccggggcctgtcatggggtgggtggacaggggagggatagcattaggagatatacctaatgtaaatgacgagttaatgggtgcagcacaccaacatggcacatgtatacatatgtaacaaacctgcacgttgtgcacatgtaccctagaacttacagtataataaaaaaaaagaaattgcaaaattacacattctttgtaagcacacaaaggaaacatgttagaattttccattttaagctacaaataagctacaaataaagtagtctcaaatttcagataatataaaacatgttttctggtcacaatacaattaaagttgatataaataagaaagataactataaaatcttcctatgttagaatcaagaactatacttttaaacccatgtgtcaaataagaaatcataaattagaaaatattttaaactgaatgataacaaggcatgacatattaaaatgtgggaatcagctaaagcaatatttagaaagaaatgtatagcgttaaaaacatatattggaagagaagaaagcctgacaattaatgagctaaggtatgtctcaagaagctagtgaaacagcaaaataaaccaaaaggaagtagaagcaaggaaataataaagatatgaagtaaatgaagtaaaaaagaaacatacaatagagagaataaagaaaaccaaaagttggttccttgaaaattgacaaacttctggcaagagcaatcaagatgaaaagaaggcacaaataatatcagaaactttaaaaaactggacatcaataaagatcccacaaaaatttctgccaatataaaaatataaaaaatgaggatacttattaatattaaatgttctttcttgttgtatttaccagggattaatccattttacctaattttccaaacttagtgttaaaaggttattaatttaaaaaatccagatccagatggctacactaactatattctaccaatttttcaaaggagaaataatattaaccttgcaaaaattctttcagaaaatggaaaaagatggaatgttattcaattatcttatgataatagcataaccttgacaaccaaaccgaacaagaacaatattagaaaggaagataataggcccgttttattcataaacataaatcccaaacaaaatattagcaatatggatccaaattggatttatgctaggaatgcaagtttggcttatacattagaaaactgatataatttatcacagtgacagactgaaggattatacatattggctgtcctaagcagtgcaataagatgagaaaaagaaggaaaatatgtaaggattgaatatgatgaaacaaactcattgtatgtggaagatatgatggcatagatagaaaatccaaaggaatttatatataaattattagaatttttaaaatttttcaagcttgctgaaaacaaaataaataccaaaattaattgtatttctgtatacctgaaacagttggaaaaatagttttaaatagcatttaaaaattccaagcaggagttgcacattcctgtcagataatggcagctgcctaaatctctccacagtcttcaaaaaccatacatacacatacacacacaattttaaattatgactaaaaccacccataacccatctatagaataaccagaagacaaaaagtactataagtttatatttacaagtagaaaataaatatataaatctagccaaccttgctccagagagaaaccctgtctcaaaaaaaaaaaaaaaaaaaaaaagaagaaagcaaatgttggaaattaactgtcctataaaaacaaaagtgaattactaaatcacaagacccacaaacctctttggtcacatctattaaataaattacacttccatttatcaacagtagagggtactcctggctaagaaacctagtaagccacccagccctcatgtctgcctgcataaatcacctcttattgctgaaacaagaaaatgtaaggaatttctaaatgaacagaaaatagcatatgaagcagatggtattaatgttcttgagtttttattccctctttccttgaaaacctcatcaactttaggcatggccgtacggctcatcttgatcaatagaatgtgattggacatgacatatataccacttccaaatagaagctttaaatgtgattttgtgtttgacacactcttttgtgcctctgctccaggctccagactttaagcctctagaacgataagtgaataaatttcttttgttttaaaggcaccaagtgtgtggtgaatttgttacagtagccctagaaatctaatactaacaaaaagaatgttagagttgaattagaagtgtcagtgagaacttaggaatttaaaaaatcatattcttagcactgttcactgagggaatctagaagtaattacactgcagtaataacgagcccatcccatgcccaaatcttggtctctaactaccattttccagtcaaaagaatctgagctccctagagaaatgactttttcaaggctggatcaaggaaactgccaggcaatcttagatgatcttggtgatcttgatgtgccagaagattaatgggatcatgtgaaaagaacacagaaactggtctgaagggcttcctgttggccagatttgagacaatttgagcatcaaaaggaataatgagggtaatggatcataactggaaaatcagtttgcaaccatcaatgtacttactattgaatacttgtaaagaactttaagggttgctaataccattggataaaagcttgttgtgaaacagaatatttgcatggtctcaaagtctcactccacagattgttaggaaagggaaagggttacctttataaatatagagattaggtggacatcttaaccaagtgatcaaacttagcatcatcaataatgggacaatctggcatcgcatgccccctgatttaatgcagtaaggattaagtctaacaaaagatgtacaaagcctccaaatacagcgtaaacatttgtaaaataatctcagaacagggaccttaatgtttctcaaaaatttttccaaatacagaactttatttctatagatgtttatggtatatttgccatgctatatacattatgctatatattctatgtgctgaagatacaacaatgaccaaggtctttgcccttgtggaactgacatttggtggcggagacagaggaaacagtcaataagcatgtaaagagataaaggaaaagatactgaatgctacaaaggaaacaaataagttgagatttagaacaaaaaagagtcctattttacaagaggaataatgaggaagacctttctaaagaggtagctcagcactttgggaggccgaggcgggtggatcacgaggtcaggagatcaagaccatcctggctaacacagtgaaaccccatctctactaaaaatacaaaaaatgagccgggcatggtggcgggcacctgtagtcccagctacttgggaggctgaggcaggagaatggcgtgaacccgggaggcggagcttgcagtgagccgagatggtgccactgcactccagcctgggcgacagagcgagactccgtctcaaaaaaaaaaaaaaaaattgaggcagaatttcgctatgttgcctaggcttgtctcaaactcctgggctcaagcaatcctcctgcctcagcctgctgagtagctgggactccaggggcatgccactatgcttagtttaagaggtggtatttaaactgagacccgaagggtaaaaaacatggataaaagaagaaacagaaggggtaagagccttccaagcagagggaatcacatatacaaaggctctcatgttaaataaaacaagagttgacattgttgagaaactgaaagatcagctcatctgcgatgcggtaaaataggaggaatgcagtgggagaacagatcagagacttgggcaggggctatattaggcagaacttggagaccagagtaagggggccaaggtgggaacagaccgattaaattggcatctcttgggggggtgggggggtggggaacttacccatgcatcattttttaaaagctccaaaggcgattccaataagcagccagggttgggaacctagggggaaaatgtagctagatgaatgaagatggcccaaacgtcttttgttctgatagctaaactctctgtaggatcacagtgttacttcacagtgcatttgccaggaaaagtctcttcccatttggaatccgaagtaaaactgacaccacacttgaagatgccaggattgttagaggaaaatgtcacccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttcagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagt

SEQ ID NO: 4101 - DNA, 186958 bp, human
gataaaaaggaagcaatcctatcggttactgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaaggtaaaggcatgtcctgtagggtctgatcggggccaggattgtggggatgtaagtctgcttggaggaaggtgcagacatcgggttaggatggttgtgatgctacctgggccccaaagaaacatttctgggtaaggtgtgcacacatctgtgttattagcagaaatgctaactgccaattcttttcataggtctgacctatttgttgatattttgttctgttttgtccattgcttctcttcgtcatatgctgctcctccagaatctagagactggagtagagggagggtgaagggacaaagacaaaacttccctctgcctgcccaagcttccatagagagaatcaaggcaatgaaatccaatcaatatcacacacaagtttcatgtctggttctcttgtgtgtacatgcaatgtgtgtttttataatatcttttcctactttgggtgtaaggataatatgagccttgagttcagaagcttttcgtgttttgggggttctggtgcatttaggcagagtattaaataactttatcaatattgtctatggtcatcagttgattcagatttttctacctcttcttcagtaaatattggtatattttggtctatactttcatagaaagcaatctactgtccctagatttgataatgtattggtatcaagttatgtaagagtctcctgtgattttgttaaactgttctgtgtctgtagttatattttctttttcattccttatgttgtatatgttctcttcctctcttttaaaaataatatttccaggagttttcttgattttattggtcttgtcaagaattttcttttggtttgatttatcaatctcttttttctttctgttgcatcagtttctgcttctactttcattgatttattccttccttctaatttcctttggttcattttgttgttagatttttgcttcttgagttgaatgctgaaatcatttattttatttttttgtcttctttaaatgtgtattataaagatttaaatataatacatagattgtggctgtgtaaacattaaatgtggtcatgttgtacatactttatattctttttggttctttctgtttggctccccaccctctttccacatcagtccccttctcccccacctcagctaggtaaccccagtatgataatatatattcacatacacatacacacacacaaaggttttcttggacattatttgttttataaaattgggacattatacacacatttctcactcattaacacgtactagaactctaagtcaattggtatagctttaattcattatttttattggctatataagattctatggtatggctgtatcacaatttagtcaatatgttcactttattccagtttttggctactatatcctatatcattacatactggtgcttttacttctgttgaacaaacttgcaagaggaatattaatggaacgaagggaatgtttccttctaagttttaatttccaaagaggtcagaacttttcaaacatttctaccatcgaagtatgaaaatggccttctctctgcattcacatagcgataagttttatcctgtttttaaaatttgccaattttacaggtgtagagtgatattgcatcattactttcattgtgttatttttatttctaataagttgagcatctttttaaatgcttgttggctattggatttatttgggggatttaattagtcatatgatttgcccattattctttggactctttcatttaaaaaaattatgagaacccttttattattacaaatattaactctttgtcatgtatattgcagttttccccaagatctattgtttgtctgttgactttcttataacttttaccaaaacagtttttaatttttataatcagagatatcttttctttcatatcttcagagtcggcaaggttggttaaaaatgtttcccacacctcaagattgtacgtgtaatctcccagattttcttgcaagatgtttactgtttcgctttttatatgcattgcttcaattatctgctaattacttttgtcatatggcatgagagagggatttgtctagttttatttccatccagatcaatagcctattgtgatggcaccttttgccactgatttgaatcaacacattcatcatataaagttctcatatatattagcatatatttctggattcattaggctgtttcactaatctactattatcttgctatgccagtaccatagtgatttgattacagtgagcctatgatatcttctgatatctggtgggtgaaagcaatcctcactattctttttgtacctttcttagctattcttagacactttattcttccacataaaactgttaagatatttttcaaattaaaaagatccaagccctgttgtgattctaactgcaatttcattaaactcagaccttaattttattaatgtaataaatttaaatatttttcttattacatttatctctgtgtattttataagtgtgatgctattgttaataagatagttttctcctatttccatttatgagtgcttagtaccaaatagagataagctattggtttgtgtattttcagctttttcttttgagcctgggtctcattttgtcacccaggctggagtgcagtggggtgatctcaccttactgcagcctcaacctcctggattcaagcaattctcctgtatatcagccccccaagtagctgggactacaggagcaggccaccatgcccggaaaatttttgtatattttttagagatgggtttttgccatgttacccaggctggttttcaactcctgagctcaagcattccccccacctcagcctcccaaagagctaggattacaggtttgagccaccgcacccagccattgtatattcatcttaaatctagctaccttaccaaatttgcctattaattctagtaattttaccctaaagtctctgtgagtattgaatcatatcataagttaaatgagacagattttagctcatttccaatatttatagccagttatttcattttcttatcttattgaatttattagaaaacaagagcaaatgttaaataataacaatgaaagtgaacattccttctactctatgattttacttgaaataatttttgtattttgctatttagagtaacatttgctgttttggtttttgtaaatggtgtttattctattctcatttgccacaaaatgtttatcataaataagttttcagcagctggtatcatctgaattgtcttctttgatatgctgatgaacaaattatgttcatagatgtcctgacactaaatacccttacattcttggagtaaaatctactattcatggaatttgatcattagtgggttctatgtactatttctttagactattcttagtagattttcactactcaacctactaataataataaacaaagttttgttggctttatcaaatgaattgatgagtactccatctttttctattgcttagaatagcttaagtaacatttgaattatccattgtctaaaagttaggtgagactcacttatgaatccatttggtcctagtggcatttgcaatatctttaatcacccctccaggctcttctatgataatcagtcaattcaagtttcaacttccaataattatatacctttctaggaagtaactttatttattttttcaattttgttgccacagtgttgcatgtagcactcactcatgattcttttactccacattatctgtagttatgtgccctttcttattcctaaattcctctatctttgctatttatctttttttccttgaataagcttgccaatgacttgtctattttgttgctggtggtgctcttttcaaagaatgggcttttggattttttttttttctagttggtataaagcatttttattttcactgagcagaaaaagaagctattgattcattaactgtgctgctttattggcatgtagctatgcactgttcacacattaatatataaaactcgtcagtctgttttattttgtctgatgggaaaacatgaacagtgagatttcttatgcaaaaagtgaacagttcaactatgctagctccatatacctttattaacattccagagacttatcctctcaacatgatctgatttctgtaggataacttttcaggaaaagtattttctgatcagtgaagcttggagatataaataagcaatcggccaggtatggtggttcatgcctgtaatcccagcactttgggaggccgaggcaggcagatcacctgaggtcaggagtttgacaccagcctagccaacatggcaaaactccgtgtctaccaaaaaaaaaaaaaaaattagctgggcatggtggtgctcacctgtaatcccagctactgaggaggctgaggcaggagaattgcttgaacctaggaggcggaggtggcagtgagctaagattgtgctcagcctaggtgacagagtgagactccatttcaaaaaataaaaaaataaaaaaaagcagtatctctcatattcattaactggaccctgactttcttaaagctcaccccaaagctgaagtccatgaaggcactagttctcaaacttcagtgtgcataagaatcactcgggaagcttattaaaatttacattcctaggccccatcctcagcaaactatttagtccccaggtaattctatcccaccccaccccagctttattgtggtataattgacaaataaaagttgtatatatttaaggtgtacaagataatgttttgatgtaagtatacattgtaaaatggtatagcatgaagggttttcttttcatttttttcagaatagtttgtaatatcttctttgatttcatctttgataatctagacgtatgattttaattgctttttaaatttgtttatcaagttagtttgtagtatttgggtcaacattgaatatcctgttaatttcctattgctgtgtaacaaactacatcaaatgtatcagcttatgacagacccatttactgtctcacagtttctgtgagttagaagtccaggtggactcagctggatactctgtgcagggtcatacaaggccaacaccaaggttttaatagggctgcactccttagtgaaagctcttggggagaatctgcttacaggctcatttggaatgttagcaaattcagttccttctctcactttccatgtagtgccctctaccagcaatggtgcatcaacactctctcatgcttggaattgctctgacttcaattttccgtgcatatctctggccttttttgcctctctcttttacttttaaggactcatgtgattacattgggccgacctgggtaattcagaatactctccccatctcaaggtcagctaatcagccccttaattccatctgcaaagtttaatttgccacataatatatttttggacatgacaccaaggagcaaaggtgatgtgggccaaatttttacctgccacaggtatagtttacatacaatgaagctcatcaattttaaatatgcagtttgatgagttttgacaaatgcatacacttgcataaccaccaccctaatcaacatgcatttacatcaaccctcctgcaactttttaatgagtctctcccactgacctggcctcagccaataaactgctatctggaagttacagatttgttttcacatgttctagaattttacatcagtggaatcatacggtatgtattcttctatggctttttttcttcagcatcatgatttggaaattcatgcaggttgttgtataaagtatttctatcctttttattgctgattactgctccattatgggattatatcataattttggattatttccagttaggagcaaatacaaataaacctgctatgaacagtgctccacatgttttgtgtgaacatctattttcatttatcttagttaaatatctaggagtggaattgctggatcatatggtaagtgcatgtttaagagaaactgccagacagatttcttgaacgtaccattctatactcccaccagcaatgcatgagagttccagttgcaatatatcctggacaacatttgatgttgccagtacttaatgactgcacagtggtatctcactatacttttttttttttttgagatggaatctcatcccatcacacaggctggagtgcagtggcgcaatctcagctcaacatctgcctcctaggctcaagcaattctcatgcctcagcctcctgagtagctaggactatggtcacacgccaccgtgcccagctaatttttgtatttttggtagagacggggttttgccatgttggccaggctggtctcaaactcctggcctcaagtgatccacccgcctcggcctcccaaaatgttgggattacggcttgagccactgcacctggttatacttttaatttgcgtgtctctgatgactaaagatgttgagcatctttgcatgtgctaattagccattcctatatcttcttggaagtgtctattcaaatcattggtcctttgtttttaaacgtagtttcaacttttattttagactgaggaggtacatgtgcaggtttgttacatgagtatgttgcatggtgctgaagtttgggttacgaatgaatgatcctgtcactgaagtagtgaacatagtacccaataggtggtttttcactccttgctacccttcctcctccctctttcctctagtcgtctccagtgtctattattctatgtccatgtgttctcatcatttagctcccacttctaagtgagaacatatggtatttggttttcagttcctgtgttaattcacttaggataatggtttgccagtttttaattgggttgtttgtcttgttattgttgagttttgataattttttatatattctgggtacaagactattcagaggtacctgttttgaatgtttttttccaatctatggcttgcattttcattttccaaatggtgtctttcaaatagtggaaatttatagttgtagttaagtccaatttagcttttcttcttctatgattcatgcttttttttcccctgtcctaggaaatctttgcccacctcaagttcacaaagcctttcttctgttttcttctagaacttttatcattttagcattagtatttaggtttataatacattttgagttaaattttctgtatggtgtgacttttctttctctattgaattcccttggtgcctttgtagaaaattaaatgactgtatataggcaaatctgtttatggattctctagttccatagatgtgtatatctgtgcttatgccagtaccagattgttttgattgttgtaactttatagtaagtcttaatatcaggcagtctaaaacctccaacttacttttttattgaaattgcttttgatatatttaggcttttatatttctgtattaattttatagtcaactagccaactccaccaaatagccaactgggattttgactggaattgaattgaatctgtagatcaatttggggagaattgacatttaaacaatactgaatctttcaatacaacaacatggtatggctttgtttctttaaattttctttaatttccctctaggatattttgtagcctacagagtagttcttgcaagaattatattaattgtatccccaagtattttgagggattcgatgctattgttaattgtatcatttttatttgttttcgttttccaatcatttgttactaaaatatagaaattcaattgatttttgtatattgaccttgttcactctaatcttgttaatttgcattttagctctagtagcgttttgcacttcttttagaatttctacatatacaataatgttgtctgcaaataaagacagtttgcttcttcctttccaaactggatgctttttattttttttttcatgccttactgtactggcaagggcctccagtacaatgttagatagaactgatgatagcagaatccttgtcttcttcctgatttcagagggaaaatattcattattttaccattaagtacaattacttgtaaattttttcatagatgccctttgtcaaattgaggaagtttccttctattcttggtgtgagagtttttatcaagatttgatattagattttgtcaaatgctttttctgcatctattcaaatggtcatatggtttatcttgtttattctgttatggtgaattaccttgattgattttttaatgaggaactagctatgtattcccagggaaaaaatccacctggttgtgacatattacattggtaatattttcgctatggactgaattgtctccacctccccccaccccaaattcatatgttgaagtcctaactctcaagatgattatatttggagatagggcttttaggaggtaaacaaggttaaatgaggccataaggatggagtcctaatctgataggactggtggcctcataagaagagagaaggttctctctctacactcatgcactgaggaaaagccatgtgaacatacagcgagaaggcagccatctaccagctgggaagagggctccactagaaactgaccgtgctggcaccctgatattggatttccagcctccggaactgtgagaaaataagtttctgttgtttaagtcacccaatctctagtattttgttatggcagccctggccaactaaaactgttttgttaagggttttggtggtgatggtggttttttagtttttgcgtctgtgttcatgatggatatttggctgtgattttcttataatgtcattgtctggttttgatataagagtggtattagtccgttctaatgctgctatgaggacatacccgagactgggtaatttataaaggaaagagatttaatggactcacagttccacatggctggggaggcctcacaatcatggtggaaggcaaaggaggagcaaagacacatcttatatggcatggtggcagacaagagagcattgtacaggagaactgccctttataaaaccatcagccctcatgagacttattcactataatgtgaacagcatgggaaaaccccactgccatgattcaattacctcccacctggtccctctcacagcacatggggattgtgggagctacaattcaagatgagatttaggtggggacacagccaaaccatatcaaagagtaagactattctttttttttttttttttttttttgagacggagtctcgctctgtcacccaggctggagtgcagtggtgcgatctcggctcactgcaagctccgcctcccgggttcacgccattctcctgcctcagcctcccgagtagctgggacgacaggcgcccgccaccacgcctggctaattttttatactgatagtagagacggggtttcaccgtgttagccaggatagtctcgatctcctgacctcatgatccgcccacctcggcctcccaaagtgctgggattacaagcgtgagccaccgcgcccggctgactattcttataaaatgagttgagacgtgttcactcttctatttaatgaaagagtttgtgtagaattggtatcatttcttttttaaatgtttattcaccagggaaatcatcttatcccagtgttttttgttttggtttggttttttttttaagggtcttaattgtgaattctatttttaataggtaaagggctatttgaattttctatttcttataggataaattttaataatttcttttaagaaattccatttgagactgggcatggtggctcacacctgtaaccccaacactttgggaggaggcagcaggattgctctaggccaggagtttgagatcagcctgggcaacataacaagacttgacttctacagaattttttttcattagccaagtgtggtaacatatgcctgtagtcccagctacttggaaggctgaggcaggaggatcacttgagcccaagagttcaaggctgcaattaactatggatcatgctactgcactccagcctgagcaacaaagcaaggctctgtctcaaaaaaagaaaagaaattccatctgagctgttgaatttaatagtataaagttcagaatatttccttaccattttttcactccttggaggtatgatttacatactgtaaaaatcacttattttcagtgtggagattcttttcctttcctaaatctccacatttttattgacatatactttacatatcataaaattcaccatttgaaagtgtacaattcagtggtttttagtgaatccgtaaagtgtacaactatcatctttatttaattccagaatattttcatcacctcaaaaagaaaccctgtaatcattaaacagtcacttctaattttcttcctttccccagcccctggcaaccattaacctactttccgtcactgtggttttgcctattctggatatttcatgtaaatgaagggataaaatatgtggccttttgtgtctagcatcttttgcttagcatgttttcaagattcttccatttttgcagaatgatagaggagttaaaataagaaaataaagatatagtaagaatgaaactattttcattttttaatttaaaaaaatcttccatgttgtagtatgtatcagaatttaactcctttttatggctgaataatactccattgtatggatagaccacattttgtttatccattcatctgttgatggacttttggattgtttccccttttggctattatgaataatgctgctatagaacattcatgtacaagtctttgtgtacatatgcttttatttctcttcggaatatacttaggaatataattgctaggtcacatggtaattctatgtttaacttttagaggaactgccagactttttcaaagcagctgcaccattttacattttcactaccaaagtatgagtgttccaatttttccatattcttatcaacacttgttactgtctgtctttttaattatactcatcctagtgtggataaagtgatatctcattgtagtttggatttgcatttccctgatgacttacgttgttgagagtcttttcatgtgtttattgaccatttgtgtatctcctttggagaaatgtctatttaaatgctttgcgtgtttttaattggattatttgttttttagtactgagttgtataagttctttatttattcttaatattatacccttatcagagctatgacatgaaaatattttttcccattctgtgggtagtattttcactttcctaatagtatcctgtgatgcacaaagtttttcattttgatgaaatccaatatttatttattttacccctttggttgcttgtatttttgttgtcatatctaagaaatcaatgtcaaatcaaagatcactaagatttaaacctatattttcttttgagacttttatagttttagttcttacattgaggtcattgatccacttggagttaattttggtatatggtgtgaggaggggatccaagttcgttctacagcctatatagcctgcagatgagcaatgttagtgaccttgaaagtagaggcccaggttgtcagtagcctggcatctaactaaacaaccatttatccattaaagttagccctgttaacaattaatattgagataattttacttaatacactgtgtatattagtgtccatctagcatgcagcctgaggcacagagaataatagtttgagtataaaattgaattgaatggaatacatcattaatttattatctagctttctgttattgtataggcagtcacatgtatttaccagaaaaaagttgatagaatttttattttaatgaaacccttttatactttagattattttgatgctgattaacaggataagctgactctggacacatcctgacagcctctgccaaggtttgaaataaacagctgggaaaattcagttttatattatctgttcccgcagctgctcagtttcttctaaccacaggtcagggaatataataggttttccgattagttttagataaaatgtgaaagaacagttcatgtcaaggacaatggttgccaaatatatttggcaggatttctatattgaatcccaaaggaaatacacaaacaaaaccccacaaaagttaggaaggagtaaaacccaggaaccctggaacattttgtcatttactatgcagatttgcctgaaagtgagacaggcaaataaatcacatgtttctgccagcgtggaaaatattcactcaaatggcaaaggtctcaggctggggagctggatattgtcctgtaataggttcatctcagaactgaatcacacacttggagggtgttaatgctcttaggaacatctagttattccctttgaatagagtcctgtcctgaatcacatatacttgacctagggcctaggcctttttgtttttctgtctcacaatcttgtttctccatcaattatgtgttttcactcttccctcagagagggaaaaagtgtttctgtgtgctcttgatcctgttccctctctgatcttccaatctattgctctataacatattttatatgtgtcttatatcttcattttagtcagaaacatttatttatttatttatttatttattttttgagacagagtctaactctatcccccaggctggagtgcagtggcatgatctcggctcactgcaacctctgcctcccgtgttcaagcgattctcctgcctcagcctcctgagtagctggcattacaggcatgccccaccacgcccagctaatttttgtatttttagtagacagggtttcttcatgttggcccggctggtgtcgaactcctgacctcaggtgatcctcccgcctcggcctcccaaagtgctgggattacagatgtgagccattgggtctggcctttaatcagaaacatttaaagtgaaagcactgtggtaacttatgttgaaataccttagaaatcaatggaaactgcacagagagggggtaggatagacgtagtggaaccaaggatatgatatggaaaaaggagaaaggtagcaaactagggatgagttggtgaatgtggaagggcataataatgttaaatgactgaaaactacataggcttatgttaagactagtgccatggaaatttttagaggtagatgacattagagtatgtttaaatataaattaatgttcttgcagtgagccgagattgcgccactgcagtccgcagtccggcctgggcgacagagcgagactccgtctcaaaaaaaaaaaaaaaaaaattaatgttactggttgtgttccctagatgtagactctgagatgaagattaacatgcaggaattttatttggagtgttcttgggatcaacacctgaggaatcagggataggcagagggagaagcgcgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccaatggctgggactggggagttctttcctagactgccatccgggcgcccctcaccctcttgctgctcagctccaggtcgtcgtgggttcagggctcagctgcacgctcctgcccgcgccctgggcgtgatggcacccccagcccctgccattcttccccctcaccccctctccctgccactgctctgcattgccctgggttagcctggcggggccaggtggcacccgccgtatactcttgcctttctgctgcaggggcctttctgctgcgggtcccagagctgcagggaggggcggcagagactccccacgtggctcattggcgggggtgctaatcagagttcttttgctgccactctttgattcccaaaccccatgtaatcttcttagtggggacacagaatcatctttgaattcatacatatacagcaccttggaggctggccctccatcctcacagagacctgcctccaagctggagttctacctgtgcctggttgtggacccactccctcatctcttttgctgtacaatgattccccaggtctacacggtgctatatggaattccacatcagtgaatcaaatcctctgtaagatttcagatagtggtgctggctaaggccctgaagggaggaaaggctaagttacgccaagattaggtatcacaatgaagtcctgtcctttctaggatggaaggagttcagtgtgtctggccaccgagaagctggtttgtctctgtgatggacaataccatattgcagcaatccccaacctttttggcaccagggactggtttcgtggaagataatttttccagagactttggggttgttgggaatggttacggcatgaaactgtccgcctcagatcatgcggcattagttaggttctcataaggagcacaaaacctagatcccttgcatatgcagttcacagtagcattcgcactcctatgagaatctaatgcagcagctgatctcacaggaggcagagcccaggcggtaatgcaagtgatggggagccgctgtaaatacagatgaagctttgctccctgcctgctgctcacttcctgctatgtgaccccattcctaacaggccacagaccagtactggtcaggggcccaggggttgggcccaatatggcatattgggagctcagcattgatttttgttgctggcaggttggactttggtggcaacagtagctagatcagccttagtcagtgggaagccacgcttttgggtccatgcattaattctctccctgctgctgtagccacttagctcatgtcttgccagtactgcgatggcctatgcagaggctagctgatgtgaattgccagagtcatttttatatgtgttgttggtttgtgcttccttcaagatggatgctttctgttggcattaacgtattacttggagatttttctagtttgtgtccactcactaatatgcctttgtcccaacttttttctggaagagcttccttatcagtacgctgggccctggccctcagccagtacagaaagtcatttgtcaaggccttcagttggcagacgtgctccctggactacgtgctttctcgggtgtcccagaaaccctggaatggagtgaaatgcagggctacgtgggagagcagggaggcaagaattaagtcggccccacctttgcccaactcagtgggtctccttgagagaggtctgcagtttcaaggagacttttcagccaatctgctgcgagatcctgtgaaggggtgtgaaggtcttcctctgtgactatagattggccagtctctccttgtgtgtccaacagttttcattatactttatgtgaattaatgcaaaactgctaggtttaaactgctcaccattttagggatcccttctggattttaccttccttaaggggaaattttcctcctttcctcagttcatcctttctgccttggctttgacgtggtctggaggccacagagcctcctcctgagaacctctctctggtgtgtctgtttgtgtccgtccctctcctttcgatcattccctgtggttcctgttgggcgcggctcccataaacgcacagagcagggtctgctttgtctgcaacctgatgcattgttatttctcaccaaaacttgcagtccaaacatcacatttccgggccacactctttgtcagagctccaggggcacaaccccggggacctgctggaaggtgccaccgtgacgtgtgcctagatgcgttttccctcagttaccacagcgttcctctggttctggtggctggagggtgaccgcgtgcttcatgaagggggtccttactgcttcgcatccacccttttcacggaaagcactttgtcacatgttttcagtgtttctaagcgattttctgccaatcttgtgtgctaagattgtgtggcagcgtttccacagatttatagctggcaatgaattctcccaaaggaaatcagacaaaataaaatgtttccaacattgttcacatactgacaacttatgtgcttccttgggtgattttacaactttttaagcacatgaataaaaattattgtctgcttttttctccttttttctctcttttttttcttgcatgcagaaagtttataggagggggatcctctggatcaacacccatgggggagtgaaggaagcaggattgggtaaaagaagttgaggtgatacagtctgaataaaggtcagtcccacagggagctcaagctaggatggctctgcagagatgttctctattgaggcaagttgtctggacctatatagtcccacctttaccaggaataaggcatgagtttggatgtggtgactgacttcagccaaaattggttctcagagaggaattcagattagagttgtcagctgtcagcacacccagcagcttaggaaataagtgctttagtcctgaagcggtgaatctggacaccagcctccactgtggtccaccctttctgctgctcagattcatttgcttcataagttctggaatggttccttcaggattctgatgggctccctttcctggggaaacaaaagagaaaggtttggaacacagcacaactcctgctgctttagcttttcttgagtctgcaactggtactcatcatcttccccttctactacccattctagatccctccccccaccaccctctcaattcatacttctgctgctccaagtgggttaccagataaggtatctggtcatcatgccctttgtaagccatgactgtacttgtccatttatcatcaacattgaacaagggaatactaagagatacccaggcagatgacctggctgccaaatatattctcctctgtctccattgtgtaatgtcagcccttcctcctgatgatcaggatcggttacgcttgccaggatagtgactcttttccttacctcttggtctcttaatagtgatctgaagtaatatgatggcaaccatagtttcaagtttaatgagactcttggtgtgtccactggcggacatattccccttttaagaaccagtacttctaaactctcagagcccagagttgggataagaggcatagtttccctaattgggtcactgggagtaatggtagtgtgaggctgctcctacttacactccttgttttccaaaaccatatattttacttcgggacacaccccactaaacgatggccattgatctagagtatatactgcatcctgcaggatggtgcctcgtccttaggtattatgtctaagctagtgcctcagctgtgccttcaacaagctgtcctaccactctatcaagtgggtagcttctgggtagtggattccatggtcatgtatcttcttgctttaaagtaggtctcttggtctgatgcagtgttatgtaagatcaaatattctgtgaggccttgaatggtggtgtttactgaggctcaccaagcaactgaatgattttcttgagaaatggtgacatatcagagccttagctttggtctctgttactggcaagttgaacattaacaacatcagtagctagatctgtattgatgagtccatgatgttgggcccatgcatagcctctgccatggctcctcctttcatacatccattttgtaagaattggggcaccaacagcagagactggtaagcatcaaagtggctaagtcattcagtctacttggttgtttagtgctgtttctgtggctgatgttcttttcatttattcattctgtaatgcgtatcctttgtagattcaatttccttctctctgaacaacttctttggatatttattgaaaggcaggtctactgtcaataaattccttaatttttattgtctgagaaagtttttatttctccttcatttttgaaggatactttcacagagttcagaattttaggttgactgttttttctttctctcaacactttaaatatgtcagtgcactctcttcttgtttgcatggtttctgaggcgaagttggatgtaatttttatctttgctcctctatggataaagtgtttttccccatctggtttcttacaacattttttgtctttgattttctggagtttgaatataatatgcctaggtgtagggtttttttatttgtttgctcgtttgcatctatctttttttttttttttttttttttgagacagaatctcgccctgtcacccaggctggagtgcagtggcgcgaactcggctcactgcaagctccacctcttgggttcacgccattctcctgcctcagcctcctgaatagctgggactacaggcacccgccaccacagctggctaattttttttgtattttttagtaaagatggggtttcaccatgttagccaggatggtctcgatctcctgacctcgtgatctgcccgcctcggcctcccaaagtgctgggattacaggcgtgagccaccgcgcccagctgcatccatcttctttggtattctctgagcttcctgaatctgtggtatggtgtctggtgtctgacattaatttgggggaaattctcagtcattattgctttaaaaatttgctcctattcatttctgcattcttcttctggcatttccattatgtgtatgttacaacttttgtagttgttgttccacagtttttggacattctgggcccatgcatagcctctgccgttgttgttggtgtttttttttttttcagtctttttttctctttgcttttcagttttgattggaagtttctattgtcatgtcctcaagctcagagattctttcctcagccatgtctcatcaaccaatgagcccatcaaagacattcttcatctctgttacagtgttttgatctctagcatttcttttttattctgtcttagaatttccatatttttccttatgatatacatctgtcattgcatgttgtctactttttacattaaagccattagcatattaatcatagtttaaaaaattcctggtctgataattatgacattcctgccatatttgactctgattctgatgcttgcttgttcagtctcttcaaattttgtgggttttgccctttagtgtgccttgtaatttcttgttaaaaggtggacatgatgtactggctatgaggaactacagtaaataggcccatagtgatgtggtgagatggaaagaaagaaaagatgctcaacatcactaatcattagagaaatataaatcaaaactacaaagagatactgcctcacacccattaggatggctactatcaaaactaaaacagaaaataatgaatgttggtgaggatgtggagaaattggaacccttgtgcactattgcaaatgtacaatagggcagtttctctaaaaattaaacagaattaccatatgatccagcaactcgacttctggctatatatgcaaaagaactgaaatggggtcttaaagagatatttatacatcaattgtattagggttctccaatgaaacagatccgtgtgtgtgtgtgtgtgtgtgtgtgtgtgtgtgtaaatatatgccaatggtaaaagtacagggtctgagtcagaaggcagaaccaagaatgcttatgtccaagggcaggagaagacagatgtcccagttcaaacagggagagtgaatttgcccttcctctgtctttttgttctattcaggccctcagtggaatggataatgcccacccacattggtgagagtgatcttctttaccaattcacatgctattctcttctggaaacatcatcacagacatacctagaaatactgttttgccatgtatctgggcatctcttagcccagtcaagttgacatataaaattaaccatcatatccatgtttataagcagcattattcacaatagctaaaatgtggaagtactgcaagtgtctattgacagatgaatggataatctaaatgtggtatatacacacaaagcattacgaaagaaggaaattctgacacatgctacgacatagatgaaccttgagtatattacgctaagtgaaataagccagtcatgaaaagacaaatgctgtatgattccacttatattgggtacttagagtagtcaaaatgatacagaaagtagaatggtggatgccagagactggaggaggtgagagttattgtttaatgtttatacagtttcagtttacaacataaaattaattctggaggtagatgggagcatattacacgttttctttttggagatgggatctcactctgttgcccaggctggagtgcagttttgtgatcatagctcactgcagccttaactgtctgggctcaagtgatcctcccaccccaggcaccaaagcagctaagaccacaggtgcacaccaccacgcctggctaattattattatttgtagaggccaggtactgctgtgttgcccaggctggtgttgaacccctgggctcaagtgatcatcctgccctggcctcccaaagtactgggattacaggtgtgtgccaccacacctggccagaatatttaatgctactgaactgtatatttaaacatgcttgggctgggcatggtgcctcatgcctataatcccagcactttgggaagccaaggagggtggattgcttgagcccaggagtgtgacaccagcctgggcaacatggtgaaaccctgtctctacaaaaacattaaccgggcatggtggcacacgcctgtagtcccacctactctggcggctgaggcgggaggatcactcgaacccgggaggtggatctcgccactgcactccagcctgagcaacagagtgagaccctgtcaaaaaaaaaaaaaaaaaaaaaagatttacgatagtaaattttatgtgtattttaccacaattattaaaattgaagaaaatccccatgggtcactggtttaccaatttagccattttcaccatttttagattgcattttccttctctatctcagcattctgactaaaggaaaagcaaaatttcttacaagaatgaatgattctccagtgtggctgctcctgaaaggaacaatgagacttttgttatttcaccacaagactgagaaagaaataaacaagtgataaatgcccagaccccttcttattcattccacatcctggtaatctgaggcatggtgtggcttttactccaagcatatgaatacttacaatcagaagctgcctctcctttccctcactttatcattattgccatcatttatgacaatggagggagtgtctcactggatgatatttggggttctttcttcagtggtccgccataccaagcatttatttgtgctgttctccatctttcacatctaccacttttcaaaagtccctgagagtcaataagacatgcgactcgaacaactgcttcacatctaagtgtatgtctttaaaaatctctccttttccatgtttatgtctgatgtgttttgttatggcaaagtggcatgtagtatacggttcataagtgaatcgatgtatatctgtggagggcaaatgctcaattttagatctacacatgaaagcttttttccagggcaggagccttgctttctccaactaagccttaattacccaaatgcccatgtgttgtgcctttggcttgttgaaatgataccaactggtaaaatctgatgggagataaaagttagatgtccagaagcataaaagtcaggaagagaggctctttatggcatagagaaagctgcagaactgctccatggtgtgcaaaactcatcagcacatgaaactagtgagtggagatagtcaccttcaaccactttgtaatttctaccaattcacttggggccagtgtcccttattcaccaagattcacattggtccttttgattatttggcgtgaggaggcccccagacatgctaaactgtcatgcagggagagaggaaaagttgggaaccagcctttgcttaaaagggctttgacaatggaggcaaataataacattttgggaacatttatataagtaattatataatttctgattcagtagctggttcatgaataaatgagtaattgggagtatctgagtggagacaagaatgaacattaatgtaggactgattctgaattacagcttctggcactagtaggtttcaatatacatagtctgctgaaaggtaattttctctgtgatattcctggtatccctaaggagggaagtataattttaggtacatactgacaaaatttgaacacaaggtacttagatgaaagttatagtctgttttagagatgaaattgaaggatgcagtagctattgctttggcaaaggatttttggctgatgcagtgtatggttattgattttatgattcttatcatatggcacctaatgtatcagttgagttgtgaaaacagtgtttcggtttaatggatgttagggatttatatacaacttcaaatttgcctccttgctaatagtagaaaagagtagtatggaagcattacttccagctgctttttgaagtgtccaccaaaatgaacgactttttcctttcttcacgcagatttcctcctagagtgccaaaatcttttccattcaacacctcagtcgtgtacaaaaagactctgtttgtagaattcacggatcaccttttcaacatcgctaagccaaggccaccctggatgggtaatgaaaacaatgttgaatgctatttatgaaattgggtatcttattttctatcacagattccccaatcttgaggttgcagttaaaaagtgcagctgccaaagagaatgtttccctaactgctacctatagggaaatacactgactgcattttctgtctttttgctgggccgtcttcctctgcttggtctatgccaactgcttacctccacttagatgtcaaataaagtatgtaacaacatgttatgacaggacattttctgtcttagaattgttgctgagaattataggtgggaagtatccccttattctaaagagagatatcagcctatcgatttagaacttgttcaggtagtagtccaaaattggttctgcaacccttaggccctgactcacctccaaccttgtataaaaaaaggctaggaacttatggaagactttagatttgaatatttattatttggagagcctcttcggtgttttatgtgttgcttaccccatggggagtgggaggcctgtccctcatgtcaaggtataatgaaggaggcttcaggagaaccacttagaagactggacaaggtacctatggaacttgggagacactgaccactgcctggtttttatctggataaattttcaaggtcagaggccaaaaggacttctcctgatggaatagcagggggagtgggcaatagtgggagctaactgcactaccattgttaggtgtaaggccaggaaggtcactgaatgggacttgtcttacaaagactctgcctgagaggtcttcctgccaggattagataaccccaatagaaaaagcctgtatgggttgtactgccagaagcagaatctgagaggagagatacaagtgaccagctggagaaggtatatcccatgccaagatcaggagcagtggggtgtctccttgttggcagggagaggtctccaaataactcataagttccctaagaaagaaaggcagaattttggtatgtgtcacaactagggagtactaatgccacattatcactgctccttccaagaaagactttgtcattgtgcctatttgtttttaccctcccccctcctttccacttgctcctaccttggcaggtccagagacacaaaggtgagttggggaggaagattaggagaggaaggtgggaaagcagcgaagctgccaaaacaaattacctttacatattgcagatttctggggctgtcagaatgtagctggagaaggaagggaacttgcaattgcagaagacatcaaaaatttggtattagactggactggacttgttagaacctaagagtgatactgttggttaatacctgaaggttactggaaaagatttgggatcaaccaaagtgcaagaaaagggagatctcacataaagtaattaaaagcagtggtctaagaaaaataaggctattttatgtttttatcccactcaatccagttcattcaacagactgtttataggcattttatacttagtgtattcataaaacagagctcttaattttcctcctgattttctgtcatggcctgactaacaacccagttgcacaagccaaaatcataggagttttctttgactcctctctttttttctatctccacatcatatttatgagcaagtcctgttgactgttcctccaaaacaagttccaagtcttcttattttacttcttgtaaaatccaaattcatccaaattcctgtggcctgcaaggtcctacatgttatgtttcctttttgaccatattttctgttactcctctgctgattcactgtgcttcagccacactttacttgactataccaaacttatttctgcctctggacgtttgcatttgttttatctgttttcaatgctcttccactagatctttgaaaatcttgcttctttttcattagtcagatctctactcaaatgtcacctcctcagagaggcccttcctgactactacactgaaagtatcctctacctcctgcctcatcactttctagcagaccactatcttttatatttataacaacttgaaattttcttatttatttctttatgtgcttaatgtcttgagaatatgatctccattatctgtcttgtttgctactgcacctccagtgcataagacagttcctagaatatagtaggaactctagttgaatgaatgaatgaattgaatgattgccagaaatcttgcctcagagcaaccataaggttaggctgatgttggcagcaagcaaatactactttttgtcagtaattacaggggcatgcttctccactgtgaccttgactctaacttttggaataacaggttttctggagtactatccccaagtaacctttggcggacatctcattcttacaggtctgctaggtcctaccatccaggctgaggtttatgatacagtggtcattacacttaagaacatggcttcccatcctgtcagtcttcatgctgttggtgtatcctactggaaagcttctgagggtgagtaaaataccctcctattgtcctgtcattctatgaatagaacagtgagatgtgtgtgctttgtaatggtggcgttacaactcttttaaggtcctaactgaacattatgtgtatttcttaacatttactagattataaatatctcaagatagggaaatccatcttatttattgctgtgtccttagcatataacatattgcctaccctatagtagatactcaatacaagaatgagggtgtagtggacaccagtcattttttcttcctaaaattaaacatttctcacctgtataccccctaggaattgcttttctgaatatacttcaaacagaacctgccattttcttaaagcccatgcctccctagccatagcagttgatctaggagtgagcagttgacacgggtatcccacctccttggccacagttgattggtccagagatgggcaccttacccaagctaggccaatgagagtacttgcactagcattttgaaatttatgagaaaaaggacctattattaccaggtaatcctatacttaggggatggagcccaaatataataaaatcaagattctactacttcatgtatatcatgtgggccatggatcttataggagtcttaagggggtgttggtcttgtccttttcttagttgcctagctctttgcaggcatggtgcaaaggcaggacaatctacctttatctgctccttctataccactgatcctaccctaaacatgtagctgtataatcagagacaggaagccatggcaaatctggagggtctcggcttggctatatcttaaagagttacatgtattcgtagttcaacattggggaaattttccaaaaattggtggagaaacgagtggccaatgcaattttatctttttttttctgctgacatcagggagagataagagctttaaaatcacaattatggggagataatattttaaaatccagctcaagttaaacccatcagaaaaggtaacaccttttgggacccccaaatggccacatcttatccaatgaggggacaccaaccatagagtctatactgcacagttcaaatggtagccatgagctatcaggcacttgaaatgtggtgagtcctacttgagacatactgtaaaatatacaccagatttcaaaggttaagtacaaaaaagactaaaaatatctcattcattgtttataagtacaagttgaaatgcttatatttggatatactaggttaaacgaaatacattattaaaataatttcacctgtttctttttacttttcttaatgtgactaccagaaaatttaaaattacatatgtggtttgcattatatttctattgaacagtgaaatgtttagcatatgttgaagttgctgctcctgatgcagtggctcatctcagatttggccaagttcttctgtccaaggaaaactaggttcaacccattcctggagaggaacagactcaaatctttctgggctgggtcacttaccttggttaaatctgttctccacctattctaccaacaaccaaagggatggacatagctgaaataaaaatcacgcaatcacactgaatggtatctcacctcaggtgggccttcagcattgcctagccattctactgctacatttcccctaatccatttactctccctctccccaagacagctataatgtttcacacattgttagcctctcattgaacctccaacatgtgctcccgcccctgcccccaccacaacgtgagccttgggaaaaagggtatttttttcctaatgaaatatttcaaacaaagataaatacagaaaataatataacaaacaaacatgtgcccatcacctcactttgccaaatcttaacattttgtcatctttgcttaatttattttacaaaattaagcattttacatacagtctgtactcctctatggggctggcaggaaaaggctctcattgtcaaagttcaaagtaattgatcattgaaaaaataatgatcacattaaaaacaacacttatataatagagatacatattgtaatactcataaatgaaatgatatcctgtctaggattggcttcaaacacatccaagctgatgttacaatcattaggtgaattcctgatgtggaatttgacatttgtatggcgccaaaataatatcccagtgatttttttctgattgtaagtggaaatgttaactttagaatggaggtatcaggctaatccacaggtcagttttagtgtcactaaggatgggatggccagatattatctgcccctgatatggcacaatatgagggactcagcatcatctttgatatattttagccaaaaaacttatttaatttgaatctaatcagaacttaggcatattcaatagcatgggatattctacaggactacaagccaaatttctttcaccaaatgagtgtcagaaaaaaagggactactccatactaaaagagactatgggcctaaacaaccagatgcaatctgcagtcttaggttggattctgatttggaccaactagctacaaaggatgcctttgaggcaattaagaaaatttgaatattgcattgatattaggtgatattaactggatcaggtgtgctagtgtcattttgtttatgtgggcaatttttttttaaagatgacttctaaagtatataggagtggactatcatgaaatttgtaatgtacattaaaatgcatcatcataaaaagtgtgttgaaagaaaaaagtgaaagtagcagtgcaattctaagaataattttctaacatccactcacaaaaatattaaattctttatattaaacacatgaaaaagaacacaaatatatctgtctttcaagattcatctcaaattccacctccttcatcaagcattactgaagagtaggaagcttgtttactttttttatccactgtgttgctcgctccaagggcatagagacttctatcttgatctttatattttcagcttgtagctgagtctggtaaagaataagaactcaataaatatttgtgaataaataggtgaatatttccacatggtattataattatatctttatatgtctatgtcccccaccaaacatagtgttgtaccactaggaaagaacaaagtttaagaaattttcttaaatctctctttcttactgttccgtgaccctcactagtgcctaccaaagagtctgtgacaaagtgtatttgttgttgaattgaattaggcaaaaagatgcaataatggaagcaatttattatttaacagaatgtggagatatcaaccagaacctagtttttactgctcatgctagggttagtgatctcaagatcctctggagtatatgaagcttctccccatttgtggctgctgcttgttagtttttcaaattaagatgcagaaagtaggccgggtgtggtggttcgcgcctgtaatcccagcactttgggaggctgaggcgggtggatcacaaggtcaggagtttaagaccatcctgaccaacatgatgaaaccccatctctactaaaaatacaaaattagccgggcatggtggcacgtgcctgtaatcccagctgctggggagtctgaggcaggaaaatcacttgaacctgggaggcggacgttgctgtgagccgagatccagcctgggcaacagagtgagactccgtctcaaaacaacaacaacaacaacaacaaagatgcagaaagtccgtttcttatgtagaacctattggtgacaataaacttgacatgtttctttgagtgtacagtggatatagaaaggacaattttatttcttcctgctataggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaaggtaagtgtatgaaagcgtaggattgagatgaaataagcagagaagtacaaacaactgaatctatctataacagttagcatttgtgttccttcacctgaaagaggcttttttactctagcatcatgctcatggaaaggagaataatccagtttctgagagaagcagatatgcattctatataaccacaataaactctaagctgggatcaggaggagctgagttccagaattaaatctctctcctcaaagcattgctattttcctcttcaaatctgtgggctttatcagtagtgatttctactgtcctctgccttttgcaaactttgagctaggttccttgaaaacttcatggaggtaaacacatccaagtgtgtgatcaatggcatatagactggttcaggtggttagtttgtcatctgtaaaccaaaagtatataaaaatctaagaaaagtcagcatttatttatatgttactgaaaattaattaatttggattgaattaatatattctaaaataattctaatcaaacctgtttttaatttataccttagcataaattagggaagtaaattttgcataatttgtttttatcctattttttatggtgaaatcagcttcactgtaccttttccttgttccatttatcttttactgcataactccacaatttagtggcttaaaacaacaacagtctcttattatctctcatggtttctgtgagtctcatggaatttgtcagtgttttgacttggtggcctatctaagtgtgtctcatgaggctgtagtcaaacagtggctagagctgaaatcatcccaaaggtgactttattcacatgtctttgaccttggcttgatggtactctccacatgatctctctcacatgggttttacagggtagccagacttcttatatggtcctgagatagcccattagaagctgtttcacgatttctaatgtaaccttggaaatcactcacataacctacattctattagttagaatgcatcactaagaccagtctataaagggagactccaccttttgatggggaataggcaaagaatttattaacaggaatcaccatactctttctgaatggtgatgatgaatgtgattcaaaaaaaggatgggagcggggagtggagaagatgagaaaggtttgtagtttataatagtttcagatgaaagtatgatttctcatatactgagttcagtttcatagtcataattaatgagaaagtgccaaaaccacagtgtattatttatgggatgtaaaggctaatggaacaatgagatcatcaaaacattagtgtttacatatgacatataaagaaataagttaaaaacccaaatgattctttgacacagagttgaactaaagagtctacagaggttctagttccaggtgaaatggataaacacactccaccctttatttcccattgaacttaactataaaaccttgacaaaatgcaaagcccagatatttaaaaatttctaaaaagcaaatagaacaagtatatagagaaaagacactagaattgaaagtattaccaaacttgtgggggagtatacctttttccccactctagtattccttaacctgaattaaaacataactggagacttcgaagtgagtactatgttgcaaagagagctccaggacaaaccctctggggtttcaaggagtgagaaaggtaactctaaatgctcagagagcgtgggaggggaaatcccctagggtttttgtcctcttttccaccattctctcaagcttcagtcccaggttgcctgtggcaatgacagtggctggcaacagaaacctgccggagtaaaaacttagggaggggaacattattcttcattcagtacagctacagatctaagacattgggggaaaagcacattactttctctctgtctttccccttccattgcttgaccttagctatgatgtagttgtggaaattggaagcttctggttagaaaaccaaaaaagggagctcacagaactggaaagtttatagatgacagagagaaaagatcccaggaaagtaaacccataaagttgtgcattaactcctggattcacccccaacctacacatccaggtatgtagtttcagtgtcagatctgttttaaaccccttgcagtgccattgagtccaacgcagtggccagtctggtgcttgaggggaaatctcagtttcacagtcttcaacatgttccattagcctttacgtcccataaataacacactgtggttttggcactttctcattaattatgactatgaaactgaactcagtatatgagaaatcatactttcatctgaaactaacgcccacagaattccttaaaacatgtctgatggctgaaagcaaagatagaacattgtgagataggttttttaatgtatggtagatacaatacataaaagaatcatagcataacaagaggagggtaaggaaaactttatggtccattcaacttcattccaattcaaatggtaaaatgttgactctaagtagatgatagtgaaaggttaagtatgtattttgtaatccctagagcaaccaataaaaaattataccaagagacacagtaaaaagtcacaataaactaattacaatggtatatcaaaaatattcaaataactcaaaagaaggcaagtaaggagagatgaaaatcagagagaagaagcagtaaaatcataataaaatgataggcttaaatctaaacatatcaatacttacattaagtgcaaatggctaaaacacaccaattaaaaacagagattagcatactggatataaaagcttgaaccaattatatgttgtttacaagaaactcatttcaaaaaaatgatataggtaggttaccagcataaagatggaaaaggatatatgatgcaaacatgaatatgaagaaagttgaagtagtacaaatctgtaatcacaacattgatttttgccaggagtgccaaaaccattcaataggggaaagaatagtgtcttcaataaacagtgctgaaacaggtgaatatctgcatgcaaaatactgattgagtatcccttacctgaaatgcttggaaccaagaacgtttcagatttcagatactggaatatttgcacatatataatgagatagcttggggatggaacttaagtctgaatatgaaattcattttggatataaatcccttgccagttatgtgattggcaaatattttctcccactctatagtttgttttttcattcttttaatggtgtcttttataaagcaagagttatatggacaaacatatgaaaagatgttcaacatcattaaccattagggaaatgcaaattcaatcaacagtgatgtatctattagaatagctaaaataataatataaaattgccaagaatcctgtcaagaattcagagcaacagaaagtttcacaatgcacaatggtatagccattctggaaaacagaatggcagttttgctgcttggtagagaaacagtctctggcagtttcttgtgaaattagatgtacactatagagggatagcaggagggagttctttttggatattgaaatggatctgtatcttgacgatgatggggtttcatgagcttatatctttgttaaaagttatagacctatacaccaaaagaaaaagtcaatttcactataattgaaaatttatataaaagtaattagaatgttttaagacagctttatacgtattttaaatgtgtctctaaagtttttaatccagtacttctggtaaagatggcacagggtcttcctacttagccatttttccatcctccacctcaaccccaacctcgctgaaaaccaacaacaaagataggtaaaccataaatagagaaaatcgaataggcatggtcagctgaaaaagaagataaatatttgtggaccagaagcagaacaggaactgtgagtagtaaaaggggtggaaattacaggccaactgagatctgggtcaggaagccagctgcggtagccaaggagtcaggatgacaaggataaatagtgctccccaccagagggactgagagcccatatcatagagttgggctcttcttcacttgaaagagagctgagcacagctgctgctcactctttgtttagggccatggctttgtggaaactcagagtcctagaagaggggaaagcaaacccagtcctagaataggaactgaactaagttttcttggttcagtgggggaatctgcaatatccccaaggtttccattggccagtatctccaaaattccattctagggtatgatttgctagatagagaatagtgaacacatcctttgcttaatcaaccaatgatcacaagggacagcaaagatcactatagttcaacaaagtcagatttattggctcatggcaacaagagactgtggacacctccctaaacaaagggaaatactgtatagagttagtaaagaattttggggaagggtggaggttaggtgatatttaaatgaagcaaagtagagttgtgtgtaaagaaataaccatgaggtctagactgtgaagtgttctaaaaagttaacatagacatgaaaggttaagtcaaggcaccccttacctgaagcttgagctttaaattgagctgcttctttgtgtcaaagtaatttagatgacctaggaaagaatgagatgtttcattcttgttgctattagttcaaacatttctggcaggctgtgaattcagagaacaaacaactcaattgagtaagaaagcaagagataatcaaagcaaatagttggcattcagtgagtttatacagtggcaatgtgtccttgggagaaatggtgttgttaactctgcagttagctttatctatgtctcttatcccagcctgatgagtagcagcacacgtactgttgctttcttagtccaagctaatttttatttctaagcattaagggtgcgagagagagaaagaacggcaaaatgtcataaacaaaaatctttctactcaaaataagcctgtaaacaaaagtttccagtcaaatttaaaaaatatataattctaagaaagatagccaacaagctcaacagttaaagcatgaaacaagctagtttgttccattaaaaacttcagctatcgatatacacggtatttatttaaaatgtgagtataattagaagcactgtgggctattgaaaaaaaatcatgagtatagatgtttaatatggacaattgctattttactcaaaacttttaatttacaattgcagaagtataaaaagttacaagagtaacagaaattatctataatttcactattatcacacagtgtgtgagggcttgtattttgtaagtgtttttaatttttttctttagtaattcatttttatcatattttacacaagtagtggtcttcatcaaagttgaaataaaaaaattctttgctccagatagttttagaaacactgctataggagacctgacatcaaagccaagttatcaagagacagaagactacatttgttcttactgtcaagtaactgatgaagaactgtctcctcctagtgacaatttcctacaatgagattttttaaatagaagataaatgttctcacttctttttcagggagtctggccaaggaaaagacacagaccttgcacaaatttatactactttttgctgtatttgatgaaggttagtgagtcttaatctgaattttggattcctgaaagaaatcctctgctactattaagaggaggtgattatagaaagatcataaattacattactgttcaggaatgaaggagatggggttaaaaatgaattccaagaaaacaaaacgtaacctcagttccactggcagctatgaggtaagaagatagaggagctggataacggactggcctcatccccctcattaagactgtcaacaaatactttgggctctactttctaaatactttctcttatcttcatctattattaagtgcacaacctttggcaagttatttaacctctctgtgtctcggtttcctaaatggaaataatagtacatttttcataagattgttgtgagtgctgagtgatttcacttaagtaacctagagcactgtgtggcatagagtaggccctcaatagtgttagtacctccgcctcttcctcctcctcctaatgtaatcactatgtaatcatagtaacataatattcttcttgcccccttatcaatttacattgccatcttcttaattgaggccctcatgatctgtctcataactctcaaaggaagcttactgaagtgagtatctgatcttgtcactctagcctctacaatacttcagtttgccagtttcggtggctcatgcctgtaatcccagcactttaggaggctgaggtgggcagattgcttgagcccaggagtttgagaccagcctgggcaacagggcgaaaccacatctctacaaaagaattaaaaaatcagccggtcatggtggcgggtacctgtactccagctacttgggaggctgaggtgggaggatcacttgagcccaggaggtgaaggttgcagtgagctgtgattgcgccactgcactccagcctgggtgataaagccagaccctatctcaaacaacaaaacaaataaaataattcaatttcaaggtaaagtgcaaaatgcattatctattctctggtgacatttccagccttgttgtgttccatttcctgccttatcttccatgtcacccaaatatgtaatgctttttcttgcatgagacctctgcatatgcagtttcctctgcctggaaaaatctgtctccctctttacactaagtaagcttctcctttttctttaagtctgacttacttcagttatccccttccttaattccttctcccaggatgacctctagtctggattagatgcctgcttatatttccacagcatcttgagcttattccttatcatactatatcagtattttctactttatttaatatttatcttctttgatctcatatctttttcccttcaagcaaagtgaaatttcttctcctctctgctccctgtaacaccctactctcatctttattatatcactctttactctttattataattatcagcttctctgacgattccagctagagtgtaagcatcttgaaagcagaggctgtatcttcctctctatcatcagtgtctacaattagtagtgctcaataaatatgtgtttgaatgaatgaacaaatgaatggctgcctcataaagttttagcactagctaccagtccttcacacaaaggggtaactccagggagtcactgttcaatagtatttccagtgcttcagcccttatcaatttcagagacagtgttagggagctttcaggttcctggggtttcataaatataagctgggatgaagcaattataacggagacagggactgacagacagcctttttcctaggacaattttcttttttcttttcttttttttttgagatcgagtctcactctgttgcccaggttggagtgcagtggcacaatcttggctcactgcaacgtccacctcccaggttcaagtgattctcctgcctcagcctcctgagtagctgagattacaggcacatgccaccatgcccgcctaatttgtgtatttttagtggggatagggtttcaccatgttggccaggctactctcaaacgcctgacctgaagtgatccacctgcctcagcctcccagagtgctacgattacaggtgtgagccaccgcgcccggcccctaggatgattttcataagctttcttttaaataattcagctaataaaaagaattgaatcctgatgcctcaagctaaccaatattctgtcttctattattatccattcccacttattgtcatggacaaatggagggagagaaaatcagtttgagcaagagatgtctgcctttacataattatcttctccctccctcacactgactttgagaggataagtgctgtgtgcctactttgctgacaaaaatgcttaaggtgtgagcacactgggagcagggaaggagaaaggggaggcggtcattcatgagacacatgcttagctgactctatctttgccttctctctcatcagggaaaagttggcactcagaaacaaagaactccttgatgcaggatagggatgctgcatctgctcgggcctggcctaaaatgcacacagtcaatggttatgtaaacaggtctctgccaggtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaccaacaacaacccagagctcacatgtgaggatgagacagttcccggagccacagagaagtgaaaaaactttgagaatcagacttccacatccatgactctccttcctcctattctgcccagcaccaagtgtatggaaaatctcccctcaactcatggtttctacactggaaaaagtgacattgaggtgttcaaccagcttctccaccttcttgggttccctggggggagatttgtccttgccttaacccacagaaaacatcatgactgtctgaaggcagaaatatcccagagtacaggcagagacaaatgagggaggaaggactaccatccccagccctggaaattctgctctataatttggccaaagacatgcaaattcagaatggccgtgcagcagcaccatgctgtagcaggtttatcctacaggtcaccttggcatgaatcactagctggccttccaacactgctatgataatccctttgggacctcacccacttgggacaggcagggctctgaccacttactggaacacctgtaatcccagcacttgagctcagcacaataacaataggagatggctactaccgttaattttatgcagttacgatttaatactggatctttacgtttgtttacatttgtcccaactggcaccttcatcacctccaccctccccaccccagactatggtaaccacgattctactctctattttcacaagatccactcttttagctcccacatgtgagtgagaacatgtggtattgccctgcagtgtcacctatgttgatgcaaatgaaaatattcttttttatggccaaatagtattccattatgtatatataccactgaactgtacacttaaaaatggtaatgatggcaaattacatatgtatattttacatcaataaaaagaaacttaaaaataaggtaacaataggattctatgaaaaacaatcataacaaaacgtgctcataaaaattataaacacaatggtcaaaatagaaactcaatagaaagtactaagaatagataaaatctttcataaggtcaaacaaaatgtggttgagaatatagttgacccttgaacaatgtgggggttggggtactaaccccctgcacagtcaaaaatccatgtataacttttgactccctccaaattcaagtactaatgacctattgttgatcagaagccttatcaataacataaacaacaaatattttgtgtatgtattatatgctgtatattttcaataaagtaagctagagaaaggaaaatgttatttatacttttctctgcttcttgggagtacttccagcatcactagtggcactttatacgggtcccaagtatccttcaaagtttatggagagatgaaatgcttatgcagagatgattagcatcatgcagagttttcagtggatgcctgcagcactcgagctcagcacaataacaataggagatggctactaccgttaattttatgcagttgcgatttaatactggatctttacgtttgtttacatttgtcccaactgggaatggtgccatgtatggttgtaagtatgtaagtttttataaatttcaactttttataatagatttttgtatattttatggtaataaatgataaaatagtctagtatcaacatgtatatgtatatataagtgtgtatacatatatatatatattttttttttttttttttttgagacggagtcttgctgtcgcccaggctggagtgcagtggcgcaatctcagctcactgcaggctctgccccccggggttcacgccattctcctgcctcagcctcccgagtagctgggactacaggcgcccgccacctcgactggctaattttttgtatttttagtagagacggggtttcattgtgttagccaggatggtctcgatctcctgacctcgtgatccacccgccttggcctcccaaagtatatatatatattttttgagacggagtcttgttctgtcacccaggctggagtgcagtggcacaatctgagctcactgcaacttccccctcttgggttcaagcgattctcctgccccagcctcccaagtagctgggattacaggcatgtgccaccacgcccacctaatttttgtagttttagtagagatggggtttcaccatgtttgccaggccggtcttgaactcctgacctcgtgatctgcccgccttggcctcccaaagtgctgggattataagtgtgagccactgcatccggccatctccatatattttttgcattcataacatacctttttcttaatttttttgatatttttaccctatgtggtccatctgacagttttttcaaattgtcataaatttccaaaaaaatctcactatatttattgaaaaaaaactgcatataagtggactcatgcagttcaaacctgtattgttcaagagtcaactgtgtgttttaaagcagattttaacatcaagaaatgatagaaaaatgataagaattaaaagagataaatattcatattagaattgcccatcaggagcttctgagtagctgaacgcatggaggttcctggagagtggctggccccatgccccttcccacatacccttccttatatatgcatctcttccatctggcgtttataagaaaaggtgctgactgctgaattataaggacactgtggtctactagataaaggttgaggagaggggtttgggcttctattgtcttctttccgggccttcatctcctgcttgtgattaagtagtgcatgctgagtggagcaaagtggtggaataggactcttcagcaataatctcctcacagaaacatcaaggtaacaactcgatgcgtgaaattaccttcagaagagttaagaaaacctgaacccatgagcaagactgtgaagcccttttggactgcaaagacgagtaaaaccatagttgcacataaaggggattggttctttatgactgagaccccacccgcaagccactgcagtaccacaggcggaaagtcaccatggacccacggtttttacaccggaaaactctcccgtatggcctgagtgccctctgtggatctccactaattagtagcagagccagcatgagacttgcgtctaacctgggctcagggcgccctctcgtgctaaaaggaaatacaacagccagtcctttcactttctttttgatatggtctctgttgcctaggttggagtgcagtggtgcgatcatagattactgcagtcttgaactcctggctgggctcacacggtcttcccacctcagcctccagagtgggactacaggtgtgtgccactatgcctggctaaattttcgggttttgtgtgtggggtggggaagattggggtattgctatgttgctcaggctgggtctcgaactcctgacctaaagcaatcctccagcctcagcctcctaaagtgctaggttacaagtatgagccaccacactcagccccactcaatttctaaacgagctcactgaaatagagcagtcacaaacaaacccagactgtgaacatgagaataaatacctaattcttcaatgtgtagacagggatgcacatctgcaaagaataagaatagcctaagaaagacagcctcaacaaatgaacaaaaaatcgtgccagtgactaatcctaaagacatgcaggtgaatgatctggtagacaaagaattcaaaatagctattttaagaaaactcaacaaacttttataaaacacagagaaacaattcagaagtttatcaaagaaatttaacagagaaattgaaggaataaaaaaagtcagaaatcctggaactgaaaagtataataaaaaatgacacatgcaatacaagacatcagcaacagaattgatcaggcagaagaaaggatcagcaagctcaaagacaggttatccaaaaatacaatcaggaggggcttcaggatggttgactagatgcatctagtgttcatcccttccatggagaggaaccaaagtagcaagtagataattatactttgaataggtcatctaagagagaacactggaattcaacagagcagtgacaggaagcattgaaagcaagggaggagagagaaataaggcctgtttgcctgggattggctgggagtctggaacagcttcctaatgtggggaaaaggtaagagacccttagtgttcctcattttcaccaaggactcttgcaatcctagccacaggagagcgccttattccttgacagcacagagactagcatagggagttgcctaaagaccgtgtgaaggcattgcaacagagagctcacgctggattctgcaattctcccaagcagctgcagcacagcaccattttgagaacacagcccacacatcctgccctgctatgatggccgtgacttaggcaggagccctgagcagtgatcctgccccacccagcagaggagtgcccatgcattttcacatattccaagaacaaattccactacctacaaccactgctgctgcaggctgctgtggggccaaaacactagtgaaccttgtgctcccaagctacctgcctacagctactccctgagaaagcaaccccaccttcaccaagagcagggctatagcacagctactgctgcaccccaacctgagcattttgctagtgacctcggtatcaccccacccctgcatagcacaaccagcacctcacacaccaccaaggagcctgagggcaggttcacgtagcccagctctacctgcccccagtacccaagcatatcatccaggggcctagggatcacttagccctgtccaccactggtggcacctgagcacctcctggggtctgaggtcaggcccactcaacctgccactactgccacagttagcactcactgcatgcaccacttgagggtctggagactggccatgcgatccatagcagccacaaccaacgccagcacagaccacttgagattcaggttgtttcattgctatgattgccatcaaccatgccactttgctgcccaggaacttgagaacccacccacccatgtgatccatcaataccacttctggcacccaagtaaaccacttggaggcccacaaatcaacctgcctggacctaaaaccagtgcaatcatatgccaccatggtacaccaaagacaagcacactcagcccactgctgccaccattggggcctgaagacaggcctacctggcatcccacttctcagaaaaacttcaccacagcctccactaataaccacaccctaagccactgagaaaatcacaaatatcactgatgctgtttagaatcttatacagaggctactacattcaccgagaatcaaaaccgaagtgctctacccaagcaacaccacagatacatcttcaggaaaaagttctttcctacaaaagcaaattttaaaaattggaaaaagtgattattacaccagatgtgcagatatcaatgtaaggacacaggaaacatgaaaaatcaaggaactatgacactccaaaggagcacaataattctgtagcaagagatccaaataaaaaaaatttaagatgggtacaaaaaaatagaaagaatgaataagacctgctatttgatagcacaacatggtgactatagttaataataacttaattgtacattctaaaataaagagtgtaattggattgttaataactcaaaggataagtgcttgagggtatacatacctcattctccatgatgtgtttgtttcacatcacatgcctgtatcaaaacatctcatgtgttccataaatatatacacctactatgtatccacaaaataaaaaaatcatagtttacaagcaaaacagtatatgtgaccattggtttttaagtaaactggccaacatctctttaaaaatttatgaaatcctggaaaaataattccaaattttgatactaaataaactcagtgagatacaagagaattctgaaaaaaatacaaagaacacagaaaaacaattgaggctatgaaagagaaatttacccaagagatagatatcaaaaaagaaccaaacaaaaattctggaaccaaagaattcattgaatgaaatacaaaatagatttgaaaggttcaacaatagaccggaccaagcagaagagtatcagaactgaaatacagatcttttgaaataacccaatcagacaaaaataaagaaaaaagaattttaaaaaatgagcaaagatttcatgacatattaggcactataaagtgaccaaatatttgaatcttcagtgtcccagaaggcaaagagaaaatgaagaggttagaaagcctatttaatgaaatattagatgaaaaatttccaagtctaccaagagatttagacatctagataaagaaggctcaaaaatacccaaataaatacaatgcaaaaaggtcttctccagggcacattatagtcaaactatcaaaagtcaaagaaaaaaatttaaaaatagcaagagaaaagcatatagtcacctgtaaaggagccgctatcagactaactgtgaatttctcagcagaaactttacaagccaggagagaatgagagagagagaaaaaaaaaaaaaaacacctgccagccaaggatactgtacacagcaaaattatccttcataaatgaaagagagagaaaaatattttcagacaaaaaaaaactgaggaaattcattgcaacctgatctgctttacaggaaatgctaaagggagtttttcaaactgaaagaaaaaggtcctaatgtgtaacatgaaaacatctgaaggtataaaacccacaggtaaaagtaagtatcccgacaaattcagaattctctaacatggtaattgtagaacataaatcacttatatccttagtaggaagattaaaaaacaaaacagataaaaataattaccataacctgttaaagaataagcaatataaaaagatgtaaatgatgacatcaaaaacacaaaatttgggagtcgattttttaaaaaattttcttgcaatcaaaattaagttgttatcagttcaaactaacttgttataactataaggtattctgtgtaagcctcatggtaattacaaagcaaaaatttttataatagatacactaaaaataaaaagcaagggattaaaacatactgatagaagaatcacttaaccacaagggaagagattaagagaggaagaaaggaacaaaggatctacacaacaactagaaaacaagtaaaaatatggcactaccaagttcttacctatcaaaaattaccttgaatacaaatgggttaaattctccaactaaaagacatagagtgtttggttttttgttcttgcgatagtttactgagaatgatgatttccaatttcctccatgtccctacaaaggacatgaactcatcattttttatggctgcatagtattccatggtgtatatgtgccacattttcttaatccagtctatcattgttggacatttggaccgcatattctcactcataggtgggaattgaacaatgagatcacatggacacaggaaggggaatatcacactctgggaactgttgtggggtggggggaagggggagggatagcattaggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaatttaaaaaaagacatagggtggctgaatgaatttttttttaaaaaaagatctaactacatactgcctaagagaaagactttacctgtaaggacacacatagactgaaagcgaagggatagaaacagatattccatgcacatgtaaacaaaaagaaagcaggaatagctatacttatatctgataaaatagacttcaagtcaaaaactataaaaagagacaaacagccagacgtggtggctcatgcctgtaatttcagcactttgggaggctgaggcgggtggatcacctgaagtcagaagttcgagaccagcctggccaaatggcgaaactccatctctactaaaaatacaaaaattaaccaagcatggtggcaggcgcctgtagtcccagctactcgggaggctgaggcaggagaatggcatgaacccgggaggcggagcttgcagtgagccgacattgcaccgctgcactccagcctgggcacacagcgagaatctgtcaaaaaaaaattgacaaacaaggccattatataatagtaaagaagttaatacaacaggagaatgtaacaagcataaatatatatacacccaacattggagcacctaaatatattaatgtttgatctttgtattttctagtctcattaaaagtaagggcaaaaactacaattacttttgcaccaacctaatataaagcaaacattaatagaccaagggggaaatgaagacagcaatgaaataatagtagaaaactttaacaccccactttcaccaatggacagatcatccagacaaaatatcaacaaagaaacactggacttgaactgcactgtagaccaaatagagcaaacagacatttacggaacattccatccaacagctacacagttcacattcttctcaactgcacatggaacattctccaggagattatacattaggccacaaagcaagtcttaactaacttttttaaaatgaagtatttttttcctgccaataatggaataaaactataaatcaacaacaggaggaacaactgtacaaatacatggaaattaaagaacatgcccctaaacaaacaatgggtcaatgaagaaattaaaggagaagttaaaaaatttcttgaaacaaatgaaaatggaaacataacatgccaaaacttatgggatacagcaaaagtagtccttaaagaaaagtttatagcaataaatgcctacatcaaaaaaaaatctcaaataaacaacctaatgatgcatctcatggaactagaaaaacaagaacaaacaaaaccccaaattattagaagaaatgaatgaatacagatgagagcacaaataatcaaaatagaaactaaaaaatacaaaagatcagtataatgagttagttagttctttgaaaagataaaaaaaagtcaataaacttttagccagactaagtgataataaagaagaaaaacagaaataaatcagacatgaaaaaggagacattacaactgataacacagaaatacaaagaattataagaaactactatgaacaactataagccaacaaattgaaaagcctagaagaaatggataaattcctggacacatacaacctaccaaggttgaatcaagaaaaaatggaaattttgaacaaatcaacaatgagcaacaagattgaagcaaaaatacaaagtctcccatcaaagaaaagttcagtacccaatggcttcactgctgaattctaccaaacatctaaagaactaataccaattcttcacaaactattcaaaaaattgaaaaggaagaaactcttccaaaattattttaggaggataatgatcattatcctgatcccaaaaccagacaaaagcacaataacaacaaacaactacaggccaatatcctcaacaaaatactagaaatagaattcaacagcacattaaaagatcatttaccatgatcaggtgggatttatcccagtgatgtaaggatggtttaacatatgcaaattaagaatgaaggacaaaaattatattatcattttaatagacacagtaaaggcatttgacaaaattcaatatcccttcatgataaaaactctcaacaaagtatagaaggagcatacctatatgataaacctacaaacaagatgaaactgagtggggaaaagttgaaagcttttcctttaagaactggaataagacaagcatatccaccctcaccacttctattcaacacagtactggaagtcctagccagagcaattaggcaagacatccaaattggaaagaaggaagtcaaattgtccctgtttggccaggctcaatggcttatgcctgtaatcccagaactttgggaggccaaggcgggcagatcacttgatgtccagagttcgagaccagcctggcaatatggtgaaaccccatctctactaaaaatacacacacacacacacacacacacacatgctagccagacatggtggtgcgctcctgtagtcccagctactcgagaggctgaagcaggagaatcactagaaccccagaggcggagcttgtggtgagccaagatcgcaccactgcactgcagcctgggcaacagagtgaaacactgtctcgaaacaaaaacaaaaacaaacaaaacaaattgtccctgtttgcagaagacatgatcttatatatagaaaactgccaaaactacaccaaaaaactgttagagctagtaaatgaatgtagtaaacttgtagtctacaaaatcaacatacaataattgatagcatgtctatatgccaacagtgaacaatctgaaaaagcaatcaagaaagcaatcacgtttacaatagctacaaaaaatgtccagaaataaattaaccaaggaagtgaaagatctctataatgaaaactataaaatattgatgaaagaaattgaataagacacaaataaatggaaagatatttcatgttcatggattgaagaattaatattattaaagccaaagcaatctacagattcaatgcaattcctatcaaaattccaatgtcattcttcacagaaatagaaaaacaatcctaagatttgtgtggaaccacaaaaaatcccaaagagccaaagaagtcttgagcaaaaagaataaacctggaggcatcacactacctgatttcaaattatactacaaagttatagtaaccaaaacagcattgtgttgacataaaaacagacatatagaccaatagaacaaaatagagagcccagaaatacacccaaacatttaaagccaactgattttctacgaagttggcaagaatacatgatgggtaaagaacagtcttttcaataaatggtgctgggaaaactggatatccatatgcaaaagaatgaacctagaccccctatctctcaccacgtatgaaagtcaaataggccaggcacagtggctcatgcctgtaatcccagcactttgggaggccaaggcaggcagatcacttggggtcaggagtttgagaccggcctggccaacatggtgaaaccccgtctttactaaaaatacaaaattagccaggtgtggtggcacacctgtagtcccagcaacttgggaggctgaggcaggagaatcacttgaaccccagaggtggaggctgcagtgagcctagatcgtgctattgcactccagcctgggcaacagagtgagactctgtctcaaaaaaaaaaaaaaaaaaaaaaaaaagaaagacagaaagaaaagaaaagaacaatagattaaggaattaaatttaagacctgaaactctgaaattattagaagaaaacatagtgtaagcatttcatgacatcaatttgggcaagaatttgttagacaagacctcaaaatcatgagtaacaaaagcaaaaataaagaaattggattacatcaaactagaaagcttctgcacagcaaaggaaacaatcaacagagtgaagagacaacctatagaatgggagaaaatatttgcagattatacatctgacaagggattgatatctagaatatataaggaactcaaacaactcaatagcaaaagtccaaataatcctattaaaaatgaacaaaagacctgaatagacatttctccaaaagagacctacaaatggccaacaggtatatgaaaaatgctcaacatcactaaccatcaggaaaattaaaatcaaaactacaatgagatatcacttacccctgttagaatgactattataaaaaagacaaaataacaagtgctagcaaggatgtggagacaaagaaacccttatacactgttggtgggaatataaattagttaagccattagagataatggtatagagatgcctcaaaaattaaaaatagatctatcatattttctagcaatcccactactgggtatataccaaaaagaaatgaaatcagcatgttgaagaaacatctgcatccccatgtttatgacagcattattcacaatagtcaagatataaaatcaacttaaatgcccatcaatggatgaatggataaagaaactgtgatatagatacacaatggaatactattcatccatttaaaaaagatgaaatcctgtcattttcaacaacgtggatgagcctggaggacattatgttaagtgaaataagccaggcagagaaagacaaatactccatgatctcagtcctatgtacaatctttaaaatttgatctcatagtagttgagattagtgattctaggaagataagggggaagtgggagatggggagagattggtcaatgggtacaatgttacaggtagatagaaggaataagttctggtactctattgcacagtagggtgacaatagccaacaataatatattgtatatttcaaatagaagagaggattttgaatggtctcacaacaaagaaatgacaaacatttaaggtgatggatatgataattaccctgatttgaataattacacaatgtatacatgtattgaaacatcacattgtacccataaatttgtagaattatttatgtgtcaataaaaagtaatacagttaaaaaaataaaattgcccattaggataaataaaaagacccacacacaaaattatcattgtggcatttcagagcacagagagaagatacttaaagcttcttctgagaggaacaggacgcatacaaaagaatgggaattagactggcgatataattaagcaatattgtaaaagatctaagggaaaaattatttggaacctagaatttttagtcaaactatgaatcaattttgggggaagaaaaaagacattttcatatatagagggccttaatagtcactgaatgtgtactatagtaaaaccagaaactacataaaagaggaatttgggagattcagcaacccaagagaataatgaagtatgagggggatgttttctccttagttcttttccgtatttttcaataatttgataataaacatgcataattttataattaaaaaggaaattaattttgacaacatgcaagttcctgttctcacataccttatagtggagggacagattgtagtcaaataagcataataatacatgcaaaattacaaactgagcattactctgaaggaaaattacataattctatgtaagcctataatacaggaatctgacctagactggggaatcagagaaggcttccctaagcaagtaccccttgaacttagctttgaaactgggaaaatgaggcaatgtgagatgaagctgttagaggtattaggaatcaaacctattggggccttctagtccttagtagagagtctggactttattctatgtggaatgacagcctccagtgggttttaggctggcggatactacaatcagatctggaatgcagaaatagtacaccagtttctttgtgggtaaaagtcttagaggggagaatatgaccaactgtagggagacctgtaaaaaaagtttatcagtagctcagacgagataatggtaacttggattaagatagtggtagtagtaacagtgaaaaactagatacatttgaaagcttttagagccaaaataggaggcagctgtgcccttgttgttaccagtgtgggatctgaacacatgactacttgggttcaaatactgagcaaattaattaacctctctgggcatccgtttcctctcctgcaagacatggatgataatggtttctacattcatagggttgttatgaggaatgaatgaattaaaacttgtaaaatactttggacagtgcttgacataaaacaagtgctcaatacatattagctattattgattatattgccctggtcagtgtcaaactgcatatgggagatgagaatggtaacaaggataactctcacttgcatattcaaatgcaggatgctgccattcactgttataaaaaactctggaagagaatgaagtgatgaaaattgtaaatttggttttgaacatgtgggttttttgagatatctaggtggagatgttgagaaagtgattggctgtatgagcctggagttccagaagaggtcagcaggggagacagaagaaggagcagtctgagaagtaggagaaaaaaacccacagagatgttggcacagaggccaagggaagagagagttttaaaaacgaatgaatggtcaacaggtgcaaataaagactgaaaaatgtccattggatttagcagcatgatggtgattggtgaccttggcaagagctgttggtttgatagtagcccaatgttcttgataaatttgtttacaagtcaaggtagcaataaagtgtctaaagtcaatttgtccattctgtcctagcaagtgttttccatttcagattctctacttcatagccataggtgtcttattcctactttacaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatggtaatatcttggatctttaaaatgaatattataaatatccagtcctacttttaataaaatttactggacaatgtacaggaatatagtgtgttgctgaaggggacattatagagttactgtattagacctcagccaagatcccctagtttccagcttccagtgtaaagtttttaccttgactataaaagggcttgagtattagtaggactcatggatttttagttaaatgtctgtgatggagaaaagatggcttatggatgattgaggtgggaaaatgaggagaatagtatgcccttggtttctcagccttatcccattaattacgctccaatattatggagagaggaactgcaagttgtagctgaagagattttttttttttttggagaaatctagggaaatgggaaaaaaaggcattgtccagattgcaactgtaagggctccactatatcattagtaatgcccagagcagtaaatagcaaatatgacaggctattgtagagcttgacttcagacaccagacagccagaggcactctgtagatacctggcagtagatgagagacacctgtgaaactgagggcaggtcaggagctagtgaattttagaagtaacatgggattgaaaggactatttggtgggaactttggaaagggtcaaaggttctgtgtaagcaaattaggacgatggtaactacagttttaaattattgttaatgtaactttatttgtaactgctagttgtgcaaattcagattgcatcatcatttcaccccaattttccttacttttgtatttattctgctaactcttaatcttggatcaacctaataaccctctttctctacccctctcgtggccattgaaggctcttagtcagtttgtgctgcaataacagtataccacagaatgggtaatttataatggacagaaatttattggctcacatttctgggggctgggaggtccaatatcaagttgcctttttctgcgtcttaacatggtggaaggcattatatgacaaaagggcaaagaaagggtgagagagagcaagaggagggtgagctcactcctgtgataacaaatccactcccatgaacactttccccagataactgcattagtccattcatgagggtggaacgcttatgacctaaacaccttttatatgttcacctctcaataccatcacgatgataattaaatttcaatatgagtttcggaggggacagacattcaaaccatagcaagagttattggagaaaaatgtcggagaggcctaatcttttatatttaatagcatttctttcttcctattactctcatattaaccttctcctcaggttccttggttgacttagaaaagagaattgatcttgccatgcatccaccattttcctccttatgttctattagtgaccttgtttattgtcttctgtagtgattaagaatagaaatctctcttccccatgtgtcacataatatttatggaattttgacaagaccttagtggacaaaatgtgtcatactgaatgagtaacaggaagttgatgcacaaacaacattcttgcaggcacagaggaataggtcatttacttgtatatgatcattgtcaatcaatcattgtccagttggaccccgattcagtttattttttgttttgtttttctccttttcacagattctatccactaattttaatctttatttttcagaaaaaaatgctttatcttattgaacctcagaccaaacactttgtttttcgatgcagactgagttatgtttaaggctacatgaaccccagactagttgtttgctgctcctaaaaccttccctgttcctcataatcaagtaaacaggtctcccttcttagaagtatttgatcttcaaaattgccctgtggtataaatagggcaggaattattattatccattttacaaagcatgaagatgagactgagaatgttgaatacatttgccatagggtttacaactagtcacaggcagacatgctcttaaaatatatatctccttgattttaagttgtatcttgtcatggttttatgaacttggaacatgtcttaaagtttatatctacactaacatttttcccaataagctgttattaaatcaatgatttgtggcaagaagggatagtgatgtggaaagggggggtacttaggggagagcctggaaggcctaataagagagaaagaagtcataaaagttaaggcaagtgatatggtttggatatttatcttcactgaaatctcatgttgaattgtaatttccaatgctggaggtggggtctggtggcagatgtttggatcatgggggtgaatccctcatggcttgatgctgtcttcatgatatttggtcattcagaagtgtgtggcaacttgcactctctgtcttgctcctgctttcaccatgtgacatgtctcctcccccttcacctacccccatgattgtaagcttcctgagacctccctgaagccaagcagatgccagcaccatgcttcccatatagcctgcagaaacatgagccaattcaatctcttttctttataaattacctagtctctggtatagaacagcctaatatagcaagacactctgacattgtttggtttgtctgactccagatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacaggtaagcactttttgactattggtactctctcttccccatactcaaaaagttcttaccagttattcaaaccaacaaatcctgaagccatgtttaaggttaggtacaggtatggaatcaaatggcaagggtattaacatttggaaactaacatagctgagcatcagagaagcttgtatttttctcactccttgccttgattgaatcatataagctgttttagagttggatttgagcctacctagaatttttcttcccaacctctcatctttttttctcttatacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttggtaagttgaagaaaagatttaaggtcaggtaagaagaaaaagtctggagagttttgagtttctaaaatacctcataattcagccttgtctccaatggacatgatcttttaaaagctataaatgttacacaaataatagctgattgtatgtatttaaagtttgagtatatagaataaaaatttaatgtcacccactaaactcgacactcctttgaaatactgcttagactttgatacatatccttccagatctttctccattaattatgtcatataggagtcagcagactatggcctgtgaaccaaatttggcttgtggcctgcttttgaacagtccatgagcttagatgagattttacatttttaaaatattgcaaagaaaagaaaggaggatgggaggaaggggaggagaaggcggaggagcaagagaatatgtgacagaggctagatagggctcacaaattttagagtacttactatccagccttttccaaaaaatgcttgcttgctcctgatctaggatattaagaatgagtatggtgtaagtaacagaatactcaatggacagtggtttaaataaataagggtttattttcttcacaagaaatttgaagattggtcgttggttccataaattcagccgctgaagaatgtcatgaagaacactggtttttagatatggagttttgttagatactgccaaactgactttcagcaattttgtaccaatttatatcccctaccataagtatatgactgcccttttccccacaccattgccaacaacatatattataaaccttcagaaaattttccaatttgatgagcaaaatgtttatatgttgtcttcatttgcatttccctggttagtggtcaaattgtatattgtttcatgtttgttggctatttgtataactccctctgtgaattgcctgcttgtaaattttgtccagttttctatttggtcagtcatcttttgcttatgtatttgtaaaaggtctttatagattatggatattgacacattgttatttatctttcaaatgttttcctcacattgtcacttgtactttaactcctttatgatattttttgtccttcaaagatttttcatctttatatagtcaaaacctcctatcttttatcaatcttttcatttatatgtctctggatctttttcacttatgttttctgcctgagaatgtctttgccacccccaagacactacaaaaatagtctatattttattctcttacttgtatagctttatttttacagtgagcaatctaattgccctggaagttacttttgaatgtagtgcataattcaaatagaaattttcccaaatggcagctgacacaaccaatccttttttcattaatttgaaaatgtcttctttatcatatactaaattgctaaaatctgggatttttaattctccttaactaatctgttaccaccctgttttaatgacttcaactttgtgatatgtttgatatctgtatgacatcttctttcattgtacttcttcaaaatttttattagctattattgtacaatttttcttcataaattttgtgtacgtattttttctatttttcattttttgaagattgtataattttattttttattcattaatttttaaaatgcataatgacacaataattttacatatttatagggtactttttgtgtattttgagttacttttactggctaatttaaaaatagataaacaagagcatgcaataaaatgtaaattttcctccctcttggacttccaaccccatagtctgacagacagtcattgctgtgggtttgtatactcccctccagaagtagtgcatacatgtacaaatgtgtgtgtgtatgtgtgtgtgtgtgtgcatttcacacaaaaacaagagcagtgtaaattggtctgtaccttgatttttaaaaggtaacaatatattttgaattagccaggcatggtggcacatgcctgtagtcccagctactctggaggctgaggcaggagaatcgctcgaatctgggaggcggaggttgcagtgagctgagatcgcaccactgcactccaccctgggcaacagagtgagactctgtctcaaaaaaaaaaaaagtaacaatatattttggatatcatttcatgtcaacatatatagatctaccccattctttgatttattcaggttatactctggataccatgctgaatcctacacttaaacattacctcaaaatggatcaaagataaaatgtaagagctaaaactacaaaattataagaaaacaacaggataaatctttgtgatcttgaattagacaatagtttattggataggacaccaaaaccaacaagcaacaaaagaaaaaccatttgacccagccatcccattactaggtatatacccaaaggaatataaatcatgctgctataaagacacatgcacacgtatgtttattgcggcactactcacaatagcaaagacttggaaccaacccaaatatccaacaatgatagactgattaagaaaatgtggcacatatacaccatggaatactatgcagccataaaaaatgtccccgtttgcagatgacatgattgtatatctagaaaacaccattgtctcagcccaaaatctccttaagctgataagcaacttcagcaaagtctcaggatacaaaatcaatgtgcaaaaatcacaaacattcttatacaccaataacagacagagagccaaatcatgagtgaactcccattcacaattgcttcaaagagaataaaatacctaggaatccaacttacaagggatatgaaggacctcttcaaggagacctacaaaccactgctcaacgaaataaaagaggacacaaacaaatggaagaacattccatgctcatggataggaagaatgactgggttttaagacaagagcagaagtggaagttgcatttttatcctcatatcacacacctcagatctggaggtgggattgatattttcagggttcttcgctgcagcttccatgttattgctcttccattctctctctctctctctctctctctctcgtctctgtctctctctctctctcttgagatagggtctcattctgtcacccaggctggagtgctgtggtgtgatcacagctcactactgcagcctcaacttcctgggctgaagtgatcctcccacctcagcctcccaagtagctggtactataggcatgcaccaccacgcctagctaatttttttattttttgtagagatgaggtctcactgtgttacccaggctggtcttgaagtcctgggctcaaacgatcctcctgcctcagcctcccaaagtgctggcatgagccactgcacctaggcctttgttttcttttaaagctggtgcaatcaggcaataccacctgctacccttgcttaatactgtaatcaactgtcctcttggtcatgcctgctcatgcactgaagattttatctcctgaaacactgtctctttctctattatcagtgaatttaatgcccaaatagtaataaaggctgagaggaagcagtgtcctcaccaggcatctaaatttcaattagtgtgagaaggtgcagagaatacttcctgaagcaattgaaacaatttttaaagaagtggaaaggggcctttagagagaaacctaagtactgtcagccctctacattgtcaactgaagaatcctaagtttgtaaatttggagtggaaagggttgcaggctgggaagtgtagcctctggcagcaaatggaagcaagcactttgaagaaggaaggatgagataagaatttatgctgaatgagttggctaagtatacatatttaacaggttccaggaggagctgtgaatatttatgatggggcacctgcaaccacacatgttacatacattccatgttcactttggggtggagacttaacatttagatgcatgaaaattaggctgtatatgtcaaaagatgaaacagaggacacagaggcagcctctgtaaactggccagagccagtccatggtcagtggtctctcatcaggaagcaatgcttctcggttgttatgataaaactgcacaaagggaggggaatccaccacgtctttagaaaggactggtttatgtttaacccttaagaaagaaagtctaacggcagattagggagggagggaatgtaacaaggcatgcccgatctcccatcccatcatggtcagaaactcagtttttaagccatctctggggtctccttggccgagaaaggggtctcttcagtcgtttggggatgcttaagattttatttttatttttcagtatcactggatttctagtctcatattcaaacaaccattgattgaaagtattcaaaaaacaaccccaaaacaataaaagataataatacaacaataaacaataatacaaagaaacaatacggtaaaacaactatttacatagcatttatgttatattatgtactgtaagaaatctagagacgagttaaagtacatgagaggatgtgcatatgttatatgcaaatactacatcattttgagtaagagacttgagcatcacagattgtggtatctgcaggggtcctggaaccaatcctccatgcatgccaaggaacaatttcatgaaaagaccaaatattttgagttttatctagcctcaaattactataatgtagatagaggccacttttatttatctggagttagaccacagttttcttgttgatcctagtcgttttaggatttgatcttagatctcgcttatactttcagattatatttaagaatcaagcaagcagaccatataacatctaccctcacggaatcactgatgtccgtcctttgtattcaaggagattaccaaaaggtaaatattccctcgatttatagctcttttttacctgtagatacagatgagataaatatcatcaataacaactaaaattatgttggtcctttctccagctgttggccggacctcaagctccagtctaaagttataaaaatcaattataggaatcctcaggtgatgtttcatgtaaattcgtgaagagtcgcctgacatgtttttcctattacctagcggtgatgttcaaatattccacagccaattagattccactgcaattggttccactgcaactactgtaaatgccctaaaatcttgaagctggttcttctggcacttaagataatttttttttctgagtacggttttcagctacattccacacttttggtatctagtgtggtattccacactttgggtaactagtttgatattttcaggattctttgctgcagcttccatgttattgctcttccttgctctctctctctctctctctcaacagggtttcactctcacttttggtatctagtttgatattttcagggttcttcgcatattcatttctaaatagttcacaactccagtttttatttactatattgtttgctgtttaaagatttattttttcttttagtagattggatgttatgtatattctttctattatttaattttggatgaatatttatcaaaataatagatgtgtatgcttaaaactacaaaagggctgcctccctagaggcatccatttttaagaatttctgtttttgatttttggtggttatctctacatctctaaaaagttacttatactgctaactctttgtttttcaactttagacattatatacttactttgttttgtgcttttttccattcaagttgtttcagttttatcagtgttttcagttggattggctatcattagaactttaaaaatatactaaacatcaacttttagtaagatattttccaatcatggattgaaaatatcttttgactccatacttcataaattaaggatattaaaaactgtacccctcacttttcctttccccaaacctttcttttctctactgctgctagccattcctttacttttacaaaactaaacttgataacatttacattttgtgctgtaatttgaaataactcttccttgctttgtctatatattttctctaaagcttaaaaaattaaaaaacagcatttgtattattttagtattttagcaagtttcttttcataaatgttaactgcagaactgggtaatatgctatgattgctctcttttctacagctcaagtgattttactattaagataaaataatatgtggaaggaaaaaagttgatctcatagaagtagagataaaatagtggttactagaggctaaagaggggaaggggagggggaaatagggagacgttggttaatggatgcaaaattccagctagataggaggcataagtcctaatgttctatagcactgtagggtgactgtagtcaacaatgacatctattttcaaatagctagatgagaggatttggaatgttcccaacacaaaggtgtatcctgaagtaagactttgttttcttttattcggaaaagaaatgtaggcttcttcaaccctatttcttaggcctttcagcttcttaatcattctatgtattgcttgctatccaaatcttttattttttttttgagacagcgtctcgctctgtcacccaggctggagtacagtggcacgatcttggctcactgcaacctctgcctcccaggctcaggctatcctcccacttcagcctcctgagtagttgggaccacagacgcacactaccatgcccagctaattttttttattatttttattttttgtagaaatggggtgttaacttgttgcccagactggtgtcgaactcctgagctcaagcgatctgcctgcctcagcctcccaaagtgctggaaccaaatctttttcttcttaaagacattcttgtagtgaatagcattaactacttttcccttgtacatttctattttttgatttcttcttttgtttttctggaagtatattctcaagtaacttctaaatatgtggtacatagagggtgaactttctgaatccttcagtatcacatgatgggcagacagactggttataaaaattttcccgctgggtgcggtggctcacgcctgtaatcccagcactttgggaggccgaggcgggcagatcacttgaggtcaggagttcaagaccagcttggccaacatggtgaaaacccatctctactaaaaatacaaaaaaaatagccgggcattgtggcgtgtgcctgtaatcccagctactcaggaggctgaggcaggagaattgcttgaaactgggaggtgaaggttgcagtgagccaagatcaccccactgcactccagcctgggcaacagagcaagactgcatctcaaaaaaaattccttcccctgttttctaatattcattattgccgataagaattctttatttgcatttctttatggaagaatggcatagtgacagagttctggggagattttgaatgtgtgtcccgaaatttggaggcatacgtggatagttactggtaacctgcttttccatggagaattttgaaggctgtaatgcccataatagtgggcaagaagagagggcaagagtggagcagtttaccttcctgctgtttgacatgagtttattctgtaacaagtgaatactgttgaaagtagctgggctttatcccttttgaagatattctacccaagaaggcagttaggcaggctgaggggatagcagaaccaatagagtcttggatatatcactggaagtaagaagagctgatggggagaggagagttgcagaaggatagctgaaagaaacatctctcatgtcatggaactatgtaatgctgaggtccccatggtaactctaaagaaaccatacatgtgtcctatgaaaagaccagcatttgggcacctcccacacagagaacattgatgaccaaatagtgttgtcaaagatagagcagcaggacctgttaaacaagagtctgtttgccctttcttctattacctaccctccctcacccccagctcctggaaaagggaagagaaggctcagaaatattgaaagaacatactacaccattccctttctttctttctttcttttttttttttttttggagacagagtctcgctctatcccccaggctggagtgcattggcatgatatcggctcaacctctgcctcccaggttcaagcaattctcatgcctcagcctcccaagtagctgggattacaagtgcctgccaccacacctggctaatttttgtatttttagtagagatggcgtttcaccatgttgaccaggctggtctcgaactcctcacctcaacaccattccctttctatggatcctctaaccataggtcaggcataacttactgaggtgaggaagagcttagaatgaatataaaattaaaattttgatttagattgtatcttcaggtatgaaacatacccagaatgagacttaattactaaaatcagttcttgtcctgaggacccattaccctgagggcagatctcagttcttgctccctttcctcacagaagtcagagactacaccttaaaactccaatgccaagctctttggcatatattcaggcctgacactttcacagtcaaccggataatcaattacagctttttactttttaaaaaaattgtttgaatcttaaaattataataggtgcgactttagcttccacttgctcagaaacttcatatgtacatacagatttgtagaacccttgcaacaacaacatgattatcaatatgtggcttgttgtactctaattgagctatttatggttttgcttgtgggtaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccaggtgagttcttgcctttccaagtgctgggtttcattctcagtgtatgtccccttataacctgaagaaaatataatggtttgcaatataggtcagtaaaagaaatgagcttagcttttactaaatttgagtttcacgtagtaaacgtgcctgctggatggataggccatagaatgtaggccctagatttttcctatagtactcattcccagtctgggatttagctctctctagctgatcctccccatttttatatgtccaattaccacctattttcagatgacccacagatttatatctacagcctagatttcttccatggacatctcattatgggtgactcaaaagtacctcaaaattaacatgtctgcagcatgtagcactgttgcaggaagtcagggaccccgaacagagggactggctgaagccacggcagaagaacataaattgtgaagatttcgtggacatttattagttccccaaattaatacttttataatttcttacgcctgtctttactgcgatctctgaacataaattgtgaagatttcatggacatttatcacttccccaaccaatactcttataatttcctatgcctgtctttactttaatctcttaatcctgtcatcttcataagctgaggatgtatgttgcctcaagaccctgtgatgattgcgttatctgcacaaattgtttgtaaagcttgtgtgtttgaacaatatgaaatctgggcaccttgaaaagaacaggataacagcgatttccagggaacaagggagataaccataaagtctgactgcctgcagggccaggcagaacagagtcatatttctcttcttgcaaaagcgaataggagaaatatcactgaattctttttctcagcaaggaacagccctgggaaaagaatgcattcccagggggaggcctctaaaatggccgctctgggagtgtttatcttatgcagttgaagataagggataaaatatgccctggtctcctgcagtgcccccaggcttgctaggattaggaaattccagcctggtgaattctagtcagaccagttctctgctcttgaaccctgtttcctgttaagatgtttatcaatgacaatgcatgcacagcaggacatggaacctcattagtaattctaatttcgccctaccttgtgatcttgctctgtccctatttgccttgtgatattttattgcctttgaatcatgtgatctttgtgacccacaccctattcgtacactccctcccctttgaaaatcactaataaaaacttgctggttttgcggcttgggggcatcacagaacctgccgacatgtgatgtcacccctggagacccagctgtaaaatttctctcttttgtactctttctctttatttcccagaccggccgacacttaggtaaaatagaaaagaacctatgttgaaatattgggggctagttcccacaatatagcacagtgcatctcacttagtaagagcttaataggctacgtgcggtggctcacgcctgtaatctcagcactttgggaggccgagacaggaggattgcttgagctcaggatttcaagaccatcctgggcaaaatagtaagaccttgtctacaaaaaaaaaaaaaaaaaaaaaaaattagctgggcatggtggtgtgtgcctgtagtcccacctactcaggaggctgaggtgggaagatagcttgagcccaggaggtcgaggctgcagtgagcctggatgacaaagcgacaccctgtctcaaaaaaaaaaaaaaaaaaaaaaaaaaaagcttaataaatacttttgggcaaaacatagggaaagatataaaatatttcaaaatatggctagaatttggaccatttctactgctttaaaaaataaagctaaattctctgaacaagaaaagcttagttcttcacaaaaactcattgctcggccccagaataactcagtgccatattgctgaggcttgactacatgtccatttgattatatttatgatacataagatccctactagtctgaaaacatttcatatgtttagagagtaaagtatatgaactttggtgccaataaaacacatggcacataaactcagagaagtataaattttgccaagtacttgtcctgaccgatttttcctaactatagttttttcgtcacttttgggaagagaactgaaatattattctatattctccaatctcctctcttcagtattttggtttatatagctataggttataaaaaatgaggtttatacatattagtgaggtttacatatgaaatcttagcagatccaattagcaagcgactaattcataaatctggttcatatacaaaatgctcttctgaaaaaaatttgaatgttttaaacagaaaatttaaggtattagtgttgtttgacatttttgtggttcaccttatctttcttatttgatttctgtttttctatttttaattttttatagccttgtggaaggtcagttgctagatggaagtttaggaaagtcagtatctcatttgacttaactaacttaagaaaggcactgaataaccacttggttctttaaggagttaaatcttctaatctgaacatgaagagaataaggctacagactgtaccaaataaatcagctagcatatggccttgggtgcagaaaaaactaagttcagtgggatcagtcaccctcttgtcctggggacacatttgttgtaagcatatactcactgctcatagcacccaccctcaactcccaagccctggtacatgcctaagaggaaatggaattaaaccaatggattagatatatcacatgcatgccatcgctttcatcatagactgctagctcctacctgacaacatcagtagcatttctttacccctttcaatatatgtaattaacagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagtgagtaaagcagcacttaagtccagtgggtggtgaataaagaaaaattgatgtaatcaaagtgatgtccagataatgaatgaattgtatgtgcacataaatttaacaattatgttacctataaatgtataatttttactcaaacacacgtgatcatataacccatattttaaaaatccagtcaccattttttcctttcaatatttacttgatttccctctcccttttaattccctatctccttctatattacatcttttcaccaaccattccatgcccaggtaacatattttaagacatattttctctataattatataatcatatataaacacatacatacattgtattagtcttctagtgctgccataacaaagtactgcagactgggtggcttaaccagcagatatctattgtcttacaactctggaggcttgagatcaggatgtgggcaacgttggtttcttctgaggcttctctccttgtcttgtagatggctttctcccttgtcttcacatggtttctcctttatatatctttgtcctaatctcctcttctaataaagataccagtattgttgggctagggcccaccgtaatgaccttattttaactaactacctatttaaaaacactatctccaggtatagtcacatgctgaggtactggggtttaggactgcaaggtataaatttgggatgggggaacacaattcagcccattgcatacatacacatgtgtatatatttatatataccacaaatctgaatggtcaaaaatatggtaaaaaattccaattgcactatcctacagggaaatgcgaaatagaataacaataggatagcactttatacccatcaaactgccaaaattataattactagtgggcttgtggataaaagagtgttctcatgctatattagtggataagtagtatagtcttttcaaaaccaatatatgccttttgaaattctgattattaagatgtttaagatggagtgagccacatttccctgtgtgtcccactggatgcaactaaaaatcctgaacaggccgggcacagtggctcacgcctgtaatcccagcactttgggaggccgaggcaggcggatcacgaggtcaggagatcgagaccatcctggctaacatagtgaaaccccgtctctactaaaaatacaaaaaattagccgggcatggtggcggccgcctgtagtcccagctactcaggaggctgaggcaggagaatggcgtgaacccggaaggcggagactgcagtgagccaagatcgtgccactgcactccaggccggcgacagagtgagactccgtttcaaaaaaaaaaaaaaaaaatcctgaacgaaatgcatgggaaccttgaaaagttataatgtgagttatactcacctaccagaatgtggcatatgttacaattctatgcccctcctctcaaagctttagccctttaactttgggttgagcctcatatttagcttgaatttctagtaatagtgatatattattctccagagttaaagtcctttactatccattattctaaaaattttaaggttgtttagtcctttgagttgcatttttattttttacatagttcagggtattgctttccttctgaaggattcagatttcacatttgtgcaagagtctaatgcttagtatttaattctagtggcacagagctttttcttttctccctcttctctccagcctcatggctttggtttagaattccttcagcctgatagaatattgtattttataatttccttattgtgctatttactagatatttgttcttctatttttttctattcataatttctccctttcccaccacatctttttccaagtaggatgtgcacttgccacagtatctggacagttaaactgtctcattttcttggagacggtgatgaaaactagagagatatagtgacataagcagagccagaaaacaatttcactgaagatgatatatattttttttcctctgggatttctaatatagcttttggtggagataagagtctggaattgagaaagaagagattggaattgagaaaaagagtctgagaaagcacagggagagacacaaaggcagagaccaagagacacaggggaaggatcttcagaggaagagtccagggagaaagatgctaagacagagggataagaaaagaagaaaaaaaaggaccaggaggagagagacccaaaccataaatcactcctatttccattagcagtaaaattgataatctattttcatacaatgaaataccatgtgacaatgaagattcacaaaaataaagctatacacaacaatatgaataagtatcacaaagacaatttttagtaaaatggtaagtgtcaaaagaatatatacagtattatattatttacataaagttcaaaaatgggcaaaattaacttatatagtttagggatacagaggaagaaaagtataaaggttagtaaggacatgattataataaaagacaagatagtggctacctcttagaaagagttcatttgagaataaacacatgtgttttgtggggatagcagcaatattgtatttcatgacctagatgtttgttttataattttgtgttttaaaaaattgtaggatttatgatttatttcgtagatggatcctacaaatgatagggaaattgcagtaggaatgaagaggaaggaacatgtacaggatttgtttagaagatagaaggcacatgattttgtaaataattagctatgtttggtaaaggactaagaggattcaaagatgattaccaaatttctgatatgggtaactagaagaagagtgagacaaaatggaagaaagtgtatttaaagaaatgatagcaaaaactttccaaatctggagaaagatgtaaatatccacgtacaagaagctcaaagatctctagtcagattagattcaaacaagactatatgaagacacgttacaatcaaactgtcaaatatcaaagacaaagagagaatcctgaaagcaacaacaaaaaagaagcaaaccacatacaaggaaattccaataaggcagaaactttacaggtcagaagagggtgggatgatatattccgagtactgggaaaactttacctagaaaatgtttccttcagaaatgcagagagataaagactttgccacacaattccagttagacaagagaaataaattaaagacatctattgtacactatggtgactacagttaataaattacccattccaatatatacatatataaacattgtgatgtacatcataatatattctatttttccctgtcaattaaaaaataaatttaaaaagattggatagagaagaatcagccattctagtaattaagcctgaggaagcttacattccagtgatttcagataaccattatgcaagttaaggaataaactggataggatgatattaaaaaaacaaaaccaccaatgagatacaccagaatggctaaaattaaaaaggctgtccataccaagtattggtaaagatgtagagtaatgagaactctcataaatttctggtcaggaaatccaaacatcgaaagccaaacatcggcataccctattgactcaggaaatccactcctagtatacacctgttatgtcctgaatcatgtcccctagaattaatatgctgaagccctaacactagtatttcagaatgtgactgtatttggagatagggtctttaaggggtttattaagttaaaatgaggttgttacaatgggccctaatccaatatgactagtgtccttataagaagaggaaatgtgggccaggcacagtggctcacgcctgtaatcccagcattttgggaggccaaggcgggcggatcacgaggtcaagagatcgagaccatcctggccaacatggtgaaaccccatctctactgaaaatacaaaaattagctggacatggtggcgagctcctgtagtcccagctactcgggagactgaggcagaagattgcttgaacccaggaggtggaggttgcagtgagcagagatcacgccactgcactccagactggcagacagaccgagactccatttgaaaaaaaaaaagaagaggaaatgtgtacacacagagacaccagggatgcatattcacagaggaaagaccaagccaaggagaggtgtcagtaaaaaccaaacctgccaataccttgatcttggaattttagtgttcaaaactgtgagaaaacacattcctgttatttacacctcccagtctgtggtatattgttatggcaaccctagccactagtacagcacccaaaagtagtgtgtacatatttcacaaaagacatgtaactatttaatccatgtggagtgtcaaaaggcaaaaatacaacaaatgtattttaaagattgtaattggcttttatacatgattctagaatcagatagccctcagaaccaaatacagaacagcagccagcaacatagtatggatagaaattggaagtgaggtttagagacagcttaattgattacagttgggcatttttgccttatttgaagctgttagtcgcctgcaattgatggaagttcagctgctataatcggctgagactgagctgtttgttataaaagcatattcctaaattaggctttcagttagttcatcaactaagccaggctgcaactttgttgtgcaaggactcaagtgcaaaggtacccttaggcaaaattcagattaatttaaaaggactttacttttgttagttatgtgaaatgaagtggaatctattttttccaagtggatagtcatattttctattatcatttaccaactagctgatttttttcctgtactggttggagatgctgcctttattatatattaagtttcaacttattatatattaagtttccgcttacatcttgtcagtttctggactccatattttgtttgatatatttatctattctgcattaagactgcatttttaattataatagctttataatatctcaatgttgtataggaaaaaaacttcaattattaattagttatactaagccaatgtctaagtattgcttagtggtttgtgggcaaccatcttacacagtacctagtaacagagtagacaagtgtttattgaatggatggatgaatggatgtgtggaagaggctttcagaaacaattcccttcatagactaaggccaatgttacttttgcttagctctttagtttgaaataatttaaaatgtacagaaaagttacaagaataatacatggaacttgcacacaccctttacccagattcacaaatgtttaacattttgcaattttgtttttcattttcttttctttatatacacacttctgttacttattttctatttgaaaattagttgcagacatcacatccctttacctctcaatactttagtacacatttcctgtgaataaagatatcttttacataacagacacttcaaattgataaagcacatttccataatttacaactggtattccagttgtatcaaccaatgctgtcatttatagcattttcttctttgaagtacagggatctagtacaagtaactacttgtcctgcttctttcatttccttgaatctggaccttcatcagatggtaactttaagcacccaaaggtttttttctggtttctcctctgtgtagtttaagaccatgcaaacatcttgctactcatcaaaatgccccccatataacatccaaattaatctttatcatgatggtttatgactgtctcctcacattgggattggggcccaactgattattaacaatctacttttttggaagatataatatctcttcctgggaataagataatgggcataacatataataattcctaattgtatcatgacaatcacaatccaaaatactaaatctgtgatgtgtctaaatctcttttccccattgtttttgcaggcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggttagttattatatttttcttgtaccaacagctgtgaatgcttcactagccattcgtatgctcttttgcccactagctcacatgctgtcatttatagcattttcttccttgaggtacagggatctagtttctcctctgagtagttattattttcacccttgcaactaataaacagtttgaaggatcacgtagtagttctatttttagttttttgaggaacctccttactcttttccacagtatttgtacttatttacactcccaccaacagtgtacaagcattccccttttgccacatcctcaccagcattttttaattattttgtctttttgataaaagccatttaactggagtgaaatatctcattgtgcttttggtttgcatttctctggtaattagtgatgttgagcagtttttcatatacttgttggccatttgtatgtcttctttttttttttttttttttttttttcagacggagtctcgctctgtagcccaggctggagtgcggtggcacgatctcggctcactgcaagctccgccacccgggttcacgccattctcctgcctcagcctcccgagtagctgggactacaggtgcccgccaccacacccagctaattttttgtatttttagtagagacagggtttcaccgtgttagccaggatggtctcgatttcctgacctcgtgatccacccgcctcggcctcccaaagtgctgggattacaggcgtgagccaccgtgcccagcctgaatgtcttcttttgagaaatgtctattcagatctttgtccatttttaatagggttctttgttttttttgctattgactagagtttcttatatattctggttattaatgccctctcagttgtatagtttgcaaatatttcatcccatcctataaattgtctcttcactttgttaattgtttcctttgctgtccagaagctttatggcttgatataatcccatttgtctacttttgctttagtcccctgtgcttttgaggtcttacctgcaaaatctttcccagaccaatgtcctggcgcattcccccaatgttttcttccagtagtttcatactttcaggttgtatattttagtctctaatccattttgatttgatttttgtatatagtgagagataggggtatagtttcattcttctgcatgtggatatccagttttcccacaccatttattgaagagactattctttcaccagtgcgtgttcttggcactttgtcaaaggtgagttggctataaatgtgtggatttatttctgggttttctgtcgtgttccactggcatatatttctggttttatgccagtaccgtgctgtttttgttactacagctttgtagtatagtttcaagtcaagtagtgtcatgcctccagctttgttcattttgctccagattatttagctgtttggagtcttttgtggttccacacaaattttaagattcttttttctatttctgtgaaaaacttcactggcatttggataggtattacattaaatctggtagcattgatattttaacaatattagtttttccagcccattaaaatgggatagataccttttcagttttttgtgtgttcttcaattccctttatcagtattttagttttcattatagagatatctcagctctttggtttaatttattccaatatatttatttttattatagctattgtaaatgatttttaaaaaatttctttttaggttgttagctcttggtatatagaaatgctactgatttttgcatgttggttttgtatcctgcaactttactgaatttgtttatcagttctaatagttttttgatggagtctttagttttttgtgaaatataagattatgtcatctataaacaaggagaatttgacttcttcctttccaatttgggtaccctttatttctttctcttgcttacttgttctggcttggacttccaggactacattttatagaattggtgaaagtgggcatccttatcttgtttcagatcttaaaggaaaggcttttggttttccacatttggtatgatattagccgtagtttgtcatatatggcatttattgttttgaggtaagctttctatacccagtttgtttagagttttctcatgaagggatgttgaatttaatctttttggcatcaattgaaatgatcatttgtttttgtccttcattctgttgatatgatgtatcacattgattcatttccatatgttgaaccatccttgcatccctgggatgaatcccccttgatcatgatgaatgatcttttactgtgttgttgaatttggtttgctagtagttcgttgaggatttttgcatcaatgttcatcagagatattggcctgtagtttctttttgtgtatgtgtgtgtctttgtctggtttggtttcagggtaatactggccttgtggaatcagtttggaagtatttttcccccttgatttttgggatagtttgtgaagagctggtattagttctttttttttattattatacattaagttttagggtacatgtgcacaatgtgcaggttagttacatatgtatacatgtgccatgctggtgtgctgtacccattaactcgtcatttagcattaggtatatcgcctaatgctatccctctccccttcccccaccccacaacagtccccagagtgtgatgttccccttcctgtgtccatgtgttctcattgttcaattcccacctatgagtgagaatatgcagtgtttggttttttgttcttgcgatcgtttactgagaatgatgatttccaatttcatccatgtccctacaaaggacatgaactcatcatttttatggcggcatagtattccatggtgtatatgtgccacattttcttactccagtctatcattgttggacatttgggttggttccaagtctttgctattgtgaatactgccgctataaacatacgtgtgcatgtgtctctatagcagcatgatttatagtcctttgggtatatacccagtaatgggatggctgggtcaaatggtatttctagttctagatccctgaggaatcgccacactgacttccacaatggttgaactagtttacagtcccaccaacattgtaaaagtgttcctatttctccacatcctctccagcacctgttgtttcctgactttttaatgatcgccattctaactggtgtgagatggtatctcactgtggttttgatttgcatttctctgatggccagtgatggtgagcattttttcatgtgttttttggctgcataaatgtcttcttttgtgaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagttcccatttgtcaattttggcttttgttgccattgcttttggtgttttagacatgaagtccttgcacatgcctatgtcctgaatggtattgcctaggttttcttctagggtttttatggttttaggtctaacgtttaagtctttaatccatcttgaattaattttagtataaggtgtaaggaagggttccagtttcagctttctacatatggctagccagttttcccagcaccatttattaaatagggaatcctttccccactgcttatttttctcaggcttgtcaaagatcaggtagttgtagatgcgtggcgttatttctgagggctctgttctgttccattggtctatatctctgttttggtaccagtaccatgctgttttggttactgtagccttgtagcatagtttgaagtcagggagcgtgatgcctccagctttgttcattaggcttaggattgacttggcgatgcgggctcttttttggtttcatatgaactttaaagtagttttttccaattctgtgaagaaagtcattggtagcttgatggggatggcattgaatctataaattacattgggcagtatggccattttcatgatattgattcttcctacccatgagcatggaatagtcttccatttgtttgtatcctcttttatttccttgagcagtggtttgtagttctccttgaagaggtccttcacatccgttgtaagttgtattcctaggtattttattctctttgaagcaattgtgaatgggagttcgcttatgatttggctctctgtttgcctgttattggtgtataagaatgcttgtgatttttgtacattgattttgtatcctgaggctttgctgaagttgcttatcagcttaaggagattttgggctgagacaatggggttttctagatatacaatcctgacatctgcaaacagggacaatttgacttcctcttttcctaattgaatacactttatttccttctcctgcctaattgccctggccagaacttccaacactatgttgaataggaaaggtgagagaaggcatccctgtcttgtgccagttttcaaagggaatgcttccagtttttgcccattcagtatgatattggctgtgggtttgccatagatagctcttattattttgagatacgtcccatcaataccaaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttttgtctctgcccggctttggtatcaggatgatgctggcctcataaaatgagttcaggaggattccctctttttctattgattggaatagtttcagaaggaatggtaccaattcctccttctacctctggtagaatttggctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagcggtctatcaattctgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccatctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttgttttacatttgctgaggagagctttacttccaactatgtggtcaattttggaataggtgtggtgtggtgctgaaaaaaatgtatattctgttgatttggggtggagagttctgtggatgtctattaggtccgcttggtgcagagctgagttcaattcctgagtatccttgttaactttctgtctcgttgatctgtctaatgttgacagtggggtgttaaagtctcccattattattgtgtgggagtctaagtctctttgtaggtcactcaggacttgctttatgaaactgggtgctcctgtattgggtgcatatatatttaggatagttagctcttcttgttgaattgatccctttaccattatgtaatggccttctttgtctcttttgatctttgttggtttaaagtctgttctatcagagactaggattgcaacccctgcctttttttgttttccacttgcttggtagatcttcctccatccttttattttgaggctatgtgtgtttctgcacgtgagatgggtttcctgaatacagcacactgatgggtcttgactctttatccaatttgccagtctgtgtcttttaattggagcatttagtccatttacatttaaagttaatattgttatgtgtgaatttgatcttgtcattttgatgttagctggttattttgctcgttagttgattcagtttcttcctagcattgatggtctttacaatttggcatgattttgcagtggctggtactggttgctcctttccatgtttagtgcttccttcagaagctctcttaggtcaggcctggtggtgacaaaatctctcagcatttgcttgtctgtaaaggattttatttctccttcacttatgaagcttagtttggctggatatgaaattctgggttgaaaattcttttctttaagaatgttgaatgttggcccccactctcttctggcttgtagagtttctgccgaaagatcagctgttagtctgatgggcttccctttgtgggtaacccgacctttctgtctggctgtccttaacattttttccttcatttcaactttggtgaatctgacaattatatgtcttggagttgctcttctcaaggagtatctttgtggcattctctgtatttcctgaatttgaatgttggcctgccttgctagatttggcaagttctcttggataataccctgcagagtgttttccaacttggttccattctccccatcactttcaggtacaccaatcagttgtagatttggtcttttcacatagtcccgtatttcttggaggcttcgtttgtttctttttattcttttttctctaaacttatcttcacacttcattttattcatttcatcttccattgctgataccctttcttccagttgatcgcattggttactgaggcttgtgcattcatcacatagttctcgtgccgtggttttcagctccatcaggtcctttaaccacttctctgcattggttattctagttgtccattcgtctaattttttttcaaagtttataacttctttgccattggttcgaacttcttcctttagctcggagtagtttgatcttctgaagccttcctctctcaactcatcaaagtcattctccatccagctttgttccattgctggtgaggagctgcattcctttggaggaggggaggtgctctgattcttagagtttttggtttttctgctctgttttttccccatctttgtggttttatctacctttggtctttgatgatggtgacgtacagatgggttttcggtgtggatgtcctttctgtttgttagttttccttctaacagtcaggaccctcagctgcaggtctgttggagtttgctggaggtccactccagaccctgtttgcctgggtatcagcagcagaggctgcagaacagcagatattggtgaactgcaaatgctgctgcctgatcattcctctggaagttttgtctcagaggagtagctggccatgtgaggtgtcagtctgcccctactggggggtgcctcccagttaggctactcaggattcagggacccacttgaggaggcagtctgcccgttctcagatctcaagctgcgtgctgggagaaccactactctcttcaaagctgtcagacagggacatttaagtctgcagaggttattgctgtcttttgtttgtctgtgccctgcccgcagaggtggagcctacagaggcaggcaggcctccttgagctgtggggggctccacccagttcgagcttcccggccgctttgtttacctactcaagcctgagcaatggcgggcacccatcccccagccttgctgccaccttgcagtttgatctcagactgctgtgctagcaatgagcaaggctccatgggcgtaggaccctctgagccaggtgcaggatataatctcctggtgtgccgtttgttaagcccgttggaagagcgcagtattagggtgggagtgacccgattttccaggtgccatctgtcacccctttctttgactaggaaagggaattccctgaccccttgtgcttcctgggtgaggcgatgcctcgccctgcttcggctcacgcacagtgcactgcacccactgtcctgcacccactgtccggcactccccagtaagatgaacccggtacctcagttggaaatgcagaaatcacccgtcttctgcatcacttatgctgggagctgtagactggagctgttcctattcggccatcttggctcccaatgcaaagaccttcaaacaacgtgacttcattttctcactcctaccttttgtgctcttgtcatttatttgaattctacatatattttaaaccccataagacattattattgttttatataatcaatatcatttatatatatatatatatttacacctttcatttctttcattcttttctgcatttcttgcttccatctatgatcattttctttttgtctgaagaaacttctttggaacttccttcagtgtgtgttggctagtaaaaagttctctgtcagtttttggtcagaatgggtctttattttgcctagatacaagtccttggttggatttacatattgtgaatgttttctcccagtctgtggtttgtcttttcactcctttaagggtgcattatggttaatagaagttcttacatttaattaattcttatttttcagttttttatggttaatgccttttgtattctgtttcagaaatttttgcctatcctaagaacatgatgccatccttctatattttctttctacatattttaaatattttcttctagaagtctgattgctgtgttgttcacaattaagtttatgattcatttttaattaattttgatggagtgatgcagataaaagttcatttttccatatggatatttaattgctctagcaccaattgttggaaaaaaataatttcctcactgaattgcactgttgtctttgccatgaatctgatgactgtatcactgtagctttgtttctgtactctatttcaggggtaggttatgatccacaagccaaatttgcagcttgtttttatatggcattgagctaagaatttttttacatttttaaagaattgtcacacaaaacaaaaaaaaagcaaaaaaacaaataaggatatgtatcatggaccatatgtgtctacaaacctaaaatatttactatgttgctttttacagaaaaagtttgccaacccctgatctcttatattccattgacttattggtctatctttgtaccagtaacatactatcttatagtaagttttaatatttgttagtataattcctccaactttgctctctttgatttttatataaattttagaatcatcttgtcaattttatcaataaaaatatcttctgaggttttgatagggattacattgattctgcagatcaatttgggggagcatacctcttgacaatattgagtattcctgtccatgagcatggtttagttatttatttacatcttttaaattttctcttggcaatgtttttgtaaaattttagtgtacaggtcttgcacatttttgtaaagtgtattctttggtatttaatgctattataatattttttatggtatcagtttttgtcaattgtgtttttctagaaatatgtccctttcatctaagttgtttaatttacttgaagtaagttatttgtaatgttcttttatcatccttataatgtctgtactgatgtctccgttttcatacctgatattgttatttatattttatctattttaagtttatcgcctgcacccactaactcgtcatctagcattaggtatatctcccaatgatatccctcgcccctccccctagtgcacatgtaccctaaaacttaaagtataataaaaaaaaaaagtttgtcgcctttgttataggttcatcaaatttactaatcctaccataggatcaaatttttgctttgttcatcaggtcatggaattaaaaaaatttttttgttttgtttattttctatgttgaatttttatttttattttgctttgcatttcatttatttctggtcttttgttattattccaatactttctctggattcagttttctttttcttcttgacttcttgagattaaaacttggttcattgattttcaacatttcttactttttaaaagttcatacaaagcataaatttccctttatatactgctttaaccccatatcacaaattttgatgagtcatatttttattatcattgagtttaaaatattttataaattttacgttatttcttgttttattcatagttattttacagtgttttacttaatttcccaatatatggcgattttctggctctctctctgttgctgatttatttgttttactgtgatcacataacatactctatattatttcaatcatttgaaatttgttgagacttgctatatgcccagtgaataatttaatttgattaatggcccactgcatttgaaacaaatatgtctttgctgttattgggtagagtgtcatatatttgcctattatgtcaagttgctttatcatgtttttaaaatccttataaacttcctgatattttatctgtttcttacagacatggaggaaactgtgacatctctgtgattgttgagtttgttattttgatttttgtatttgttagtaagaatgtttcaaaataaatgaggcaatataaaatcaggtgcttacaactttaaggttgtattcttattaaatcaattctttcatctttgtgaaatgtcctttttgtctgaagtagtacttgttgccttaaacgtctgcattgtctaaaatttatacacctgcactatcatatttattttgcttaatgtttgtgtggtatatatttcccattcttttcttttcaacctatctctatccttatatttacagtgtgtcttttttaacattttctgtagtgcaagtctgttggttaattaattttgtcagtttttgcttctctgaaaagtctttatttctgtttttgaattatatcttcactgtgtatagaattctgggtttgtggttgttgtttttgttttattacattttgttttattggtttttccctcagcactttaaaaatgccgctccattgtttctacttgcatagtttttcacaataagtttgttgtaattcccatttgcattcaactgtacataatgtatctttttaaaaaaatctggatggcttcaagctctttactttgatttttgtgtgtgtgtgtgtgtgtgtgtgtgtgtgtgtgtgtgtgtgttactttggcattctctaggcttattcaatctgtaatttggtatcattaattttgaaaaatatttatcatctgtgtcttcaaatattgcttctaattctttctcttcttctggtattgcatttacatatattatactgttcaattttgtcacacagctcttgaatatgctgttctagtttgttttctaactatttttccttctagttgttcagttttgttgacatttattgacctatttttacttcagtaattgtttcctgggttgttgagttaattgatgaactcatagatgacatacaatttatctttttattcttgtgtcacttgtgcttttgatgtcacatctaggaaggctttgtctagcccaaggccacatttacttccatattttcttctaagagtttgatagttgtagctgttacatatatgtctatgatctagtttgaataaatttttgtgtatggtgtgaagaagaggtctaacctcttttttattttttgcatgtaaacatccagttgtcccggcaccatttgttgaaaatatgattcttttcccattaagtcatcttgacacccttgttgaaaatcaattgaccataaatgtgagagtttatttctgaactctccattctgttccattgacccatacgtcttctataaattcttatagctaattctacattagactttggtttttcagatgtggtcatctcattagattatggtgatatgtttggttacaagttttatcttctccttggcaacattttttttattactgctcttcttttattcgtttttgttgttcctttctctttttgtgagacagggtctcactctgttgcccagggtggagtaagtggtgtgatcatggctcactgcagcctcaacctcctgggctcaagcaatcctcccacctcagcctcccaagtagtgggactacaggcatgcaccatcatgccaggctaacttttttattttttgtagagacagggtcttgctttgttgcccaggctggtcttgaactccaagctcaagcaatcctccaacctcagcttcccaaagtgctgggattaccagtatgagccactgcacctggccttgttgttcctttcttccttttatcttgtagtatcttgatcctttttgcttattatttatcattgaggtgagtttgttctaaataaacttttcgcagaaagtttatgtagatatattaatatcaatgaggcattaggagtgagttttagattagcaggaattctcttatgaaaggtattgattgtatgtgtgagttttcagcctttacttctctccagcccatcaagatcaaagctgcagagttgtttacatttcagaatttctttcctcccctccccaccttgcaaaacagacttacagtgcaaaaatgacttgtcaatgtgattctttcttctggtcccatctttcctaccttttgagacttgtgttgaaaggagtccagtaaaaccaccgatgctagcttgtataccctgatcccattgttataatgaatgactgactgtttttcatatcaaagtataatacttgcaccttgatagaagaaagaaacaaggccaggcacagtggttcatgcctgtaatcccagcactttgggaggctgaagtaggaggaataattagactttgatattaaaaatggggaagatatggcggtataagatatgaggaagtatgtcttcttggacttttctgaaatctgccagccatgagcatccactctttttatcttttgatacctgttttatattaactatacttctattttgtggtttcatggcttcagatatcttccagcttaattgtactctgtctttaattatttgcagcaatttctgaaaggagcaagaagaaaggccagccctttcttcactaccttaaaaactggtcatcttttgaaaccccatgaaaggcacagtgggtgaccatctacatcaggagtgggcaaactatggcccttgggtagtctggtctctgtccgtttttgtaaggttttattggaacccatacacacacaaactgatcatctcttgttatgtgttaagttttcttataattattcttttctatttcatccagctgaattaccatttcaccttgtgtatgccctttccagtcttaaattatagaagctatgtctttgtggttttaaattatggaagctgtgccttcttgtgttttagtatggcaagatatttgttcttacttttcctctagaatctgcagtggattactttcagaagtaggtattgcctctaagtttcctgacttctgtttccttctccctgttctgtagtatatttatagattgcatgttttctcgtccttaaacaaggtacaaatatgttctgatcaaggtttgctagccgagaggataagtggcttgctcttagcctaactctctgtctacttaatggatgtcgaattcccttctcaactcaacagctagtaactagttccaagatcggataatagcttacagaattaattagttcagtgaaagccctggtttgatcacagaggcaggagactgatctatatatttgtagtgctgactagaccccaacttggccagatagcttatacctatgtcagaagttggaggaggagattgacagctgaggtgtctccaagggaattacaattattttcattttctttgtgtctgtaattatgtctcttttcttacttcaaattttgtatatgtgaaatttcttaatttttatttggttatttattttattgactttttcatcaaacaaccaactctaagttcttggattgaaatttatgaattaattataatgttttaaatttaccattagtcacacatacaatacaaaaagatattttcattacaaaattttaacccaagccattaaaactaaactccagcttggtcaccattcctaataccaggcccctctcagaggggagggtaaataaaagtccattttggtaactagtttgacgagaatctctaattgtttccctgtttttcttataatgtctgcctttgaattatcctctttttttcaagagttccatcatataatgtattcctttttgcttacagattgacctcctagaggcatgcatccccctgctccagtctgagctggttctctctaggcctgaggctcagttatcaacttgggacttttatttaccctccctcaggataggtacctggttcttggataccaggtcttactcttgtttgagatactcctttattttggtggcaaacattccataatcacttcctgataatggtgacatttgaggtagattttctgagtctttatatgttagaatatgtttttattctcctttgccacttgattgataatttggctgcacatagaatgtaagcattcacagggcttttgggagcagcttcccttgagaagaaggtggatgcagttaagatcttccctgaaaagactgtgtgaaatgacaaggctattgaggtacccaacgggtagcttggtaaaggtgtatcttgtctcttatgtttatgcatctactttaccaccatgtaattagcctattataacttgttgcattccttcactcagctaatcttgttcatggtagaaattaatattgctagtaccatggtagaattttatattagctggatcctagacctaaatgctccttccttgtgcttacatattctgcaagtgggtgacagtggatgctaggtattgtgttatgtgatttcaatgtattatatgatggggtagatactattagcctcatttgaaaattagaaacctattgttcagaaagtttaagtgactttctcaaagtcacacagctggtaaatggtagaactgggatttgaatccaggcaatctgatggatttaagaggaacctgtgccactatgtgatatagcaataacatctagccaatataaatactttcctgaattaaatcactgtcatattcagagagttctgtgtcactattaagaccctccattattgtgtatattaattacatttccctattttaatcccaatatctattcatttttatcacagtcctttcttatggtcacaaacaggcatagtacaacagcagcaatgcaaaaaccacttttatattacatgttccagggatttaacccaatgacctgtgatataatgatactgactagtattttttcatttatctgggaatgggagagaacctctaacagaacgttttagaatctgtgttatgagtaaccagagtcttattcttcctcatctccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacaggtatgaatgcattggttattcctttgctctgctcttgtgacatttgactttaccagatgatgacaccaacaatgagagttagaggatgaaaaatcaaggtgtcttgaaactcttactctggtgagatagagagaagagaggtttacaagagggtagaggaatcagggacaagaaggagcaatggggagcaggaagaaagtcaacctcacctatcaaccttatgagctgcaggggaaatcttagtctcatcagagaactttaagcaaggcagaaggaagaagcaagttcgtgttaaagaggttaaggacttggggaggattggttttcatgatactggggatccagagggcaaagtaggatgattttatttttaggtgagtagagggaggttgagcagtcaagtagtacagagaaatgtggaatataaacataaggagagtcagtcagtcacaaatatttatggaacacctactacatgccagacacttttgtacacattggagtgcagcacagcaggagcttatattctattggaaagagcaagagacaagttagtacaaaactaaataaggcaatctcaattgtgttgttcagaagatagaatagaataatatggtagagagaataatatgatagagtaatacggtagagtgttacattagctgtggtggtcatagaaatcatctttgaggagttgagacctaaatgatgataacaggccagctgatggagctctgagagaagatgtttccagacagagggaagagaaaatgcaaaggccctgagaatggaaaaagtttaccatgtttgaggaacaagaagggacaagcatgacttgtcactttcccaccttgctttctagctcaagtaagcccttattgctgcattgcaaccatagactatttccctagtccactgactttctcattctcctggacctctatcttagattttctgtgttttccttaaatctcgagcaccttttttccattctccaatgcccattttcactcttagctgatgctgtgcaatgaacctccacagactcccaacatcacatttactggcatttgtacccatatactctgcctgcacacttattacaataaatagagtgtctgtgctcctaaggccaacctctccagttttgtacttgattcccatctcttctcccttcataaaaaatgttgctccagcaatttctccttttctcccttacatcatcaatttatctctccactagattaatctcatcaacatcaatcatgctattatttcctcccctatctttacagaaaccgtcttaaaataattgtccctgcttgcagcctttgcatcttttcctgccattctctcctctttaacccactccaaagaagcttttatctctattatttcataagaactacattttcaaggtcattattgatctttacattactgattactagccctcatcttatttgaattctcagtagtatttgagaggtgattactccatcgttgatacaggttctcacttggtttctctaacaccacttttcttcacttttctactaaacttactgccaatctttgtcaactttgcgagtccttcttcatccccctaatctttaaaggttagagtgctccagggattagttctccaacttcttctttattctatttatactcactctgtgacgacattgtttagcctcatgattttaagtactatctatctgcagataattccagttgaatatctggagatattctcagatctctctcctgaagtcaaaatttacatatcaactccctaccttaacatgcacacaattagactcttaattcctgccccttcccaaaacctgctgattgctcagccttctccatggcaatcaaaaaccattcctggccgggcatggtggctcactcctgtaaccccagcacttggggaagctgaggcaggtggattggttgagccccagagttcaagatcagcctgggcaacatggcaaaacctcatctctattaaaaatacaaaaattagccaggcgtggtggtgcacacctgcagtcccagctactcaggaggctgaggcacgagaatcgcttgaactggggagacggaggttgcagtgagctgagatggcctcactgcactccagcctgggcaacagagtcagacttgatctcaaaaaaataaataagtaaaaccattccctatttcagttattcagtcacagatcttgaagttttccaactctttttttcttacattaacatctaatctgtaaaggatcctgtattagtccattttcacactgctaataaagacatacctgagactgggcaatttacaaaagaaagaagtttaatggactcacagttccacatggctggggaggcctcacaatcatggcagaaggcagggaggagcaagttatatctcacatggatggcacaggcaaagagagagagcttgtgcagggaaactcctctttttaaaaccatcagatcttgtgagacttattcactatcatgagaacagcaagggaaggacctactgccatgattcagttacctcctatcaggtccctcccacagaacatgggaattcaagatgagatttgggtagggacacagccaaaccatatcattccaccccatcccctcccaaatctcgtgtcctcacatttcaaaaccaatcatgccttcccaacagtcccccaaagtcataacacatttcagcattaactcaaaagtccacagtccaatgtctcatctaagacaaggcaagtcccttccacctatgagcatgtaaagtcaaaagcaagttagttacttcctagatacaatggggtataggcattgggtaaatacagccattccaaatgggagaaattggccaaaacaaagggcctacaggccccatgcaagtctgaaattctacggggcagtcaaatcttaaatctctaaagtgatctcctttgactccatgtcttgcatctgagtcatgctgatgcaagaggtgggtgcccatggtcttgggcagctccacccctgtggctttgcagggtacagcctcccttgtgtctgccttcatgggctggcattttctgtagcttttccagatgctggtgcaagtttctgatggatctaccattccggggtctggaggacggtggccctcttctcacagctccactaggtggtaccccagtagggactctgtgtgggtgccctgagcccacatttcccttctgcactgccctagcagagtttctacatgaaggcccacccccgcagcaaacttctgcctgggcatccaggcacttccattaatttctaaacaacaaagcattcaagaggcgacttgggtgctattaagggcattcagtttcataagggaagcagagcataaaagtttggaaaatttgcagcctgataatgttagagaaaagcaaatcccattttctgaggagaaattcaagcaggctgcagaaatttgcataagtaatgaggagccgaatgttaatccccaagacaatggggaaaatgtctccagggcatgtcagaggtcttcacaccagcccctcccatcaccggcccagaggcctaagaggaaaaagttgtttcatgggctgggcccaggatccccatgctgtgtgcagcctagggagtcggtgccttgtgtcccagccgctacagccatggctgaaaggggtcaatgtagagctcaggctgtggcttcatagggtacaagtcccaagccttggcagcttccacatgatgttgagcctgcgagtgcacagaagtcaagaactggggtttgggaacttccgcctagatttcagaagatgtatgaaaacacctggatgcctaggcagaagtttgctgcgggggtgggccctcatggagaacctctgctagggcagtgcagaagggaaatgtgggctcagagcacacacacagagtccctgctggggtaccacctagtggagctgtgagaagaggaccaccgtcctccaggccccagaatggtagataccctaaatcatctctttcaaattcgaagttccacaaatctctaggacaggagcaaaatgccaccagtatctttgctaaaacataacaagagttacctttgctccagttcccaacaagttcctcatctctatctgagaccacctcagcctggatttcattgtccatatcattatcagccttttggtcaaagccattcaacaagtctctagagagttccaaactttccacattttcctgtcgtcttctgagccctccaaactgttccaacctctgcctgttacccagttccaaagtcgcttccacatttttgggtatcttttcagcagcaccccactctactggtaccaacttactgtattagtctgttctcacactgctgataaagatatacctgagactgggaaatttacaaaggaaagaggttttatggacttactgttccacatggctggggaggcctcaaaatcatggcagaaggcaaggaggagcaagtcttgtcttacatggatggcagcaggcaaagaaagaaagcttgtgcaggaaaactcttttttttcttttcttctttttagacagagtcttgctctgtcacgcaggctggagtcagtggcgtgatcttggctcactgcaacctccacctcccgggttcaagtgattctcctgcctcagccttccaagtagctggtactacaggcatgtgccaccacatgagatgagattttggtagggacacagccaaaccatatcattccccctgtcccctcccaaatctcatgtcctcacatttcaaaaccaatcatgccttcccaacagtcccccaaagtcataactcatttcagcattaactcaaaagtccacagtatttttagtagagatggggtttcaccatattggccagactggtctctaactcctgaccttatgatccgcccgccttggcctcccaaagcactgggattacaggtgtgagccaccatgcccagccaaaaactcttctttttaaaaccatcagttctcatgagacttattcactatcacaagaacagcataggaaagatctgcccccatgattcaattacctcccaccaggtccctcccacaacacatgggaattcacgatgagatttgggtggggatcctcttggctatcatttcaaaaaatagtcagggttgattatggacttagtattgaataagatgaaaatgtactgaaatggaacgatgaagataattgaccagggaaagcaggttacaagccaagagaggatacagtgtcacttcagatgctataaaagtgatgtttttattttttgaatgttatttggctatattttcaaattatctgcactgcatatgcactgcttctgtaataataaaagggtattaaaataataaaatcaagtctataaatcacacacacacaccccagcctcttctctacacctcagtgactaccaaccacatctaaattatcatcatttctcatctgaattattgcaagaagccattgcaataattcagatgagagttgatacaaagccttcctgtttccaaccttaccctcatatagtcttttcccaacattgcatctaaagtaatttttcaaattgcaattctgatcactgttctctgcttcagatcctccagtggattttcatctcactcagtaaattccaaagccttcaccatggccttcaagaccctacgaaatttgaccctctgcaacctctctgccttcatctgttaccattgtctcctgttaatcctgcctcagccacactgacctccttgttcttctcaaatggactagatgtgtgcctatctctagaccattacagtttctgttctctctacttaaaattatgtccctgatactctaatgcaagttctcttacttccttcaggacgctgctcaaatttcattttatcagtgaggctttccctgaacactgtatgtaaatattgctcccaccattttttttcaatgcacttaacagtgcctgaaatattatatatttatttctttattgtctatcttctctgactataagttaagctcattaagaacacaaactttggaggtattgttcaatgttgtgtccccagaactttgaacagtgcctggcacgtggcagatgttcaaataaatgtatgttgaatgaattagaaaatgataaatgtagggagacaaaagcaggtctcccatttatatccaaactctaggactctaggaaagactgattatatggaatcgtgtcacacagcatccatgggcaagagtggaggcagagataccagttaagatgctattgcagtcatacagataaaagaagacagttatttagaccagtgtggtggtgacagaaatggaaagaaatggaaggatgttgggtataattaaagataagcatataagactggctgttaattgagtatgggaagaatgaggagagaggatgtaaagaacatttctttttgtttgtttgttttgttttgtttttgtttctttttattatactttaagttctagggtacgtgtgcacaacctgcaggtttgttacatatgtatacatgtgccatgttggtgtgctgcgcccattaactcatcatttacattaggtatatctcctaatgctatccctccctcttccccccaccccccaacaggccccggtgtgtgatgttcccctacctgtgtccaagtgttctcattgttcaattcccacctatgagtgagaacatacagtgtttggttttttgtccttgcgatagtttgctgagaatgatggtttccagcttcatccatgtccctacaaaggacatgaactcatccttttttagggctgcatagtattccatggtgtatatgtgccacattttcttaatccagtctatcattgatggacatttgggttggttccaagtctttgctattgtgaatagtgccgcaataaatatacgtgtgcatgtgtctttatagcagcatgatttatagtcctttgggtatatacccagtaatgggatggctgggtcaaatggcatttctagttctagatccctgaggaattgccacactgacttccacaatggttgaactagtttacagtcccaccaacagtgtaaaagtgttcctatttctccacatcctctccagcacgtgttgtttcctgactttttaatgatcgccattctaactggtgtgagatggtatctcactgtggttttgatttgcatttctctgatggccagtgatgatgagcatattttcatgtgtcttttggctgcataaatgtcttcttttgagaagtgtctgttcatatcctttgtataagattattagtggatttctcagaagaaatattgtagaccagaagggagtgaaaatatagatttaaaatcctgaaaggaaataaaaactagcaatgaaaaatactatatccagtaattttatctttcagaaatgaaggggtgataaagattttctcagaaagacaaaagctagatctgctttataagaaatgctagtaggagttcttcaagctgaagaaagaggatgcttattagtaatatgaaaacatatgaaaggataaaactcactagtaaaaataagtacattgtcaaatccaaaacactctagtagtgtaatggcagtgggtaaattaattatatctttagtataaaagataaaagacaaagaaagctattttaaaaactaaagctataataatgtgttaaggaatgcaaattattaaaatatgtaaactgtcacatcaaaaacataaaataggctgggcacagtggctcatggctgtaatcccaacactttgtgggggccaaggtgggaggatcacttgagcccaggcatttgagactaacttgggcaggatagtgagatctcatctctataaaaaatttaaaaattagtaaagcatggtggtgcatgcctgtagtcccagctactcaggaggtggaggtgggaggactgcttgagcctgggggggtcaaggctacagtaagcaatgatcacaccactacactccagcctgggcaacagagcaagaccctgtctcaaaaaaaataataatatgtaggaggaagggaataaaagtgtagagtttgtggatgcaataaaaattaagttgttatcagtttaaaatagcctgctaattttgtgtaagcctcatagtaaccacagagcaaaagcctatagtagatacacaaaacattttaaaaaggtccaaagcataccactacagaaagccatcaaactataaaggaagaatgcaacagaagaagaaaggatcaaaggatctaaaaaaaaaaaaagaaagaaagcaattaacaaaatgacacaagtatgaccaaagtccactgcttctttattactgatatagaatatctttcagatcttaagggactgattaattacttgggagagaaagtttgtgttgagaagatttgcttgtgttgcaatgagaaggggaagttctactcaacagaagctgtacaggcacatatgacaaaagctggtgtaagctttttacagatggtgatgctgctttggaatttgcagacttgtatgagtttaggagtagctacccagatcacaaggaaggggaggaccctaatgaggctgaggagtcgcccttaggaaaggacttagaatatgatgatgaaagcatggaactgattctgccttctgatgccagagtgggtcatcactccttgatgagatactacaaacagtgatttggcttgtcaagagctgtggtagttgctaaatattgtgaggccatgggccgagtgcttcagtaatagagagccctgggatagactggcaacacaggagcagctgttacatgaaagtgagacatgcattatatccaaaggatgaagtcaaaatggatgctgaagacagaaatgaagaacaatgccaccaagcagatgcactttagggtccaagtgagattctgagagtctgccaggattgagtgattgtctgctgcccaagtttcctccttgccctgaggaccagggaaagccagattgtatgatggacacttttgctgctacttcacttgctctaacataataataaaaatgaaaatctaaaaaatattttattgaagaatgaaggtgaaagaaatacattttcagacaagcataaacagagaaacttcaccattagcaaaagtccactaaaatattctaatgttatacttgagacaataaaaaagtgatacagaatggaaggcatgagagacaagatgggataaagagcaaacaaagttaaatatgtggataaatagagataagtatcataaaacatggtcaaatgttttatgagcgttaagatatatagaattgctttattcacagttggtttgctgtcataacacaagtatcatgaaaatcactgctaaatctaagccaaaattgggaaaggaaaaggttcatgtcactatcatcaacgttggacatgtagactcaggaaagttcaacactactggtcatctgatctataaatgtgatgtgatcaacaaaggaaccattgaaaaatttgagaaagaacctgctgagatgggaaagggctcatttgagtatgcttgggtcttggataactataaactgaacatgaatggaatatcaccattgatatctcctaaagaaacctgaggccaaaaatatcctgtgaccatcattgatgccccagcacacaggggctttattaaaaaaaaaaaaaaaaaaaaaaacatgattagagtgatatcaccaaaatggtggatagaagcaatctggcttcactctcctccagaaaaaccaaaaacaactattcagtgtctagcttatcaccaggaatatcccataactcaaaacagaggctgtgaggatctgagtggccacatagaagagaaaaactgcaagcagaagataacaaaaatgggcctgtttaactgcagcatccccttcccaagctgccaggcaccatgcagaaaagttcccccagactgacagtatgtacatcagaaaaagtgacatctagatgaagagccagctttcccaccatcttgggttcctttgcagaaaaatcattcctgcctcaatccgtgggaagcagcctgattgcctctagggtaaaaaaatcctgagggcagctagagacaaaggatggaggcggggctagcaaccccagcatgcaaaacacattggctgctcttcatctaagccaaagaagacaccaaatgagagagaatgttcagcccgtggttcctctggacacaaaatcctaaccagatgtctcacccaaccaggatatccagtttgggacctcccccaaatcgggaataggcagtaatccaagccgttgcaagagctgcagcaaatctgggcttacagcaccatctagtgccaaaaaagaggcagtaatctcagagtaaggaagctctaattcatacataacctttagacaggcatactcctgaaaaaccaaactaagccagacacaaagactggaataaataacttagcattcatacaaagacatagatatatgtgcataaaaaacaagagcaaatagggagctatgacctctccaaatggaaacagcatggagccagtgaccaaccctaatgagatggcaaattgtagctctcaaatcaataattcaaaataaaagttctgaggaaactcaaagaacacaaaaaagcaactgagaaatttatgagataaatttaacagagaaatcaaaataataatttaaaaaaccagaaatgctggagctgagaaatacaactgaacggaaaaaaaaaatgcactggaaagtctaaacagcggaactgatcaagcaaaacgaacaatcaatgagctcaaagacaggctatttgaaaatacacagtcaaaggacaaaaaataattaaaaggaatgaagaacacttgcaagatctagaggactgcctcagtagaacaaatctaagagtcatgggccttcaagagagaaagagcaatgaataaaaagctcaaagaaataacagaaaatatttccaaacctacagagagatgtaagtatccagttataggaaggctgaagatcaccaaacagattcaacccaaataagactaccccaaggcatacaataattaaactctcaaaggtcaaagacaaagaggggatcctaaaaagagcaagaaaaaagaagcaaataacatataaaggagctccagttcatccgggaatatactctggaccagatgaacctacctgacattttacagaacattttatccaactactacagaatatacattcttcttatcagcacatggaacattctccaggatagactatatattaggccagaaaacaagtctcaacatttaaaaaaataaaattatattaagtatcttttctgactacagtagaataaaactagaaatcaatgacaagaggaacgtttgaaactatacaaatacatggaaattaaacaacatgctcctgaacaaccaataagtcaatgaagaaattaagaaggaaatttattgaaacaaatgaaaatggaaacaacataccaaaatgaatgggatacaacaaaagcggtactaagagagaagtttatagctataaatgcctacatcaaaaaagaaagactcaaataaacctggtaatgatgtaactcaaggacatagaaaaacaagagcaaaccaaacccaaaattagtagaaggaaaataataataataatcatagaaataaataatattgagaaaaagaaaacaatatgaaagaccaatgaaatttttaaaatggctttttgaaagataaaatttaaaatctttagctagactaaggaaaaaaaatgagagaagacccaaataattgaaatcaaagatgaaaagagtcattaaaactgataacacaaaaatacaaagtttcactagaaactattatgatcaactatatgccaacaaactggaaaaactagaagaaatggataaatttctggacacatacaacttaccaagattgaactatgaggaaatagaaaacttgagcagaccaataactagtaatgagattgaagcagtagtaaaaagtctggcattaaataaaagtccaggacctgatgacttcactgctgaagaaaaacttacaccaattatactgaaactatttaatattgcaaaaaattgaagagaaaagaatgtttccaaactcattctacaagaccagcattatcccaatacccaaaccagacaaagacacaacaacagcaaaaagaaaactacaggccaacttcgctgatgaatatagatgcaaaaatcctcaacaaagtactagcaaactaaattcaacaacacattaaaatgagtatttgtcatgcccaagggggattcatcctaggaacacaaagatagttcaacatatggaaatcaataaatgtgatacaccacattaacagaaggaaagacaaaaaccatatatttatttcaataaatgtcaagaaagcattgaataaaattcaacatcccttcatgataaaaactctcaacaaatttggtttaaaggagcatacctcaaaacagtaaatgttatatatgacaagcccacagctaacattacaccaaatgggaaaaaattgaaagcctttcctctaagatctggaacaagacaagcatgcccactttcatcaattctattaaatgcagtcctggaagtccaagatggagcaattaagcaaagggccttcaaattagaaaaaaagaaatcaaattccccttgtttgtagacgatataatgttatatttagaaaaacctaaacactccaccaaaaaactgttagaactgatcaacaaattcagtagagttgcaagaagcaaaaccaacatacaaaaatcagtagcatttctatataccaagagctaacaatccgagagagaaatcataaaagcattttcattttcaatagctataataaaaataaatatctaggaacaaatttaaccaaagaggtgaaagatctctatactgacaactgtaaaaccctgatgaaaggaattgaagaagacacacaaaaaatgaaaaggtatctatcccatgttcatagaatggaagaattcatattgttaaaatatcaatactactagatttcatgtattacctatcaaaataccaataacatttttcacagaaatagaaaaagcagtcttaaaatttgtacagaaccacaaaagacccagatatggtttggctgtgtccccacccaaatctcatcttgaattgtagttcccataatccccacatgtcgtgggagggacccagtgggaagtgattgggtcatgggggcagttttcccccatgctgttctcgtgatagtgagtgagttctcatgaaatctgatggttttctaagtgtttggcatttcccctgctggcacttattcccactgccaccttgtgaagaagatgccttgcttcccctacgccttccaccatgattgcaagtttcctgagacctccccagcaatgcggaactgtgagtcaattatacctctttcctttatagattacccagtctccagcagttctttatagcagtatgagaacagactaatacagtaaattggtaccgaggtagggggggcactgctataaggatacctgaaaatgtggaagcaactttggaactgtgtaacaggcagaggatggaacagtttggagggctcagaagaagacaggaaaatgtggcaatgtttggaacttcctagagacctggagggctcagaagaagacaggaaaatctgggaaagtttggaacttcctagagaatcattgaatagctttcaccaaaatgctgatagtgatatggacaatgaagttcagactgaggtggtatcagatggagatgacgaacttgttaggaataggaataaaggtggctcttgctatgctttagcaaagagattggcagcattttgcccctgccctagagatctgtggaactttgaacttgagagagatgatttggggtatctggcagaagaaatttctaagcaacaaagcattccagagtgacagagcataaaagtttgaaaagtttgcagcctgatgatgcagtagaaaagacaaacccattttctggggagaaattcaacccagctacagaaatttatataattaacaaggagccaaatgttaatcaccaagataatggggaaaatgtgtccagggcatgttagagaccttcgcagcagcccctcccatcacaggcctggaggcctaggagggaaaaatgctttcgtggcctgggtccagggctcccctgcagtgttcagcctgggacttggtgccctgtgtcccagccactccagctataagaggccaaagtacagcttgggctatagcttcagagggtgcaagcccccagcctttgttctgtgggtgcacagaagacaaaaattgaggtttgggaatgtccacctagatttcagaggatgtatggaaatgcctggatgtccaggcggaggtgtgctgcagaggcagagccctcgtggagaacctctgctagggcagtgaggaaaagaaatgtggggtgggagcccccacacagtcaccactggggcactgcctagtggagctgtgagaagagggccactgtcctccagaccccagaatggtagatccactgagagcttgcaccgtgggcctggaaaagccacaggcactcaatgccagcccatgaaagcagccaggagcagggctgtaccctgcaaagctatgggggtggagcttcccaaggctgtgggagcctgccttttgtatcagggtgacctaaatgtgagacacggagtcaaaggagaacattttggaactttcaggtttaatgactgccctattggatttcagacttgcatggggcctgtagcccctttgttttggccaatttctcccatttggaatgagtgtatttacccaatgcctgtacccctattgtatctaggaaggaactaacttgcttttgattttacaggctcataaacagaagggattttccttgtctcagatgagactttggacttggacttttgggttaaggctggaatgagctaacactttgggggactgttggaaaggcatgattctgtttttaaatgtgaggacatgagatttgggaggggccatgggtggaaacatatggtttggctctgtgtccccacccaaatctcatcttgaattgtagtatattgtttgtaaaaattcctgcctatccagagattttttaaaaaaaaacaatactttcttcaattttctcttacaatttaattttttacatttaactttttaatacttcctgtagactaaaagttattttggtgcattgtgtgaaccaaagatcaaagtagttttatttttttctgaaaacatctattcattttttcaattaattgattgtttatattaaggatctaggaggatctaaaattatggaattgtgggcaagggcaatttttgccttacatttcatgtaaggcaaaataatccccatgtgtcatgggagggacccagtaggaagtgattggatcatgggggcaggttcccccatgctgttctcatgacagtgagtaagttttcatgagatctgatggttttataagcatctggcatttccccttctgtcacctctccctcctgccaccttgtgaaaaaggtgccttgcttccccttcaccttccaccatgattgtaagtttcctgaggcctctccagccatgtggaactgtaagtcaattaaacctctttcctttataaattatgcagtctcaggcagttctttataccagcaggaaaacagactaatacagaccctaaatatccaaagcagtcctgagcaaagagaacaaagctggaggcatgatgctactttatttcaaactatactacaaagctgtagtaaccaaaacagcatggtactggcataaagacagaaacatatgccagtggaacacaacagagaacccagaaatgaatccacacatttagagccaactcatttttgacaaagtgccaagaatatgcattggtgaaagaatagtctcttcaataaatgatgttgggaaaactggatatccacatgcagaagaattaaactaaacccctatctctcactgtatacaaaaattaaatcaaaatggattagagacttaaatatacaacctgaaagtatgaagctactggaagaaaacattggggaaatgctccaggacattggtctgggaaatattttatggcctgggaaatatcaaaagcacagacaactaaagcaaaagtagacaaacgggattatatcaagctataaagcttccgcacaacaaaggaatcaattaacaaagtgaagggacaacctacaggatgggatgaaatatttgcaaactatacaactgagagggtattaataaccagaatatataaggaactcaaacaagtcaatggcaaaaaagcaaaggatcctattaaaaatgaacaaagatctgaataaacatttctcaaaagaaaacatacaaatggccaacaggtatatgaaaaactgctcaacatcactaattaccagataaatgcaaaccaaaagcacaatggatatttcactccagttaaatgacttttatcaaaaagacaaaaaataatgaatgctgatgaggatgtggcaaaaggggaatgcttgtacactattggtgggagtgtgaattagtacagatactatggaaaagagtatgtatgttcctcaagaaactaaaaatagaacgaccatgtgatccagcaatcccactgctggatatatatccaaagacaggaaatcagtgtatcaaagagatagttgcacaccaacatttattacagcaccattcacaatagctaggatataaaatcaacctaagtatacatcaacagatgaatggataaagactgtgtggtatatatacacaatagactattactcagccattaaaaagaatgaaatcctgtcatttgtggcaacatcgatgagcctggatgtcactgtgttaagtgaaataagccaggcatagaaagacaaatatcacgttttcacttacatgtgagagcttaaaaagtggatctcacggagatagagagtagaatggtgcttaaaggagtttgggaatggtatgggggggtgggatggaatgaagagaggttgattaataggtgtaaaatgaaggggtggcctgcccctcgtcacccacagtgacgagaaacactgtgggtgtttctcgtcaggtgggacgagagactgagaaaagaaataagacacagagacaaagcacaggaaagaaaagtgggcccaggggaccggcgctcagcatacggaggacccgcgccggcactggtctctcagttccctcagtatttattgatcattatctctaccatctcggagagggggatgtggcagaacaatagggtaatagtggagagagggtcagcaggaaaacatgtgaacaaaggtctctgtgtcataaataagtttaaggaaatgtgctgtgccctgatgtgcacgtatacaaacatcttggtgcattaaagagcagtattgccactagcctgtctcacctccagccttaaggcggttttctcttttctcagtaaatagaacatacaatcgggttttacaccgagacactccattgcccagggacgagcaggagacagatgccttcctcttatctcaactgcaaagaggacttcctctttcactaatcctcctcagcacagaccctttacgggtgtcgggctgggggacggtcaggtctttcccttcccacgaggccatatctcaggctatcacatggggagaaaccttggacaatacctggctttccagggcagaggtccctgcggccttccgcagtgtattgtgtccctgggtacttgagattagagaatggtgatgactttttttattattattattatactttaagttctagggtacatgtgcacaacgtgcaggtttgttacacgtgtatacatgcaccatgttggtgtgctgcacccactaactcgtcatttacattaggtatatctcccaatgctatccctccccccaccccatgacaggccccggtgtgtgatgttccccctcctgtgtccaagtgttctcattgttcaattcccacctatgactaagaacatgcggtgtttggttttttgtccttgtgatagtttgctgagaatgatggtttccagattcatccatgtccctgcaaaggacatgaactcatccttttttatggctgcatagtattccatggacaagcatactgccttcaagcacttttttaacaaagcacatcctgcatagccctaaatccattaaaccttgactcaacaccgcacatgtctctgcgagcacagggttggggctagggttacagattaacagcatctcaaggcagaagaatttttcttagtacagaccaaaatggagtctcttatgtctacttctttctacatagacacagtaacagtctgatctctctttcttttccccacagtaaaattacacttaaatagaagggataagttgtagtgttcgatattacagtagggtgactatagttaacaatgatttattgtatgtttcaaaatagctagaagagaagactgggaatgttcccaacacaaataaatgacaaatggttgaagtgattgatattccaattaccatcatttgattattacacattgtattcatgtatcaaaatatcacatgtatccccaaaacatgtacaattatcgtgtatcaatttaaaaatacatcatgataggcacctctcaggttgactgtactgtcctgattattgctagtggtgttaacaaatttgaagctagtatctttaagaacgggcagacccatgagcatgcccttctggtttacacactggaagtgaaacaactaattgttggtgttaaaaaatggatttcactgaactatgccatcgccaacagagctatgtggaaatcaataaggaagtcagccctacattaagaatactggctacaaccgcaacacagtagtatttatgccaatttctggttggaatgctgacaacttgctaacatgccttggttaaagggtggagagtcacctgcagagatggcaataccagtgtagcacaccgcttgaagctctggattatatcataccaccagctcatccaactgacaaggcttgtgcctacctctccaggaagtctacaaaattggtagtattggtaatgtctttgtgggcctagtggtgactggtgccctcaaacccagcatgattggtcagctttgctccagttaacattacaactgaaataaagtcttttgaattgcaccatgaagctttaaatgaagctcttcttggggacaatgtgggcttcagtgtcaagaatgtgtctgtcaaagatgtttatcatggcaatatggcttgtgacagcgaaaatgactcgccaacggaagcagctggcttcctgaaccatccagcccaaatcagtgctggctctccacctctgttggattgtcacacagctcacattgcttgcaggtttgctgagctgaaggtggttgatttccttctggttagaagctggaagatgacccccattgtgatttttattgctatggtttctttctaatttagtcttgaggtctctcccttgagaatggtcataagccaagagagccactttctaggagagtcctgaccagggggaaagttaagtttgagtgtgtcagcttggtgagacacaatgaggaagtaaaaacaaaataaatagtggaatagaatactaacaagtacctagaaataagtctagctaaaaatttgcaaaatgtctatggaaaaaaaaactatggaaatttactgagaaactttaaagagtacctaaataactttcaagatataccacgtacatgaattggaaaacatgatatttgaaaatgtcggttattcccaaactgatttatagattcagtgcaacctgaatgaaaatcccaagacgttccttttgtagagctcaacaagctgattctaaaattaatatgaaaatgtaaaggtttatgaatagccaagtccttcttgaagaggaagaataagatgagagtaattgctgtctaatatattgagacttattttaaagctataataattaaaacaatgtagcagttggtatagggataatcaaacaggtaaatgaaatagaatagaaaatccaaaactagtctaacacatatagaaacttgatttatgacaaaggtgtcacagaagtagagtttcaataaaatgctggaaaatgttggtatctatatagataaaacattacattggattcctaactcacaccatacacaaaaatccattcacattgcattacaagtctaaaagtgaaatataaaatcataaacattttagaaagaaaatgtaaaagaatatatcaataaccacagggtagggaaagaaagagaattgacatcaagatacaaaaagccctagccaataaggtttttttttataaattccacacattaaaattacaaacttatgctcatcaaaagataacataaaaacaatgaaaagattagccacggaatggtaaatgtttgcaatacataacacaaaggacacacaaaggaaacttatataatagattttaacaggcttctctgtgtccttcttctccagcaatcaaggaatatataaaaaagcatatcaaggatatatagggtactcttttgattcaacaagaaaaaagcagattatccaagagaaaacttggcagaaaaaagcttggataggtgctccacaaaagaggacatccaaatgactgctactcataagaaaagatgctcaacctcatagaacatccaaaaatgtaaaaacacagtcaataccagatatttgtaataatttggagcaaatggaactctcatacattgctaatgaaaatggaaaatggtccagctgctttggaaaacagtgtggcaatacctaccaaagccaaacacatgcatacctagtaattccgcccaacagaaatgcacatatatgttcaccaaaagatatgcaccagaaggttatagcaggtccatatgaaagtgccaaagattataacaactcaaatgtccgtgattagggtatattcatataatactatacaacaatgggaatgaacaaactatagctacatatgataatatagatgaatctcacaaccagaatgctaagtgaaagaagaaacaaaagaatatatgtagtatgttttatttacacacttcaaaacaggcaaaactaaactatatttttaaaggatgtatacgtaactggtaaaattataaagaaaagcaaagaaatgattatcataaagatcagaatggtggttaccttcagtgggaagggagaaagtatgattgaaaagggacatccagtgagtcttgtgggttgttggcaatgttactgatctgggtgatgattgcatttatgtaccaaaggcatttgtgttttatgcactttattgtatatgttttagttcacaatttttttagttcacaattttaatagggctttaaaaagtaaaaagaaaagagatccaagggcttgaccatgggactctcttatatttggagtatgtttataaactttacattcattcaacattcgacaaatattttttgagcacctactttgtgccaagcaccgttacaggtgctgggaatacaacagggaacaaaacagacaaaaccccagctttcatggaacttacatgctaataaagcttggcaagagtatttcaaggaagatgaagtggttaactatgcaaaatgcttctcaggcacctaggaaaatgaggatgtgaggcatttctacccacttggtacataaaattattgcttttcctctgctttttttctccagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtgagttaaggacagtggaattacaagaaaattaattttatatatttattttcttgctgactataatgtattcccacttttggaaatttttaaagtatagaaaaataattccataattatctttgtgtacgttctatttttcctatgtatttttctccttatgtattcaaattataccatgcagaattctgattcttgtttttttactaaatatcacatcataaacatttcttacgtcattaaaaacacttcctatgtatgtttttaaaatactgcataatagtctattatatgaatttatggaaccatagtttatgtaaccatttattttgaacaagcttttagacagtttcttttttcactatataaataacgctgtaatcacaacagtttttctaagataaaattccagaagtgcaatgtatttgagcatcttaagagtttttcttattaattatttggtaatgtcccttgcacatttgtctttcatggaggaagtgcttttcttattgattatgttaccttatatattagatagtaaaccactgaacattttaatgagaggtactttttcaagtttttgttttctcttaattttataaatgatggtttttgaaataaaacaggttttaatttttaggtagtaacccatcaatctttactttttgacactttcattgcttttatgtttataaaaattcctgcctatccagagattttttaaaaaacacctatactttcctcagtttttctcttacagtttaattttttacatttaactttttaatacttcctgtagactaaaagttattttggtgcattgtgtgaaccaaagatcaaagtagttttatttttttctgaaaatatctattcgttgtttcaattaattgatggtgtatattaaggatgtagaaggatctaaaattatggaattgtgggcaatttttgccttacattttattttactttccattatattctatgataaatatgtataatttttaatctggaaagtaagccttttttaaaagataatatgcattcattctagaatttgtcatgaagaaccttaacttacatatcaactcctggcgttatggtctcttataacccctgcagtaacattttcccttttactctggaatggcttttatgtgtttaggaattttctcctttgcaactttgagttcataccttaaatttagaatacaaaacctcctcaggattaggtttgagttctaacagcatccatcttctgtaccacttcttccagggtattaaaaactttgataaagaccaaaagacaggtatttcttttagggatgtaaaccctaaggaccttaagatcctagaagattattcttgcttttttttttttgtcgttattgttctacaggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggtaagcaggtgtctattgtgctgaccactttttggtttaaaagaaatggtctttgtgtactaagaattttgatatttatcctacgtgcaataagaagctttaaataggagagttgatcattatatttgtgttttagaaatgtcattctggaatctactgaagaggatggattatatttttggaaggtgggaggcaggttggactggcataaaaattgatgagaaatccactctggttcataggtgagagagcttatactcataggattgatgtcttccctccctaggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatggtaatatattccacatccaaacattatcactgtgaaatgcagattgcactttgacaaatgagacttgatccagggacttgaacattgtatttatttagagtatatctgtgggagtggaatcctcatagatgtcagtttttttggtggagtggagagaaagaaacttatataatagattttaacaggcttctctgtgtccttctccagcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtatgagcttgtttgtgctctttcttctacctactctatttgttgagtacttactttaaatggtctaggcactgggaacacaatcagtgatcaaagcagacaagctccatgctcttaagtaatactttttcaaatgctttttaaaccatttgttcaaagcaaatgaacaagataatttcagatatagaaaaattgctaaaaaggaaatagaacagaataaatggataattaatgtcacagtactttcctagggaaaaggaatttattcctttatcatttaccatctcaaatcccatagggcaccagtagtcatccaaagagtcatttgtttatgtatgtaaccagtatattgattaagcactactcataatgttgatcacaacacaattttattttggttcttcactgtccctttaaaatagatttggccaggtgcgatggctcacacttgtaatcccagcactttgggaggccaaggttggaggattgcttgaggccaggagttcaagaccagcctgggtgacaaagcaagacccccatctctacaaaaaataattagccagacatgtggtatatacctgtagtcccagctacttcacctacttgggtggctgaagtggaaggattgcttgagcccaggaggttgatgctgcagtgagctatgaaagtgccactgcactcaaacttggacaacagagcaagaccctgtctctaaaaaaaaaaaaccatccagtttaatagcgggggtaaactttccttatttcttcgtaaaaattctgataagccctgtaacttttctgctcacccttaagtaataaacaggactaaagtcactttatgtcacaaatacagttcaaatcagaaattacaatgtccatcccaagatattaatcaaaattgtaaacttgatttaacttcaatctcccctcctccaacttgagcctgcatcaggctggaagtctgcattggaaaagggagacatggttgagtcctctgtttctgtaccttgtgatgatcgtgcttccccacaacccctttatagctgctgttttgaactccaacatggataggttaaaggtaaggggataagatagttcttacctatttacagctggcaccattgttgtaaactagcttaacactgtttgtgcctggcaatacttgttgactctttctcctgcagggcactttcagggaactctttagagactcccttacgtgactgtcatgaaatccccttgacatgatttcttccacctttactctgggtggtcacttgtgactcatttctcagccctcagtgttcacctgcagcttcttgttgctggggtaactttacccttgtaggcagctctagtggactggatccagagggaactcaccctgacttatctgtttcacagagtccacatctggccaatgggaaacacaccttttgctcagaaagaccctgggaatgtaggtcaatcataatgcagtagcattctcctgtcccaaccatcaaagaattcagtcaccctgtttctcatctcctggggggaggggagtggtcagaactcaatctccacaacccccaactgtaagggtcacgtagcaagcactttgcatttgaggggtccaaaagtagtggaactaccaaatttggtaggtctactctgatatttcgcataaaccaatgtatctcatgctcattttttagtgaaaagaaataatttctgttcctgttggtttttataaggtgtttttgagacagtggaaatgttaccatccaaagctggaatttggcgggtggaatgccttattggcgagcatctacatgctgggatgagcacactttttctggtgtacagcaatagtgagtagcaatgtgggcagaggttccctacctactcagcctacttctttacagctttcttcctttctggaatggttgcttgtgtcaggaaataaatacaagtttacatcattatcaaatttaaaatgaatattgctggtagaaatcatcagagttctcagagtagggcagatatacttgaagctttgaacactttgtacctgaagctctaaataattgacaaaaaaaaaataccacctcattttcacaacttggtaaagctcgaagatctccagtagcagattttggaatttaatgttgatttagttaccagataacttagaaatactacttggaagagtttggagatttaaccctaaacaagtaagagagccactggtctatttatgtacggaccccagtttcttcagctgtaaaatgtgaatcattctagcacctgttaggattaattaaatgaactaatacagtaaaacgttgagtacagttcttggcacatttaaacactaaaaaatagcatttgttgacgttctcccattttcattgacttacatttgagaagctgaattttgtgcacttctagttactgtgttccacccgtttcatttcagagtgtcagactcccctgggaatggcttctggacacattagagattttcagattacagcttcaggacaatatggtaaatactattatttttgctccaagaacctgggctgattatatctttttttaataatctggtggagaatctcagataatgaatccatctccatgcttctattagttctattccataagtgcctctcaaatacatctcctcctctccacttcccactgtggccatcttaactcaggtcaccatcatttcttacctgggcaatgacactgcctccttaaatatcctccctaccttcagtatttcttccttgagtcaattcttttcagtgcagcaggaagctatactttcctatgagcagtaatggtaaagtttgactagggtctatagagaattctcagaaattgttttagagcactactgcccacaggctaaatgcagcacactgcctgtttttgtatggcatgtgagctatgaacagattttccatttttaaataattgtcaaaaagatgaagactatttcatgacatgtgaaattataaaattcaaatttcagcatccgtaataaagccttattttggaacacagccacgtccattaatttacatatcatctatggctacagcagcagtaacatagttgcaacagagaccatataatatgcaaagcctaaatgatttactatctggccctttacagaaaaagtttgccaacctatgttgttgtgaggtaaaaaaaaatcctcttgaaaaggaggcgtgagagttttacaccaaaatagtaacatttttcactaggtggaagggttacattttaaaatgtcttttatttgtatttttactaatttttacttttcattttctgatttttctacaatgaacatacattgcgtaataaataataggcggggcacgttggctcatgcctcccagcactttgcaaggctgaggcaagcagatcacctgaggtcaggagttcaagaccagcctggccaacatggtgaaactccgtctctactaaaaatacaaaaattagtcgggcatggtggtacgcgattgtagtcccagctacctaggagactgaggcaggagaattgcttgaactcaggaggtggaggttgcagtgagccaagatcatgccattgcactccagcctgggtgacaaagcaagactccatctcaaaaaaagaaagaaaagaagaaataatattattatttggtagtgttggtaacaaattgcagtatcagctagttagaggtgctaacaattaacaaaattataaattttagaaaataaaatggacaacaaggataagcaatatccttagatagtaattgatactggtatgccataaagcctttatgtttttctctattttcaccacagcttagattaacctttctcaagacaataattttattctcaagtgtctaggactaacccagctgaatttaatctctgtttctttacttgggcaaaggacagtgggccccaaagctggccagacttcattattccggatcaatcaatgcctggagcaccaaggagcccttttcttggatcaaggttagaaaatgtaatcaatgatgggaaatgtatcacattcaatcaattgcattacttattcctcttgcaagctcaaaggattctatgaatatgagaaaactaaagaacagaatgccttaatgatttgtacaaaagcagtcatgaacaaagagatatggggatagaattgagtatattgatatgtcctgtttctgtattttagtccttctactgggattagaacatctgaatattttctataatattgaactcgtcatctctcaagacagtatatgttattattagatgcttccaactgcccacgtgtccttaagtactccaatcccctttattttaacataaaacaaatggttcacaaatgcaaaccacatgtgtacttttacattttctgtagccacgttttcaaaaatgtgaaattcactttaataatacattttatttaactcaacatatctgaaaatactatcatttcaacatatgatcaatgaggccccttcaaagacagacagatggaaactcttgggtctcttccatgcctcacaaaagctgagggcagcttggaagtgcctgctcagcctctccacctaaacataaggctagatgccttctagaagcccaaacaggaaatggagaaaacattttggtttccatctttgcaaatagcatgtctattaatgccacagcattgttttgtagacactgccaattttgactcaatctgagctgctgttcactaatccctaagtattttttgttggtttgtgcttctgccaaacaacatgttatgttcttcaccttgtatttctatggttattttcaaccttaagtgtatccctatatagagaacatgtttatctatttggccaccctgtgtctgtctgtgctatttaattttttgtaataacattcttatttgggagggcggaattatatcttcctcactagatacaacctgataagactagtaaatagagtgtcctgtctgtgcctagccaatgaaccctgaatgatatactctgttgtttccacttactagatttggcccattgtttcagcttgccgatcttcagtgtcccaaagtatttcctagtttttccagttactgatttgatcagtaaactttctaatactgcagcaaagtcatgatcaaaatattgaagtagacaagacttccttagtatgtgcacaatacaaatcaagctgttaagtccttactacaaccttgtgaggtagatgttactatcatcttcatttcagataatgaaattgaagcatagagaggttattgtggcccaagtcacatggctaataagtgactgagccaaaattcaaattctgatagttgggctccagaaccctaactggtaatcgttgtactacactgtttccggaatgctccctttaagttgataaccatctattaactgtcactgttcacttgtggtaattaaaccagttacaaatccacctagttatgttatcatctaccactattgaatcgccttatcttcaaggtggttttgccatctgtcctactaaggtccagctagactttttatagatctcgtaactttataaaataaaccatggagatggagttgaaagggggtgctgacaaggaagggagttggagaaggcatctattctcgtgagaaggcctgaagagtgcacaacagcctggccccaagacacaagagcactgggctggcttgaggagcaccaggtgaccaagaccaggcaatgcacagggggaagtcagcaggccccatggagatacgcagctgcagtgtttgtacttttatacagtgaaactcattaccaccttgcttacttcctagtagagagatgtgtcttgtagttacactgaaacacctggctgggcacataggtgaagctgttgagtctgtaattgtcaaactgctcccaggtgccaattataatgtagaagaggcacaagaagatgaagtggataagcctggcagtttgtcaagcattcatcagttgtcaagcatttgtcagttgcagaatgtaggtaggctgccaaggctttattgtagcctggttctattgcagctttattctagcaaggctgctggaaaatacaataatcactggtccaagaaagaactcttatactctatctatatgaagaaacagtaaaagtcaattcagtagaaatcatgatttttgtgcctggtgctttcacttttttatgccacaataccaagaggttaaaatgaagtgtctttgattgggaataccatctatctgggaaaagacagggctgcaacttctgaagaccttgacactctgtcctgttaccctgcttcatttttctcctgcgcttatcactacttgatgctataaacaaataaaaacatatatgatataaggtctatttctcctactcaactgtaagttccatgagggcagggctttctttcttgtttactactctattccctgtatctaaaacagtgcttggcacatagcaagtgctaaaaaatattctttgaatgagtgtatgaatggaacttacagtcagctgaaggagacagttattaagcataagagtgatgaccagtccaattgtgtgtgtcaggcatgtgtgaaaacgtgctaaatttgacttgcttattaggacagtaactgatacttctaatgttcttgcagcccatgacctcttctttaagaagtgtccattctgtactactttcccattattcactcattcattccaaagcatttgctatacagcagtattataccagataccatattaggtgctggggctagagagaatataaaagctaacattgattgagtgtttagtatgcgccaggccctgaactcagcacattacatgtattaactctttaacccctatggcagccctttgagataaaaactaatattatcttcactttacagataagttgagacacagaaagttaggtgactcaaatgggttcactgccttaaggatctcagtctaataaggaaagcagaaaagcaaagcaaccttataatatggtgcaataatttgctataatgaagttatatacaaagtgaagtagaagcatagaagaagcagcactaaatttgtctgggtgagtcagagaaggctaaccaggaaaaatagtttctgaactaacacttgaaggaggtgtagcagttcatcactgacagtgatgttggggtgggtctggtttcaggagaggggaggaaattggctttggtctgaggctgaggtgtgggcaaagcattagcttatgtgggtccattagcttatgtgagtccacaaaaggtgtgtgtgtgtttgtgtgtatgtgtgtgtgtgtgtgtgtgtgtgtgtgtgtacgaaatgggggctcaatgatttggtagtggtttggtttgtcaagaagcaggctgggaactcaataagcatctttccattcatttctactgtgtatcccacagcttcacacacacatgcacatttcaacattggtgactgcttcacttgcacacctaaggtaatgatggacacacctgtagcaatgtagattcttcctaagctaataattagtttcaggaggtagcacatacatttaaaaataggttaaaataaagtgttattttaattggtaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtatgtaattagtcatttaaagggaatgcctgaatactttaaagaattttggcagatttcagatattggacaaacactcttagcttccacaaacttaattccaaaaaataatttttcacttatgagcaatagagttattacggacatatcagcaaaaatgtagtagtgtcaaggctcatagatgatagaaatgaagagatgctgtattgatagaaatatgtgattcaggactgtgtggattgatgattgtgagcttgcttatggatatcctaggtttgaggttatagtaggacaatcaggttgaaatgtccagcaggcagtaggtgaaagacaagtttagggggcaaaaccatggatggagatgaagattcatgacttccacataaaaggatgggtgaaactttgggaattgatgaattctctagaggtgagctcaagacccttaaaggcttaaaacctcagcgttattgtctactcttccctcatttttatgcccacaaatctggtcaatcctttatttgcaatgcctctcacatctctttcttctgtttccatttataccgctgttgccacagcccagggtcccatcacctcacacttgatctattgtattacattcctaactagtcttcccccgtttctaatctgttctccgataaaagctgcacatcattttcaggataatcatcagtcgcctgcctaaaacttttcaatgtcttcccattgtctttagaataaagttcaaagtcttcaaatgaccccaagcaagataacttttgtttgcccctttagatccattttcctgcttctctaccctgcttcttgttctgtgaggtgagcttgtatagaatacatcaacaggttaccttgtcctccagcttttggttggatttcaccaacagggagcactggcaaaagattggcatatttattcttctgactttctccttgcagaggagttcactgtatctccccacttaaggtcactgtttccctcagagtggctttttctacctgtactagctactattgctgtgtaccaagccacttcaaaacttgctgtcataacaataaccattatgttttgctcacagattctgtagatcaagactgggacacagtggggatgggtggtttctggagcctcagttaggattatttaacagctgggtgctggaatcatctggaagttccttctcttgcttttctggtggttggtactgactgtcagctaggacagaatctggggttgttgactgatgtaactttacatggattatccctgaggcctggccttccttacagcatgtttcaaggtagttggacttctttttgagggggggtaggaaggtggggggaggacagagtctcactctgttgcccaggctggagtgcactggtgtgatctcggctcactgcaacctctgcctcccgggctcaagtgattctcctgcctcagcctgctgagtagctgggactacgggctcatgccaccacacccagctaatttttgtatttttagtagagacagggttttgccatgttgaccaggctggtcttgaactcctgacctcaggtgatccgcccacctcagcctcccaaagtgctgggattacaggcacccggcctgtagttggacttcttacacgtcattttagggcctccaagtgtgagtgttacagttaacaaggtgaagactacataaccttttctgaccgagtcttctaagttatgtagcatcacttttgttgacaaaaagtgttgaactctataaaatatttgaagagatttattctgagccaaatatgagtgagtatggcccatgacacagccctcaggaggtcctgagaacatgtgcccaagatggtcagggcacagcttggttttatacattttagagaggcttgagacatcaatcaaatacatttaagaaatacactgatttggtccagaaaggcgggacaactcaacctgggggcttccgggctataggtgaatttaaacattttctggttgacaattggttgagtttgtctgaagacctgggattgatagaaagggaatgttcaggttaagataaacattgtggagaccaaagttcttttgaagtcttatagtggctccccttagagacaatagatgacaaatgttttgtattcagatcttagttaatctctttaggattgggaggggctgggagaaaaagatctagctatgttaatagagattctttacagttgcaaatttccctccacaaagaacagctttgcagggccatttcaaaatatggcaaaaaaacatgttttggggtaaaatattttgattttcttccttgtctcataatgttatgccagagtaaggttggaaagtaaatcatgacatataaggttaaataaaacccatctgatgagaatttatgatttgtagggcatgactccccagaccccttagataggaatttgggcaagataaaaaaaaatcagagtttagtcctcactttcaatacattctattggttataagcaaatcgcatatccacccagattcaaggggaagagacatagaccctaatttttaatgggagaaatgttaaataattggtggtcattttttaaagccactacaataatctatccaattctctctttcaggatgtttctctcttctgatcctttcaggtttagggattgtcaacaaacaaaaagttaaaccctgtaaaatacttgaagagatttattatgagccaaatatgagagaccaatggcctgtgacacagccctcaggagatcctgagaacatgtgctcaaggtggtctggctacaacttggttttacgcattttagggagacataagaccgaaatcaatagatggaagatgtacattcattgagtttggaaaggcaggacaactggaagcgaggcggggcttccaggtcgtaggtagattcaaagattttctgattggcaattggttgaaagagttaagttattgtgtaaagacttagaatcaatagagaggaacatcggggttaagataaggggttgtgaagaccaaggttctgtcatgcagatgaagcctccaggtagcaggcttcagagagaatagattgtaaatgtttcttatcagacttaaagagtctgttctatcagtctgaaggtctgtgttgatgttaatgctggtcagatttttctgaattccaaaagggaggcgggtataataaggcatatttgatccccactttcccatcatggcctgaacgtttttcaggttaactttggaaggccctttgccgaaaggaggggggattagaattttattttgggtttacaggatggtaatactctgttcccaccctcctaactagtatctttattaaaccttccacaaattatcctaatttccatgttttctgttccttgctggatcccttgtttcatacagtaattggtgctagaagaaaccccaggaaacagattttcaaaatgcaattctaaggttatgttgctaatatattcaagaaacacagagataacatatttgccaaggaagaaaatgagcagttagggaatccatgacatgtgttagtattatagtttctcagattatcaccagtgatactatgggatgagttgcagatggcaagtaagacactggggagattaaatgacagtggcatttagtcactgtggcaacaaacgtagcattacctgattgtagagtggtctgtcttcttacagccctagagggcatacacatggaaaaagaaatgaaatgttatgaatatatacaaaataagaacactgatgaacatacatggaaaatcaggatgcatgcatagagcttttgaggaatactccgtatcctgtggttgtaggcagatacgacttaggggctgagcataagttgcagagctgcagtgacaattaaatgcttaactccaccagatctattatgctgtggtaagagtaccggtgggaaggagtgaaactctgaggcctgagatggaggcatttaggcagacatggatgaggctgagaattgcaaacctccaaattcccctgaacctcctttgcctgaggaggcaaccactccccagtctctgaagcagtcatccctcttttgtgtaaaagcctttcagtggctataactgagataggtgcctcacaaaccagtgactattctccttagagaccctgtttggacactacgaaagccaggcgagtcacagaaaatgacagcagatcacaaatttaatcaggtggtgatgccaaaaaacaattgcaattccagatatcatatctctgttgaagcaaatttacacagccccaggcacctgatatggaagtattgacctagagaatgttttttcttcatttccatacattagtaaaatcagaatacatttgaatttaccaagtaggaacaagagtattaagtttactgcccatgcatcagggcaatgttagctctcttgttttctatcataatatagactcaagggacctcaaacatctttacatcccacaagcacaatgcctgtccattacactgatgacattatgctgacaggatctggtaaacacataacaaataagcctgtcttgctcttgactttaatgagaatgtaacctgtgtttcactgtttaatataatgttcactgttagtttcaaatactttttatgatgtttaaaaagttttctcctatccctattttatttgcaatggcaactgaattttatcaaatgcttttccagcatctttgacatggtcacatttctcttttgtgttgtcaaattatacttaacattcaatagtgtgctgacaagaaattaacaacccacaggggagcaaagtgagaagaggttaagaagtaaaggccttgatttatagcattggcagatttccctgacataaatactactcccatcatgcctggccccagggatgggaagagatgcttacttacaattggctctcacagaccagtgcaagagcactactgtgctccatttctgggaaaactttcgtcagtcatagtgtgttagttatttaaaacttagctggatccaatttgccaacatttcatttataatttctatatctatattcatgaatgaaatgggtttagctttttcagtagctctacttaccaggttttggcatgagggttatattaaacttgaaaataaagtgggaaagcttccatttttttccatgaagactattgctctagaatagcttatttaatgtaggaatccagtatttaatgagagtaaatgaaaaagccatatgagccatgtgctttatttagtgagagatactaggctatattttccaatcgttatatgattattgctattctcatttgtgttgccttgagttaatgtctgcaaatgtgcacattagagtcatatatcccttcctgtgccatacatctatatctgtatacacacatatgtcttttctccttttttcccttctgtatcaagagttggcaagtgtttgtctattctattaatttttcaaagaatcagctcagttttaaacccaaacgtggttttgaaagagctgtttctagttcatcaatctctgttcaaaactttaaaaattctattttcctttcttttggtttgtttcctacaatctggaggtgaatgcttagttcacttattcttcaatctttgtattttaacgataaggataaattacttacagttattaactactctcatgaggttcattccttgaacagtcactgagcaactactatgtcctgggttctaattcaggggtgggcaaactatagccccagaatttggcccatagcctgcttttgtacggactgtgagttaagaatagtttttacacgttgaaaggattgcaaagacaaacatacaaagaaacaaagaagactgtgcaacagagaccacctgtggtctgtaaagactaacacatttctatcccgcccttgacagaaagagtctgtgggctgctggtctcctctaacggtggtagagatgcctgcacggttaacattaatccttggcaccagaatcctcagcacctaggaaccagatcttgcctaacacgctaatttcagtcttgaccaccttcctccggcgtagcggttctcaaacgtctttgtctttgtactattcacgtataaaatattctttcataagcaacatttatccttttgggaatacctcacaatggggagaaggggaaccccaacagcctttaagggttcactgcttcgctgccaccatttccgacggtttacactgttttaagtgtgaatttggaattgttttcaagttaaaaagcaaactaatcatgtcctctgaaagtatttgcttttggcatgctagaaatcagtgttgacttttgatactgatgtgatacattacgagggaattctcaaaactgctgaaatctggcctcggcccagttatcactgctcttaagcttctgagggagatacatgaatgagcccacggcaaatggaaaacgaggagttttagtgtttcctagaattatgctcagatacccactacctgaccgtctggttatccttcccctcacctccctgacgcaaggagtttggaccagaggcctaaggaggcttctcctgaagcccaaatcccaaactggtcaccagtcatgctccgtaactcctgaacctgacaagaagccagccggccaggtctgcagcccgggttaagaggagcataccaggaaagagccaaagagcaaaggagcatgagcccttcaaccgcttttacaataatttgggctaggcgttcagggctccgtaggacccttcctggcagccaagtgagagaaagaggaatgatggtggaatgggcctctcctgtgcttcccattacttccacactgtcgaaatagaaatagaagcagaaaagaacaccctacaagtcccacccatttggaggcactcaactcacagtgacaaccctccacacctctcccctgcaaaaagacgcaaaacaaaaacacctactccaaactgtgtccttacatctcagccccgaagatcaggattgtgtgcaacttcggcccaaaggatgcatttccccagggttgaaagtttgagaaagaggctatattctgaagagttcttgttgtcaccatcaaaaggattaaaaagacgcaataaataagaaaacagcgtagttggggggcatgctccatttgagccagaaagccttggaaacttaagtgttctcaaacggaacgccatcctgctttgggggaacacggaggctgccttgcagtcacgtgatcgcacaacaccaaagggccacgcactctgatttcacctacttaactaaaagttgcagcaaaatccctattacaggccaggcgtggtggctcatgcctgtaatcccagcactttgggaggccgaggagggtggatcatttgaggtcaggagttggagaccagcttggccaacatggtgagaccccatctctattaaaaatacaaaaattagcccagcgtggtggtgcacgcctgtaatcccaggcaccctggaggttgaggtaggagaatcgcttgaacccaggaggcggaggttgcagtgagccgagatcacgccactgcgctcctgcctgggcgacagagtgagactccatctcggggggaaaaaaaaaaaaaaaaaaaaaaaaaatccctattacaaataaaagctgttgtgatccagactgcatatacctctgcgaatggaaccagaaccgtgaattccaatgcaaatcgatgcatcggcaccagacccgctgcactggatgtatctgcattgcagtcacccgagtacggagcacatcatagatgatctctgcaggttcgttgcccacataggaggcatagcgcaaatttcaaaggaacgaatacatcctggagcccaaacagctatctggttctgctgctggcctcctgacaagtaggtaagagagtcacattttatagacgacggacaccaaaaccacacatgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttaggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggaataacaaaacgcagaagcgggaacgatgtctttttattcctccccagacgcaaacgtggatgcatgaggtttggtaacaggcaaagtcatctggttaacgtgactgatgcaaaaagtccaggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctgatgaggtgcaaagagcgggatcggaggcggggcctggccgggctgtgagcggcgtatgcaaatcgagggtctcggggatgcggatccaagaccctgggaaggtacgcggggcctggcggggcaccagctgctgctagctcggctgcaatgcaagtggtctaggttgctaaaggcatcccacagcctctccatctgaacatgacccaaacgaaactcgtgaccctaattccatgtctgcgcatttctagactgttgtccccccccccccccgccccgactactcagtcctccgtcttccggtccagggccccttgccaagcaccgggtccacctctccgtccccaccccggttgccttagaagtccgtcctgtcgcaacactgcagtcatggtcttgaggcccacccgccccaacgaacaccatcatgctgaggactttcccgggcaggccctgacttgctcagaaccagcgggggtgtccccttcccacccagggccactcccctgcactgtcacccggagagactgctcctctgtgccatccctggctcccacccaaccccagacccccaccacctctccatccctccagctgtggaggtctcacaaccccccaacccatctcaccgcccccccacccccaccccaaggcaaagtgactgaagcgggcagatggcttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgaaaagggtgctcagtagcctgtcgttgtgaaccaccatgtccagcagcaggggagtgatgttccgctctccgctgttctgggcctcgttgcccgccagctccgggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggaggaccctcggcgtctcctcctcctcggcatgctgggcgttgagtgtgctatctcggcttggcccagctaggcaagatggctctcaagaggacagttaccgcgtccagtactgtgtatcctagcgaccagggcccagcccctcattggctagggagccgagaccaatgggcacgcacatccggcgacgggcacgcatgtggtgacggcccctcacaagggacacacgtccgtcaggtgacctcatcactttcccattggcctcgagggagcaggcctgggcctagaagtggctggagggccgtgggggtggggtggggcggggcagggggaatcgcgctggtgaccctctctttgccagtgggaactttccctttctactggatgggaacaccgtgggaaagacaaaggggtgggcgaggggaggacgggtaccacgccttcacaatgttgcacatccatcacgaccacctagttccaaaacgttttcaacaccccgaaaagaaaccgaaacccctgtacctataagcagtcacttgccgcacgcctccttccacaccaccactaccagcccccacaccctcccacacacaccccctgcccccgcccatacacacgttcccgatagtccctggcaacccctagtccatctgctttctgtccatagaggttagcctgttctggagatttcctatagatggaattatacgaccaaatgtgaggccgtgtgtgtctggctgctttcacttagcgtaatggtttcatcagggtgcatccatgtagaggcatgaatcactacttccttcctttgaatgactgagtacgattctgttgtatgaataggaggccacattttgtttacccactcgtcagttgatggacaggttatttcccccttctggctattgtgagtggcactgccatgaccatctctctacaggtttttctttgaatatctcttttcagttcttttgggtctatttctagcagtcaaactgctggctcgtgtggtaattctgtttaacttattgaggaaccaccaaactgatttccacagcagctgtaatctttcgcattcccaacagtagtgcatgagagtcccaatttcttcacagcctcatcaaaacctgttttctgtttgcctcattttgttttgtttacagtagccatcctactgggtgtcaagtgctatctcatggtggttttcattcgtatttcccaaatggctaatgatgttgctgtggtttgagtgcatcccccaaattgtgtgtcttggaaacttaatccccaaattcacatgttgattggaggcgcagcctctgagacggtaattaggattagataaggtcatcggggtgagacccccaggatgcgactggtggctttataagaataggaagagaggcctgaaacgacatacacgctcttgccctctcgccgtgtgataccctctgccgtccccagatgccgggtcacttcccagtccccagaacggtaagaaataaatttcttttctttataaattgttcagtgtcgggtattcaattatggcaacagaaaacagactaagacatcttttcatgtgcttcttggccctctgtacctctgctttggaggaatgtctattcaagccctttgcccattttttaattcggttgattgtattttggctgtgggcttctaaaacttattcatatattctggaaaatagactcttatcagatatgtgacttgcaaatgtttctcccattcactttctggatagagccctttgttgcccaaaagatttacatttggatgtagtccaacttgccaaatgaaaagatatctgtggctttgcctttggtgtcatactgaaggagctgttgcctaatccaaggtcgtgcaaagttacatctccgttttcttcttagagttttatagtttcagcccttacatttagatctgtgatccattttgaattaattctttacatgatgtgaggtaggggtccaggggccttcttttgcatgtggctatccagttgtcccagcgcagtttgttgaggggattattcttcccctccacccattgaggggtgccggaactcttactgaaaataaactttacataaatatatgggtttattcctgactctgagttctgtaacattgacctaatgtatcgatcacgatggcagtaccacccttttcggattactgcggttttgtagtacgttttgaaattgggaagtgtgagtccttcaacttttttcttttctgagattgttttggctatctgagccccttacattttcttatgaattttaggatcagcttgtcagtttttacaaagaaggcaggttggattctgacaggcatcacgatgaatctgtatattgccttggagattatgggcatcttaacaatattaagtgtcccaatccgttaacacaaaatgcctttcgatttatttaggtcttctttaatttattttagcaacgtcttgaaattttcagagtatacatcttgtacacctttagttaaatttattcctcgacattttattgtttcgatgctactgtaaaatgaatcatttccttaatcttattttcatgttattcattgctagggtgtagaaatacaaccgactgttgcagattgatcttggatactgcaactttgctgagccgaatatgctttgctgagcatactcagacagggttggcatattagtccgttcctacactgctataaagaactgcctgagaatgggtaattcctaaagaaaagaggtttaattgcctcatggttctgcaggctgtacaaggcttctgcttctgggcaggcctcaggaaacgtgcaatcatggcggaaggcgaaggggaagcaagcaccttcttcacatgttggagcaggaggaagagagagagaacgcacgcaaagggggaagcgctgcacattttcaaacaatcatcagatcttgtgagcgctctatcagaagaatagcaagggggaagtccgcccccatgattcaatcacctcccactaggcccttccttcaacaggtggggattacaattcgacatgagatttgggtggggacacagagccaaaccgtctcagttttttttttttttcttttgttggactctttagtgtcctctatataagaacatgccatctatgcatctatgaatagagatggttttacttgttcctttccgatctggatgccttttatttctttttcttgactaattgccctgactagaactttgagtacgatgttgagttacaagtggcattcctgatcttagggggaaatcaaccagtctttcaccattaagtatgatattatctctgggtttttcatggatgccctctatcaggttgaagaagtttctttctgttcctggtttgttgaatttattttcatgaaagggtactgcgttttgtcaaatgatcctttttgtacatgattaagatgaccatgagccccctcccccgcccccgctccgccatgcattctgttaatatggtgtattatataaattgattttcacatgttgaaccaaccttacatttgtgggataaatcctatttggtcatagtgtataaagagtggtcaataaacatttcgttgaaagaataggagtggatctggcaagcttcttggaggacaatgtgtgtgttaaagaatctgtagcatgatgagaagccaaggcaccggtgggaggaggggagttgcaaccaattcattaaggctggagagtacgatgccagtggagcagtagtggttgatgtggctgggaaagaggtaggcaggagccaagacatggaggttctattatgccatgctcaggttttagaataccctgtaggctacactgaacccactgtggtctttcagcttgggagtgacgtggtctgatttgcctctagaaatatcaccctggaagctgtgtggagaatagaacagagaggattgtgtgtggagaatagaacagagaggactgagattggaattagaaagctgctgtattataccagtcaagaaatgacagatatctcaactaagacaatggcattggtagataagactaggggacagagtccataaaaagtttaggtagtaaaatggcacacagtagacactcactacatattactcatactggtgaacctagctggagacatgataattcatgtgctcattcttcaaaaaatattgaagggtagtgccaggtatactgtgttaagcattgagacaacaccaacgagaaatattctgttgtataaataggccacattttgtttatctactcatcagttgatgaacagttcattaaatgatttccatggcaggggaggtaaatgttgtcctctatcctcttagattctccagctaggacttaaataagatagattaacaaaagaaaagcatacaaaattttatttggcattttttacatgtacatgggagccctcataagaaatacgaagactcaagtgattaattacagctgaatacttacatactagggtgggaaaagtatggtaaattgtgaaaacataacaagacattggggtttgggctaggagagttaattgtggaaaagtcactaagaaggtaagagttgtgtaacaaggttttttggtgcagctttccctcaagcctggactccccatctctggcaataagaatgtgtttcttcttcctggtatacagataatacctttcacatcagagtttcatctcttcctttcatgaaaaaaaaaggaaggtcagtgtgcccttcttgcatctgctactttcaagtgcctttaaacacaaaataatcaatatgccaaagtggcatattttgaggtggcatttgatcccctacattactgattggatagtgtgaatagtgctgccatgaacgctcctgtacaagtgtttgtttgaacagatgttttaaattgcagacgctcctcaacttgggatggtattatatcctgataaacccattgttagttaaaaccattattagtgtaaattcatttaatacagctatattagtccattctcacactgctataaagaactacctgagacttggtaatttatgaagaaaagaggtttaatggactcacagttctgcaggcttaacaggaagcatgactgtgaggcctcaggaaacttacagtcccagcagcaggtaaaggggaagcaagcacgccttaccatggtggagcaggagagacagagagtgaaggacggaaatgtcatacacttttaaaccatcagatctcatgagaactcactcactgtctcaagaacagcaaggggaaatccacccccatgatccaatcacctcccaccaggcctctcctctgacacacggggattacaattcgatgtgagatttgggtggggatacagagccaaaccatatcagcggctaacctaccaatcatcataatttagccaggcctaccttaaacatgctcagaacacttacaattaggctacagttgggcaaaatcatataacgtaaagccaaatttataatgaagtgttgactatctcacgtaatttattcaatattgcactgaaagtgaaaggcagaatggttgtatgtgtactttaagtacttttatgcatatggattctactgaatgcatgttgctttcataccatcataaagtcaaaatattgtaagtccaaccattataagctgggaaccatccatatttgaggtacatacccatgaatatatttatgggtttatttcttgcttcttaattctattccatttatatatatgtctgtccttatgccagtaccacaaagcattgataactgtagctttatacgaagttttgaatttgggaaatgtgagttatccagctttgttattttttaggattattttggctatttgaggtcttgcacaattacacatgaattttaagattggcttttccatttctgccaaaaaaaaaatggccattgggattttgatgcagattgtattaaatctgtagatcactttgggtagtactatcatcttaataatattgtcttccaattcatgaacacaggatatattttcacttctttatgctgtctctaatatctttcagcaatgttttgtagttttcagtgtacaagtcttttacctccttagctgaatttattcctaagtattttattctttttgatgctattttaaatagaattattttttattttgttaatttcatctcagattgttcattgctagtgtgtagaaatacaactgatttttgcacgttgatcttatatcttgcaactttgctgaattcgtttattagctctatagtgttttgtggattcttcggggttttccatacataagctcatgttcatctgagaataagatagctttacttattccttttcaatttggatgccttttatttctttttttcctaattgctctggctaagacttccaatacaattttgaatagaagcagtaaaagcaggcattcttgtctcgtttctaatgttagggaaatatctttcagtcttctaccattgagtgtgatgttagttttgggtattttatgaatgctctttatcatgttgtggattttctcttccatttctagtttgcttagtggtttttttttttttttttttttttggtcatgaaaaggtgctcagctttatcaagtgatttttctgcatcaaccagaatgaacttgcaggggtttttttccctatattttattaatgtggagttgactgggggattgattgtcttatgttgaaccagtcttgcattattgggataatttccacttgagcatgggctataacctttataacatgctgctggatttggtttgctaatattttgttgaagatttttgcacctagatgcataagggaatattatactcacatattcaattacatgcaatttgtaattttcttttcttgtgatatatttgtctggctttgatatcaagatatggtggcctcatagtatgagttgtaaagtttactctccttttctgtctcttggaagagtttaagaaggattaatgttaatccttccttaaacatttagtagaatttaccagtgaggccttctagcacaatgcctggcacataatatatggaatctaggatttgtatagtcagtcattaactatttgttgaattaataaattgtctccccaagcaggtttctaatcaaggcacaaagattgagtaacgaatgaaggcaaagccaatgtatacagggtattagttttctaatgctggggtggcaaattaccacaaacttaatatggcttaaaacaacacaagtttattatcttacagttcgatagggcagaagactgacccaagtcttactgggctaaaatcaaggtgtcatcagggctgcatttctttctggaagctctagaaaaggatcctttttcggtcgcctgtagtcccagctactcgggaggctgaggcaggagaatggcgtgaacccgggaggcggagcttgcagtgagcggagatggcgccactgcactccagcctgggcgacagagtgagactccctctcaaaaaaaaagaaaaagaaaaggatcctttttcctttcttttccagcttctagaggccacacacattcattaactcatggcttccttcctccatcttcgaagccagtaacattgcacctttgtgactattcttaagtagtcacgtctccctttgactctcctcttctgcctctctctctcactttcaaggcctcttgtgattacattgggccgacctggataatccaggatattctccctattttgacatcagctaattggcaaacttaattccatctgcaaccttaaatccctcttgccatgcaacataacacagtcaaatgttctggggattaaaatgtggacatcactgagagatcatattcttcctagcacatacggtttagtcacaagttaatgatcaacatttattagctatataatactcttaagttcaacataaactttttggatgctgataaaacggaatggcattttacattgatatatacttcatttcaaaacttcttctacttctcaatgattattctgtagcaacaaatttcttttaaatcagaaatttggaaacataacgagacctatctcaaatcaaagatgactatccccttttggagtcagactacacattcattattttagtcaaaatgagacataaaattcaggcccccaagagctgccagtacccacttacgcaggaggtagctagacgaaacaggtagctttctacaaatgattttgcaccatcccaccccagagaggtggtttggagtgtttacttattacctgggatttaattatactagctcttgcaaaagccaaatctaaaggccataaatagaaggtcaaattttctcctatatagaaaggagagcagcagagaaaacaaaatccttggtaaatctttaaacaaagttatatggtttgaatatgttattcattctattttaaccccccaatacagatatatttataaaaaagaatattgtgatttctggtataacttgtttaggaacaaagccacaaatttattaatattttctattccctgggaagaaaaaaatgctacatggcagaataattttttaaaatttccagccgggcacggtggcttatgcctgtaatcccagcactttgggaggccgaggtgggcggatcacaaggtcaggagattgagaccatcctggctaacacggtgaaacaccgtctctactaaaaatacaaaacattagctgggtgtggtggtgggcgcctgtagtcccagctactcgggaggctgaggcaagagaatggcgtgaacccgggaggcggagcttgcagtgagccgagatcgcgccacggcactccagcctgggcgacagagcgagactccgtctcaaaaaaaaaaaaaaaaaaaaaattcccatgatactaaactgatgtgtgatcatataatagacttacactgatacctattttagtgtattcaagcagataaaaaatcccaggtgttctatgagtgatatcattttcagtatttcttatgctgtatgccatggtttaaatctaggcctttcgaattggcattactaccatatttctcaaactgtattccctttctcttgaatatgttatgtaattttgtccagaacccagacatgtcaaggtgtcaaatcccacgttttggatactaacgtgtctcattaattcatacagtgggatcattcattaatgcccacattatagactctctctctctctacacacacacacacacacacacacacacacacacacactacattcttagaagatcattctgagaccagggtggaggataggctgtgcattcccagtactctttcacagctgactgtgtcctctgccagtgttttcaaactttactgcttatgaaacagctaagggtcttattaaaatttagattctgattcagtagaactgacatggtgcccaaggaactgcatctcttttaaaaaatctttatttaggtataattgacaaaagttgcatatatttaagaggtacaacttgatgttttgatatattttgtttttcatatatgatgtttgatacattgtgaaatggtcaccacaagcaagctaattaagatatatctatctctttgcctagctacctttttttgtggtgagaacatttatgacctactcttttagcaaatttcaagtatacaatattgtttactatagttactatatcgtacattagatctccagaactaatttatcttgcataattgaaattttgtaccctttgatcaacatctccctgtttcccccacaccacagtccctagcacctaagattctactgtctgcttttatgagtttgaccatcttagattccacatatgaggtcatgaagtatttttctttcagtgtctggcttattacacttagcataatattttccaggttcatccatgttatcacaagtgggaggattttcttctattttaaggccaaataatattttataattgtgggaatattccatcagatatatatatatcagattgtctttatccctccatccatcaatggacacacttaggttgtttccatatcttgactattgtgaatactgttacagtgaacatgggagtgcagatattcaacatactgattttgtatcctttggatatataacagaagtgagattgccagatcacatggtattcatttttagtttttttgaggaacctctatgctgtttttcataatggctgtaccaatttatttttgcagcaacagtgtacaaaggtttccttttctccacattaccaccaacatttgtcatcttttgtctttttgataatagctatttgctatggtttgagtgttttccccaaaaaacatgtgttggaaacttaattcccaatgcgacagtgttgggaggtagggccgaatgggagatgtttaggttatgaggactccaccctcatgaatggattaatgccgattacaaaagcacctaaggctgtgaatttgaattgctctctcttgccctctttttgcccttctgccatgttatgatatagaaagaaggcctttgccagatgctggcctcttgatcttggactgcccagcctccagaactgtgagccaaatacatttctgttcactacaaattactcagtctgtggtattctgtcatagcagcataataaattagagtccataataagttatagtccataacagactaagacactattctaatagatgtgagggaatatctcattgtgttttgatttgcatttccctgtgggttagtgatgctgagcatcatttatctgttggccttttatatttcttcttttgaaaaattctatttgggttctttgcccatttttaattgggttgtttcttactaatgagttgtttgagtttcttacccattatcagatatacagtttgcaaatattttcatccattccataggttgtcttttcactctgttgattatttcttttgctgtgcagaaagtttttagtttaatgcaatcccagtttctatttttgtttttgttgcctgtgcttttggtgtcatataaaaaaattattgcccaaatcaatatcaggtagcttttttcctgttttcttctaggagttttatagtttcaggtcttatatacaagtgtttaatcaattttgagttgaattttatgtatagtgtgagaaaagggcccaatttctttcttctgcatgtggatattcagttttcccaatatcatttattgaagagactctcttttccccgttgtgtgttcttggcacccttgtcaaaaatctgttgactgtaaatgtgtgaacttatttctgggcttttctattctgttcccttggttgatgtgtctatttttatgccagtaccatactattttgattactggagacttgtagtatattttgaaatcaggaagtatgatgcctctagctttgttcttcttgcttaagattgctttgccaggctgcatgtggtggcccacgcctgtaatcccagcactttgggaggctgaggtgggtggatcacttgaggtcagaagtttaagagcagcctggccaacatggtgaaaccccgtctctactgaaaaaatacaaaaattagccaggtgtggtagcaggcccctgtgatcccagctaatctggaggctgaggtggagaatcacttaaacctgggaggcagaggttgtagtgagccaagatcgcaccactgcactccagcctgggcaacagagcaagactctgtctcaaaaaaaaaaaaaaaagattgctttgcctccttggggtcttttgtgatttcatattaattaaaattttttttttatttctgtgaagaacaccattgagattttgatagggatcacatcaaatctatagattactttgggtagtgtggacattttaacaatactaattcttccaatctaggaatatggaatatcttttatttatctgtgtcttctttaatttccttcataaatgttttctatattttcattgtacaagtctttcatttctttggttaagtctattcctaagtattttattcttttgttgctattgtaaataagattattttctaatttcctttgggatattttatagtgtatagaaacaccactgatttctgtatgttgattttgtatcctgcaactttacagaattcatgtattagttctaacaatttttttttgagtctttagagttttctacatgtatgatcatgtcatctgcaaaaagagataattttactattctcttctatttggatgctttttattttatttattttttaaattatattttaagttctgggttacatgagcagaacatgcagttttgttacataggtatacacgtgccctggtggtttgctgcacccatcaacccgtcacctacattaggtatttctcctaatgttatccctcccctagccccccaccccccaacaggccccagcgtgtgatgttccactccctgtttccatgtgttctcattgttcagctcccacttatgagtgagaacatgcagtgtttggttttctgatcttgtgatagtttttgagaatgatggtttccagcttcatccatgtccctgcaaaggacaggaactcatccttttttatggctgtatagtattccatggtgtatatgtgctacattttcttaatccagtctatcattgatggacatttgggttggttccaagtcttcgctattgtgaatagtgccacagtaaacatacatgtgcatgtgtctttattgtagaatgatttataatcctttgggtatatgcccagtagtgggatttgctgggtcaaatggtatttctagttctagatccttgaggaatcgccatactgtcttccacaatggttgaattaatttacactcccatcaacagtgtaaaagcgttcctatttttccacaacctctccagcatctgttgtttcctgactttttaatgatcaccgttctaactggcgtgagttggtatctcattgtggttttgatttgcatttctttaatgaccagtgatgatcagcattttttcaaatgtctgttggctgcataaatgtcttcttttgagaagtgtctgttcatatcctttgcccattttttgatggggttgtttgtttttttcttgtaaatttgtttaagttctttgtagattctggatattagccctttctcagatggatagattgcaaaaattttctcccatcctgtaggttgcctgctcaccctgatgatagtttcttttgctgtgcagaagctctttagtttaattagatctcctttgtcaattttggcttttgttgccattgcttttggtgttttagacatgaagtctttgcccatgcctatctcctgaatggtattgcccaggttttcttctaggatttttatggtcctaggtcttacgtttaagtatttgatccatcttgagttgatttttgtaaaaggtgtaaggaagggatccagtttcagttttctgcatatggctagccagttttcccaacaccatttattaaatagggaatcttttccccattgcttgtttgtgtcaggtttgtcaaagatcatatggttgtaactgtgtggtgttatttctgaggcctccattctgttccattggtctgcatatctgtttggccccagtaccatgctgttttggttactgtagccttgtagtatagtttcaagtcaggtagcatgatgcctccagctttgtccttcttgtccaggattgtcttggctatgagggctctttgttggttccatatgaagtttaaagtagtgttttccaattctgtgaagaaagtcagtggtagcttgatggagatggcattgaatctataaattactttgggcagtatggccattttcatgataatgattcttcctatccatgagcatggaatgtttttccatttgtttgtgtcctctcttatttccttgatcagtggtttatagttttccttgaagaggtccttcacatctcttataagttgtattcgtaggtattttattttcttagtagcaattgtgaatgggagttcactcatgatttggctctctgtttgtctgttattggtgtataggaatgcttgtgatttttgtacattgattttgtaccctgagactttactgaagttgcttatcagcttaaggaggttttgggctgagatgatggggttttctaaatatacaatcatgtcatctgcaaagagagacaatttgacttcctcttttcctatttgaataccctttattgctttctcttgcctgattgccctggccagaacttccaatactatgttgaataggagtggtgagagagggcatccctgtcttgtgccagttttcaaagggaatgcttccagtttttgcccattcagtatgatattggctgtgcgtttgtcataaatagctcttattattttgagatatgttccaccgatacatagtttattgagagtttttagcatgaaggggtgttgaattttatcgaaggccttttctgcatctattgagataatcatgtggtttttgtcattggttctgtttatgtgatggattatgtttattgatttgcatatgttgaaccagccttgcatcccagggatgaagccaacttgattgtggtagataagctttttgatgtgctgctggatttggtttgccagtgttttattgaggatttttgtatcgatgttcatcagggatattggcctgaaattttctttttttgttgtgtctctgtcaggttttggtatcaggatgatgctggcttcataaaatgagttagggaggattccctctttttctattgtttggaatagtttcagaaggaatggtaccagctcctctttgtgcctctggtagaatttgtctgtgaatccgtctggtcctgtactttttttggttggtaggctattaattactgcctcaatttcagaacttgttataggtctattcagggattcaacttcttcctggcttagacttgggagggtgtatgtgtccaggaatttatctatttcttctagattttctagtttatctgcatagacgtgtttatagtattctctgatggtagtttgtatttctgtgggatcagtggtgatatccccaatatcattttttattgcatctatttgattcttctctcttttcctctttattagtgtggctagaagtctatctattttgttgattttttcaaaaaaaccagctcctggattcaatgattttttgaaggtttttttgtgtctctatctccttcagttctgctctgatcttagttatttcctgtcttctgctagcttttgaatttgtttgctgttgcttctctaattctttaattttgatgttagggtgtcaattttcaatttttcttgctttctcttgtgggcatttagtgctgtaaatttccctctaaacactgctttaagtgtgtcccagaaattctggtacgctgtgtcttcattctcattggtttcaaagaacatctttatatctgccttcatttcattatttacccagtagtcattcaggagcaggttgttcagtttccatgtatttttgtggttttgagtgtgtttcttaatcctgagttctaatttgattgcactgtggtctgagagactgtttgttatgatttccattcttttgtatttgctgaggagtgttttacttcgaattatgtaatcagttttagaataagtgtaatgtggtgctgagaagaatgtataatctgttgatttggggtggagagttctgtagatctctattaggtctgcttggtccagagctgagttcaagtcctgaatatccttgttaattttctgtctcattaatctaatattgacagtggggtgttaaagtatcccactattattgtgtgggagtctacgtctctttgtatgtctctaagaacttgctttatgaatctgggtgctcctgtattgggtgcatatgtatttaggatagttagctcttcttgctgcatttttccctttaccattatgtgatgctcttctttgtctcttttggtctttgttggtttaaagtctgttttatcagagattaggattgcaactcttgcttttttttttgctttccatttgcttggtaaatattcctccatccctttattttgagcctatgtgtgtctttgcaagtgagatgagtctcctgaatacagcatactgatgggtcttgactctttatccaatttgccagtctgtgtcttttaattggggtatttagcccatttacatttaaggttaatattgttatgtgtgaatttgatcctgtcattatgatgctagctggttgttttgcccattagttaatgcagtttcttcatagtgtcaatgttctttacaatttggtatgtttttgcagtggctagtaccagttgttcctttccatgtttagtgcttctttcaggagctcttgtaaggcaggtctgatggtgacaaaatccctcagcattcggttgtctgtaaagaatttcatttctccttcacttatgaagctttaagaggtttaattgactcacagttctgcatggctgtcccataagtcccatgttctttcctcaggaaacctacagtcatagcagaaagggaaataggcacatcttacatggcagcaggcaagagagagtgtgtgaaggaggaactgtcaaacacttataaaaccatcagctctcataagaactcactatcaggagaacagcgtgggggaaaccatccccatgatccaatcacctcccactaggtccctcccttgacatgtgggcattatggggattacgattcaaggtgagatttgagtgggaacatagagccaaaccatatcagtatctaaaaggaaaaaccttcagtttttccacatttggttatgatatcagctgtgagcttttcctatatggtctttattgtgttaagttccttctgtatctatcttgctgaaagtttttattatgaatggatatctagttttgtcaaattctttttctgtattgatcgaaataatcatgtgtttttcatctttcattctgataatgtggtatatcacattgattgatttgcccatgttgaaccatccttgcatcctagggataaataccacttgttcatgatgaatgatccttttaatgtgctgttgaatttggttggctggtgttttgttgaggatttttgtatccgtgttcatcagggatattggcctgtagttttctttcttttcttttcattttctttttctttctttttttttttttttttttttgagacagagtcttgctctgtcacccaggctggagtgcagtggtggtatgatcttggctcactacaacctccacctcctggattcaagcgattctcctgcctcagcctcctgagtagctgggactactggaacatgccatcacacccagctaatttttgtatttttttagtagagatgagttttcaccttgttggccaggctggtctcgaattcctgacctcaagtgatttgcctgcttcagcctcccaaagtgttgggattacaggcttgagccaccacacctggcctggcctgtagttttcttttctagtgttgtttttgcctggatatggtatcagggtgatgttggctaataaattgtattttgaagtgttctctcttgtattttttggaagagtttaagaaatactggtattaatacttcgttgaatgtttgatggaattcatccatgaagccattggtcctgggcttttctttgttggaaggtttttgattactagatttaatatccctatttgttgttagtctgttaaggctttctatttctttgttattcagttttggtatgttatatgtttctaggaatttatccatttcctctaggttaaccaatttgttgacacttataatagtcccttatggttctgtctgtttctgtgacatcagttgtagtgtctcctctttcatttatattttatttatatgagtcttctctctttttttcgtagtctagataaggacttgtcaattttgtttattttttcaaaaaaatcaactcttagttttgtcagttatttccaattgtttttttattctcttttttatttatttctgctctagcatttattatctcctttgttctgctacctttgggcttagttttttttttcttctttttgtagttcctggaggtgataagttgggttgtttatttcatatgtttcttctttttaaatataggcatttattgctataaatttccctattagtatgcttttactgcatcctttaagttttggtatattatcaagattttggtttcttctgtgacccaatggtcgttcaagaatgtgttgtttagtttccacatatttgtgaattttcgtgttttcttattgttattgatttgtagtttcaatccattgtggtcagaaaatatacttggtatgatattaatcttcttaaatttattatgacttgttttgtgacctgaaaggtgatctgtcctgaagaatgttttgtgtgtgcttgataattctactgttgggtggaaagttctgtatatacattttaggtccattgggtctattttattcttcagttctgttttgtccttattgattttctgttgggatgatctattcattatagagagtggagtattgaagtcaactatattatattgttatctatttctccttccatgtctgtcaatgtttgctttatatatttaggtactttcgtgttgggtacatatatatttataattattacatcttcctgttcaagtgacccttttattatataatgaccttctatgtctcatgtcacagttttttacttaaagactattttttctcatacaagtatagccacccctgctctcttttggttacagtttgcatggcataactttctccaccccttcactttcagcctatgtatgtccttaaatcaaaagtgagtctgttatcaacaacatgtagttgggtcctgtttatttttgtttcttacttcccatctctgaattgttggctttttaaaaagcccattcagttactctgtgtcttttgactggggagtttagtcaatttacacttaaagtaattattgataggttaggactttctgttgccattctgttaatagttttctgttttgtagttttcttgttcctttcctctttttctttctttgtggtttgatgatttttgcttggatgtgttttgattcttttctctttatcttctgtatatctactgtgtgggggggcggtcgggggggttaccacagggatcaaattgaacactttatagttatggcagtctgttttaagctgacaacaccttcaatcacatacagaaactctatactttactcattccccccgccacaactttatgtaatcgacgtcatattttacttccttctatattgtgtttccattgacaaatttctgtcactatagttactattactatttttgtcttttaatttataaattaatattaatagtgatttataacaatcattatagtgttacaatagtctatgtttctctttatatttacctttagcagtgaaaggattcatatgcttttgtgttactgttttttttttatttcaacttgaagaactattagcacttcttataaggcaggtctcatggtgacaaaccccctcagtttttgtttgagaaaggctttatctttgtgttcattcttaaaggacagtttttccagataaagtattgttgattggatttttttctctcagtactttgaatatatcatcccactctttcctgacctgcaaggtttctgctgagatatccactcatagtcttatggagctcccctataggtgacaattcactttcttcttactaccccaaaattctcttttgtctttgttgaaaatttaattataatgcatctcactgtagacttctgtgggtttaatgtatttggttatctttgggcttaatgaatccagatggcacttcccctccatagatttggggagttctcacctattatttctttaaataagtttcctttctctctctcttctccttttaagatttctataatgcatctatcattttgcttgatgatgtcccataagtcctctgttcttccttcactctttctcattgttctttttattccgctaactagataatttcaaatgacttgtcttcaagtttacaaattctttcttctgaatgattgagtctgctattaaagatcgctattaaattttttagttcagtcattcttcagctatattcagcaatattctttagctacaggatttttatttggttcttttttatggtttttatttctttattaaacttctaatgttgttcatgtattgttttcctcattttgttagtcgtcttcctgtatcctcttgtagctaattgagcttctttaaatgattattttgaattctttgtcaaaaatttcatgaatctccatttcttcagggttggttactggagctttattagttccctttggtgatgtcatatttgcctgattcttcatgatccacatagcctagcattggtatctgtgcattggagtgagctgacacctcttctggtctgaagttgggtactcagacaatgggcccattaccagggctttggataggtgtagctctcactgggtccttgagtgggcaggactgcctgcagaccatgatgcagtgggcctggagctgggtcaaagggctgcttcagggtccccacttgggcccacagtcagtgggcctgttatgggggcacaggtaagtgtggattcaggcaggactgtctccagaacatggtacagcaagactggagttggctcacagggttacttctgagtccacagtcaggtctagttggtgggcctgcttccagaggtggactggcatgactcccacctgtttcctaagtaggcaaaacttccccaagaccatggtagtgtggtactgaagctgctttaggtacagggctgcttcagagtccacagttgggagccctgttactggggttgccaatgggagttgctcctcccagattcctgggcagatagggatagtggtaggaccacatacaaacaactctggagctaagtccccagggtggtgggctgcttctgggtccacaaccagaactacagttgacaggcctgccgctagaatgtgggcctgccttattaaagtattcatctttgttcttgagctctaccagggtttctcaacctcctacctgaatcccaaggctcccacaaagacacttttgtccatagatcattgtcaaattattgttcctgtgggggaacaagagctagggacctcctatcccatcaactcactgataccgttctcctgatgctgcattttgaattgccctcaggtgatgctgctactcctggtctgtggaccatgctggagtagcagagcccaaatggcttcctcaacttttatgagccttttacaggaactcaaagtagaaaataacttcacttgccccagacctaataatttcctttgttcccacttcttcttggtgctttcctcctttgtgtctaccatcgtaacatccatctaaccatagttgtcttatgtagatgttggatgctgttgagaaacgcacaaagcaaattagaaggaagatatgattgacagaaattgctttttactctgtattcactttccatgtatttgtgctaatctctccatacaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagtaagtgccaagtcatcccatatccttcttccctcaaccatgggtagggtgactaactgttctagttatcctgagactgggggaggggttcccggtatcaggacacaaaattgtcagtgctaaaaccagcatagtcctgggcaaacccagaaataccattcaacccagcagtcccatcactgggtatataatcaaaggaatataaatcattctgtcataaagacacatgcacgcatatgttcatttcagcactattcacaatagcaaaggcatggagtcaacctaaatgcccatcaacaacagattggataaagaaaatgtggtacatacataccatggaatactatgcagccataaaaaagaatgagatcatgtccttttcagcaacatagatgcagctagaggccattatcataaatgaactaatgcaggaacagaaaaccaaatatcatgtgttctcataagtgggagctaaacattaaatgcacatggacacaatgatggacactcaggaggggagaggttgggaggggggtgtgggttagaaggttatgtattgtgtactgcactcactacctgagtgaggggatcattcatacaccaagcctcagtgacatgcaatttacccatgcaacaaacctacccatgtacccctagaatctaaaataaaagtagaagaagaaaagaaacaaagaaaattaaagagtcacacaaagtgggaagagctggctggaaaacagatagcaataacagaattggccgggcgtggtggctcacacctgtaatcccagcactttgtgaggccaaggcgggtggatcacgaggtcaggagatcaagaccatcctggctaacatagtgaaaccccaactctactaaaaatacaaaaaattagccgggtgtggtggtgtgcgcctgtagtcccagctactcgggaggctgaggcaagagaatcgcttgaactcgggaggcagaggttgcagtgagctgagatcatgccactacactccagcctgggtgacaaagcgagactccatctcaaaaaaacaaaaacaaaacaaaacaaaacaaaaaaccaataacagaatctgtgcaaaagttaaaacctgagaaatgatattatgatgacagtagccctagaatatcagtggaagctgctcagtataactgaggctgaagcatgtccttgtgataaccttcttttttcttttctttgaggttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtaagaggcaacagatttactgtttaactgactcagagcagtggttggggaaaaaatcggggaaggccttgactgtttcttctgaggtatttctgtcaactgttagttctaaaaagtgtgtcaaggaagtttggttatgggcagacaaccacacaggcatttgggggaaatgatctctaattgaacctcctggaagaagaatctctatatctagtactgagctaatatctgtcaaagaattgtagaagctaaagtccattttacagataaatatcaacaattagctttctttccaggtttctcattacatcaatgaaaagtaaacatttactgcacatcttagtatccctaggatgagcctagggatacaaaggtgaattgtgaaaaattttggccctgaagttgcttagagttgaataagagagactgactagccaatagaaagtggaggctgggtgcggtggctcatgcctgtaatcccagcactttgggaggctgaggcgggccgatcacaaggtcaggagttctagatcactcttttgctgaggcaggataatcgcatgaacctgggaggcggaggttgcagtgagctgagatcatgctattgcactccagcccaggcaacagtgcctgactctgtctgaaagaggcagagagagagagagagagaaagaaaggaaagaaggaaggaagaaaaagaaagaaaggaaggaaggaaggaggccgggcagagtggctcacgcctgtaatcctagcactttgggaggcctaggtggcagatcacctgaagtcaggagttcaagaccagcctggccaacctggtgaaacctcatctctactaaaaatataaaattatctggacatggtggtgggcacctgtaaccacagctactcgggaagctgaggcaggagaatcggttgaactcgggaggcagaggttcagtgagctgagatcatgccattgcactacagcctgggtgacagagcaagactccgtctcaaaaaagaaagtagagtgagaagtgctgtggtatggttaagagggatttgggaatttctgggagtaaatggtgaccaagaggctactagtccaactctattgccctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtaagctggtctccttggaaagaaagaaagaaagaaaaaaaataccacctctcctagagcttaacataacataaaaaggttgatatatgaccaaattttcagagcaaaatttattaagtacctatggtagcaagacattgtaaaaggcattctgagagaacacagtgactttaagaaaaaggtaaaatactgagaaaagggcagagtagatccaagagttaattctcctcatcagcaccttgattcccaagcctttttgacctttaagtttagtggtccaggaagtcttcattcttaatctgggtttgctggataattcaacaaattgtcctgattaaaagacatgacataaagtcttatcaccccatgagtaatgggggaaggaatagttcctctctttggtattttttatattcttttttcaccaagaattaaccatgatgtggtccttaccaatctctctaatacagtctcttgccacttggctctttaagctccatccatactaagaaattctcaggtcactaaatacagccattatatctcataccaggcttttaaatagatactatttcttctacctggaacatttttctagctaccctctactgccactttcacctgactcattcgttaagtctcaggtaaacatcatgtccaagaagaattcccttatccatcaaggctggatgaaagacttcaccaaactggcagtttggtgaactgaagtctagacattggatattctagaagaaaaattcccatttaaaaaaggttatatctctgattagtgccacaacatgatgaactttcaaaatatgctaagtgaaggccgggcgcggtggctgatgcctgtaatcccagcactttgggaggctgaggcaggcagatcacgaggtcggtaaattgagaccatcctggctaacacagtgaaaccccatctctactaaaaatacaaaaaattagccaagcgtggtggcgggtgcctgtagtcccagctactcgggaggctgagacaggagaatggcatgaacccgggaggcagagcttgcagtgagccgagatcgcaccactgcattccaacctgggcaacagagtgagactccatctcaaaaaaaaaaaaaaaagaaaatacgctaagtgaataggccagacataaaaggatagatattatatgattctacttatatgagtgtgttagtcagggatatccaaagaaatagaaccaataggagattctgtctgtctgtctctctctctctgtctctctggatgagctaaactgttttagttcaagactgaaagcaggaaaaagctgatgttccagtccaaaggcagacaggcagcaagaatactttcttacttggggaagactcagtctttttgttctattcaggccttcaactaattggatgatgcctcccacattagggagagcaatctgctttactcagtctactgacttcgatgttaatcccattcaaaaacaccttcacagaaataaccagaataatgtttgagtaaatatctgggcaccttatgaccaagtaaagtagatacataaaattaaccatgacaagtccaccccttgtcaatgtagcacccatcatacacatctcctttatctctaagtagagacaaaaatgaggtcataattccacctaacatgatataacaaaacttggctggtattgataactaccttcttctactacccattctgtattgactttgccttcagcaagcatctcagctgattgtggttctttacctgatgaggtgacccaaacctttattcctgaagagcctgggccactagtagtcctgcatggattgggttgctgtagtttcccattgaccagaatcatagggcctggtaatactaagagacactctaagggatctattgtattccagacacactcttccatacctccattgtgaagcagtagttcagtttccttccaggaaggacaaaacgctgccccttccatgatgaacatattccaatgtaatcaacctgctgccagatagctggctgatcatcctgggaaatactgccatactgaggactctgtgtttgtctctactgctggcagattgggcacttagcagtggccatagccaggtcagccttgttgaatagaagtccatgttgctgagcccatgcatagcctctatccctgccaccatggctactttgttcatgagcccatcaggcagtgacataggtggctgagtaaaaaggatgactggtatccacagaacaggtcatcatatctactttttttttgagatggagtcttgctctgttgcccaggctggagtgcagtggcacaatctcagctcactgcaacctctgcctcccaggttcaagcatttctcgtgcctcagcctcccgagtagctgggactacaggcacgcatcaccatgcctggctaatttttgtatttttagtagagacagggtttcaccatgttggccaggctggtcttgaactcctgacttcaggtgatcctcccgccttggcttcccaaagtgctgggattacaggcgtgagccactgcacccggcccatcatatttacttgattattgaaatccttatctgctgaggtcacccttcgttgagcactcacatgggacataaatatattcacatcctttgcccattcagagagatctgtccacatacctcttccccaaatttctttgtcacctgttttctaatcatgttccttccaagtccctatctggacaaagcactgactacagcccattacttgacatataattgcacacctggccatttctccttctaagcaaagtccacaaccaggtacactgcctaaaattctgcccactgtccttcatgggtatctcagatcgggactgtccacttttgtgtagtacctgcatatcgtgcagaaccgtctgtaaaccaggcccaagactcctcttcctctgtaaactgatcatagggaactcccaatggggccataagtgcaggctgggagagagaaggcagggtagcagaaacaggcaccatggacatttgggctacttcttcatgtaatttacatgtgttttcagtacctgctcagacatgatcatgtatataccacttccatttgatgatggagtgccattgttcatacccaactttatggcttggtgggtcagataacacctagttcatgatgggcagttcaggtcacatggcaacttggtggtctgtggctaagcattcagtatctactaaggcccagtagtaggccaagagctatctcacaaaaggagaacagttattcacagaggattacaggaggatttctcactacagtagcccctgctccataggtcagggaaccaatgtgaagatcctgctagctgctcaatatatctgttccaattacgcattccaggactggggaaataaccacaagatagtctcacagatcctctgcatccactttgagatggacttgagctaaaattccattgatcatttgaccctccataagcccatactctgactggtggaccacagtgacattttgggtctcctgaaattagtgccagttcagagccattgtccagtagtccctgaaaggtctgattaattatttttcttcagtgcacatttattctgatagaaaggccatatgtccctttggggaaggctgagagaaagagtggcagtattcttggcagtgtaccagagtccttcctcaaggagactgagcctccccttcattcaaggagtgctgggtctgtaaacctgctcaagtctgggaattgattgagaggccgtgactctgtttttattattcaggttagacttttgttcacttgacctagaacttttccacttatgcagttcaagaatttggtaggcattctatctatatcacatctaggaacactataatctactagccaacaccataggtctgtgcaagtcatactattctaactgctgctttgactctgctgtcccttatggtaaccacacttaccttgcctttggcagttgagtgctgcccattggccccttccaccccaggatccaattattcccattgtatttaggttttctaattcagtgactgcaggtcctgctgtaaggtgtcacctacagagaagagtgatcacagagcccttcaaggatgctgaggttcccctcacaaatttattcctcaaagtaatagtgagatctgtgtcttctgaactctcccagtgttggtgagtatgtcttaaatgacaaattcactctagcatttcaatctcctttcttctacattaaaccagggcaagtctgaaatttctagtttgctcactgtgggccatcttttggtctgtgtttcagccaaccaattaaactgttagaggccttcctaattccctgagatgcaacattaagtccagaatctctgcttagtgggcccatgtcaataaatttggcctaatccaactttacgtgccttccaccgttatctcacatccttagtacccattcctatacatattctctggattcctgcttgtgtaaattagaaaactcaagtcatgattttggagtgtagtgcaccttgtcatgggtcaccttcatacctcacctcgcctgctgggacttgagtgtagttatagatctaataacaaagaggggtggtagggtgggtcctgaaggaatcagcattatcttgcatggcagttgcctcaggggaagccattacagtttcctcaggcagtgcagggttaatccacttagactggagtagagatactgccaccacagggctggagagaaaactttcactgacaaagaagactcatcaatatttaggagctcaatgtccccagcttaatcagggtcttccacacatacctaatccaacttgtagtgccccattctttcccaatcactgcccttgctttaacagtagacaccctgcaaagctgggagtttggcttgctttgtaattcagttagtcacaggatgagatttggcatttgattttcagcaatctcagctctgtggctacagtagataagggtctccttcagggcatacatagaatctgtcaagtcatttatgcagctcttgagctgggaattcaaattcctgagctcctccttttctttcatcactttttccagcaacattaggagcaaccgactaatcccatcatattcattagtttgacaaatatgttcacaagtgtcaatatacatagtcaccaagacccttgcttcttaaaagtagttgattaggagtatccaatggagatattttgcatatacatattttttgagatggagtctcgctctgtcacccaggccggagtgcagtggcatgatctcagctcactgcaacctccatctcccaggttcaagcgattatcatgcctcagcctcccgagtagttgggattacaggcacctgcctaatttttgtgtttttagtagagacagggtttcatcatgttggccaggctggtctcgaactcctgacctcaggtgatccatccacctcggcctcccaaagtgctgggattacaggcgtgagccaccgcgcccagcctggcctacatatttctattgccagatcatgccatggacaatttttactactgaaaatagtcattagtgtctttaaatttcatcaggttacagaaccaattccagaaatccaataacaaatttataaaatttatccttaaaattctgttcctttagaatcactcttggtgtgaaaatctgtattagtcatggttcccaaagaaacaaaaccagaaccaagaggagatacatacacacacacacacacacacacacacacaaggaattagctcatgtgattatggagtctgccaagtctcaagatctgcagggtgagttggcagcctagagaccccagagagctgattcgtagttccagttcaaagaccagcaggctacagacccagaaagagttaaaatgttttagttcgagcccaaaggcaggaaaaaaactgaagtcccagtttaaaggtagtcaaatagaaggaactgtctcttactaagaggacagtaagcctttttgttatatttaggccttcaactgattggataagttctacccacactggggagaacaatctgctttacttagtctaccaattcaaatgttaatctcaccaaaaaacactctcacagacacacataaaataaagtttaatcaaatatatgggcaccccatggcccagtcaagttgacacataaaattaaccaccataatgaggtatctagagcaggcaaattcataaagacagaaagtagaaaagaggttaccagggtcttggaatggggaagaaatggagagttatttttaatgagtacagagtttctgtttggggtgatgaaaaagttctggaaatggatagtggtaatgggtgcacaatattgtgagtatacttaataccactaaattgtacacttaaaaatgattaaaatggtaaattttatgtatattgtacaacaataaaaaaggctatatcactgacaatgcattgttgtatttagcaaagaaaggggaatctccagcctccccatcaacaaaaacccccacaaacttctattttaaaataatgagctgaaatcatagcggagaggtgaataatgagcaaatataaaaaggaagacctttcctcagacagaatgcccatattaatgttgttactggaagactaagccttgagcaaaatgcaaggagaactcagtgtgagaattctgcattgtcatgaatcccagaaggaagctagagaagttgcagataaatattatcctctggcacctggaagaaccattctcaacctactctagaaaaaaagcacctccagtttaggcctccaggattcctacatattaaaattataagatcacagacatagatcagcaaacatgcaagacaacaagacaacttgagtacaagtgaacagaaacaatcaattcagatttaaaacttgaagaacaccagatattgacattatcggatacataatatgaaataattatgtataaaatctttaaagtaataacatatggaaacatgaaaataaaagacaaattatccaacattattaggcagttgaaaaaaaccattgcaggttacaaagtcaacatgcaaaaatcaattgtatttttatatactaacaattacaaatatgaaaaggaaaacagaaaagtctatttacaatagcatcaaagataatacaatatttaggaataaatttaacgaaggaggtgcaagtcttgtccactaaaaacaaaaaaacccagttgaaagaaactaaagaactgtctggtctgaagacagcaaatatggaaaattagcaactagaaaaaaattaaaaattaaaaattaaaagagaaattaaataactaaataaatgaaaaggcatcctggatttatggatttgaagacataatattcttaagataagaatattaccacaaaccatttgcagattcaaagcaagcattctgggtttttttgtttgtttgtttgttttttgatttgagacggagtctcactctgtcgctcaggctgcagtgtggtggtgcaatctccactcaccataacctctgcttcctgggctcaagcgattctccggcctcaaagcattctctatcagaatcccaaagacatttttttttttgaggaatagaaaaatctatcctaaaattcagatggaatttcaagggaccctgaatagccaaaacaatcttgaaaaagaacaacgttggaggagtcatacttcccaatttcagaacttactacaaagctacaagaatcaaaacagggcagtacttacataaatatagacacatagatcaatggaatagaattgagagtccagaaataagcctatacatctatggtcaattgattttcaataaaagtgccaagaccattttgtgggaaaagaatagtctcttcaacaaatggtgctgggacaattggatatccacatgcaaaagaatgaagttggatctttaccatatacaaaatttaactcaaggctggatgtggtggctcacatctgtaatcccagcactttgggaggctaaggctggtggatcacttgagctcaggagtttgagaccagcctgggcaacacagtgagactctgtatctacaaaacaagaaaaaaaaattagctggcatgatggtacacacctgtagtcccagctactagggaagctgggataggaggatcgcttgagcccaggaggtggaggctgcagtgagccatgatcgcaccactgcactccagcctgggtgtcagagcaagaccctgtctgtaaaaaatcatttaactaaaaatgtatcaaaaaactaaatataaaagctaaaaccataaaactgtaagaaaaaacaaagaggtaaattgttatgatactggatttggcaatggtttcttagatgtgacaccacaatcacaagcaacaactctataaaaatatatatagtaggcatctttaaagttaaaagcttttgtacatcaaagaacactatcaagaaagtaaaaagatgatctacagtataggagaaaaaaattgcaaatcatatatctgataaagggcctagtatcccagaatataaaaagaactcttacaactcaacaacagaaagacaaccaaattttaaaatgggtaaaggacttcaatggaacttctccaaagaagatatacaaggatccaacaaactcatgaaaagatagacaacatcattagttattagggaaatgcaaatcaaaaccacaatgagatagcatttcaaacctgctaggatggctaaattaaaaaaaaaacaaaaacaaaatgtcaagcgggaaaataacaagtgttagcaagaatataaagaaattggaaccttccttgatgatgagaatgtgaaatagggcagccactgtagaaaatattttggcagttcctcagtaaggaaaacatagaattaacatagacccagcaattctactcctgggtgtggacccaaaagaattaaaagcaggcactctaacaaaaactaatatacaaatgcatatagaagtactattcataatagcaaacaggtgaaaacaattcaaatgttcatcaagtgatgaacagataaacaaaatgtggtctatccatatatggactattatttattcataaaaaatcaaagtactgatccatgctaaaacatggatgctccttgaaagcattatgctaagtgaaagcagccaggcacaaaaggccacattccacttatatgaaatacccagaatagcaaatccatagagacagaaaacagattagtggttgccagaagctggcagaaggagtgaatgtggagtggcttcttaataagtattgaatctccttttggggttatagaaatgttctggaactagatagtggtgatggctatataacattgtgaatgtactaaatggcactgaacttcacactttaaaattgttaaaatggtaaattttatgtttgcgaattttgcaatagataagtcagaagacatgtacattaccataatgagtaacaaactgacagctgatttctaaataatagcaaatatcagaaaataatgaatgatgtcttcacaatgctaaaataaacaatgtgaacccctctctcaaaaagaaaacctaatgaaaatatcttttatgcgttaaagcaaaagaggaaattaggacacagacaggcacagagggacgaccacatgaagatatagaaagaggacagacacctacaagccaacgagagaggccttacaagaaaccaacccttagccaggtgtggtagtgtgcacttgtagttcttgttacaagggtgcagtgagctagggttgtgccactgcactccagcctgggaaacagaacaagaccctgcctctaaaaaaaaaaataaagagaaggagaagaagaagaaaaggaaaagaaaaaaaaaaagaaccaagcctgctggccaggcgtggtaactcatgcctgtaatcccagcactttggaaggctgaggcaggaagatcatctgaggtcaggagttcaagaccagcctgcccaacatggtgaaacccccctctactaaaaatacaaaaattagctggacatgctggcatgcgcttgtaatcccagctactcgggaggctgaggcacaagaattgcttgagcccaggaggcagaagttgcagtgagcccagatcgcgccatcacattccagcctggactacagagggagactccatctcaaaaaacaaacagacaaaaaaaaaatacacacacacacacacacacacacacacacacacacaaaacaagcctgcctaccccttgatcttggacttgtagcctccagaactgtgagaaaataaatttctattgtttaagccaggtgtgcgtgtgaaaatttagaacatatgacaacagcaaaaaagtcagcatgtggataaatagaataaaggattctaaaatccatgtattatctaggaggtaaagatgttaatattaaaccttcataatttgattaatgttgtagtttataggatagccagtaagtaatagaaatacacacaatgtaagactcccaaaatggtagaagaaaaaatatgaaaggataaaatatactcaacaaacctaaatgaaagcaagcaaagagagataaagaaacataaaacaggtaggaaaaatagcaagataagatggtatatttaaattgaaatataacagtaatcatatgtaatatgaatggaccaaatatttcagttaaaagacaaagattgtcagattgataaaaaagcaaaagtagctgggtgtgatggctcacacctgtagtcccagctacttaggatgctgatgtgggaggatcacttgagcccaggaggttcagcctggacaagatagtgagacttgtctctttaaaaaaaaaaaaaaaaagcaaaagtaaattgtgtgcattttatgagtcatatctaaaacattagatacagaaaagtagcaagacaaaaatgggaaaagaaattatgcaaatatctaaaagatatcgattacagctctattgatagcagaaaaatagactttaaagcaagaaagtattgctgaagattaagaatgtgatttcatggctggacgcggtggctcacacctgtaatcccagcactttgggaggccgaggcaggtggatcatgaggtcaggaaattgagaccatcctggctaacatggtgaaaccccgtctctactaaaaaaaaatacaaaaattagccgggtgtggtggcggacacctgtagtcccagttactcaggagggtgaggcaggagaatggcgtgaactcgggaggctagattttaacacatctctcgtcaattgatggaacaatgtatagaaatagaacaattaacatgattcacaagtttgatcttatagacatatttagaaaatagcaccttgaaattgcaaaattacaagggtggttccaacatggccgaataggaacagctccagtctacagctcccagcatgaatgacacagaagacaggtgatttctgcatttccaactaaggtaccaggttaatctcactgtggcttgtcggacagtgggtgcaggacagtgggtgcagcccaccgagcatgagccgaagcagggtaaggtatcacctcacccgggaagcacaaggggtcagggaattccctttcctagccaagggaagctgtgacagatggcacctggaaaattgggtcactcccatcctaatactgcgcttttccaatggtcttagcaaacggcacaccaggagattatatcctgcacctggctcagagggtcccacacccacggagcctcgctcattgctagcacagcagtctgagatcaaactgcaaggtggctgcaaggcagggagaggggcacccgccattgctgaggcttgagtaggtaaacaaagcggccaggaagctcgaacttggtggagcccaccgcagctcaaggaggcctgcctgcctctgtacgctccacctttgggggcagggcaaagacaaacaaaaagacagcagtaacctctgcagacttaaatgtccctgtctgacagctttgaagagagtagtggttctcccagcacagagtttgtgatctgagaacggacagactgcctcctcaagtgggtccctgacccccgagtagcctaactgggaggcacgccccagtaggggcagactgacacctcacacagctgggtacccctctgagaccaagcttccagaggaacgatcaggcagcaacatttgctgttcagcaatattcgctcttctgcagcctctgctgctgatacccaggcaaacagggtctggagcggacctccagcaaactccaacagacctgcagctgagggtcctgtctgttagaaggaaaactaacaaacagaaaggacatccacaccaaaaccccatctgtacatcaccatcatcaaagaccaaaggtagataaaaccacaaagatggggaaaaaacagagcagaaaagctgaaaattctaaaaatcagagtacctctcctactccaaaggaacgcagctcctcgccagcaacggaacaaagctggacagaaaatgactttgacgagttgagagaagaaggcttcagatgatcaaacttctctgagctaaaggaggaagttcgaacccatcacaaagaagctaaaaaccttgaaaaaaaaggttagatgaatggctaactagaataaccagtatagagaagtccttaaatgacctgatggagctgaaaaccatggcacgagaactatgtgacgaatgcataagctttagtagccgatgcgatcaactggaagaaagggtatcagtgattgaagatcaaatgaatgaaatgaagcgagaagagaagtttagagaaaaaagaataaaaagaaatgaacaaagcctccaagaaatatgggactatgtgaaaagaccaaatctatgtctgattagtgtacctgaaagtgacagggagaatggaaccaagttggaaaacactctgcaggatattatccaggagaacttccccaacctagcaaggcaggccaacattcaaattcaggaaatacagagaacgccacaaagatactccttgagaagagcaactccaagacacataactgtcagattcaccaaagttgaaatgaaggaaaaaatgttaagggcagccagacagaaagttcgggttacccgcaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcttgccctacaagagctcctgaaggaagcactaaacatagaaaggaacaaccggtaccagccactgcaaaaacatcccaaattgtaaagaccatcgatgctaggaagaaactgcatcaactaatgagcaaaataaccagctaacatcataatgacaggatcaaattcacacataacaatattaaccttaaacataaatgggctaactgctccaattaaaagacacagactggcacattggataaagagtcaagacccatcagtgtgctgtattcaggagacccatctcacatgcagagactcacataggctcgaaataaagggatggaggaagatctaccaagcaaatggaaaacaaaaaaagaaaagcaggggttgcaatcctagtctctgataaaacagactttaaaccaacaaagatcaaaagagacaaggccattacataatggtaaagggatcaattcaacaagaagagctaactatccaaaatatatatgcacccaatacaggagcacccagattcataaagcaagtccttagagacctacaaagagacttagactcccacacaataataatgggagactttaacaccccactgtcaacattagacagttcaacgagacagaaagttaacaaggatatccaggaattgaactcagctctgcagcaagcggacctaatagacatctacagaactctccatcccaaatcaacagaatatacattcttctcagcaccacatccaaaactgaccacatagttggaagtaaagcactcctcagcaaatgtaaaagaacagaaattataacaaactgtctctcaggccacagtgcaatcaaactagaactcaggattaagaaactcattcaaaaccgctcaactacatggaaactgaacaacctgctcctgaatgactactgggtacatagcgaaatgaaggcagaaataaagatgttctttgaaaccaatgagaacaaagacacaatataccagaatctctgggacacatttaaagcagtgtgtagaggaaaatttatagcactaagtgcccacaggagaaagcaggaaagatcaaaaattgacaccctaacatcacaatttaaagaactagagaagcaagagcaaacacattcaaaagctggcagaaggcaagaaataactaagatcagagcagaactgaaggagatagagacacaaaaaaccctttaaaaaatcaatgaatccaggaactggttttttgaaaagatcaacaaaattgatagaacactagcaagactaataaagaagaaaagagagaagaatcaaatagacgcaataaaaaatgataaaggggatatcaccaccaatcccacagaaatacaaactaccatcagagaatactataaacacctctatgtaaataaactagaaaatctagaagaaatggataaattcctggacacatacaccctcccaagactaaaccaggaagaagttgaatccctgaatagaccaataacaggctctgaaattgaggcaataattaatagcttaccaaccaaaaaaagtccaggaccagacggattcacactcaaattctaccagaactacaaggaggagctggtaccattccttctgaaactattccaatcaatagaaaaagatggaatcctccctaactcattttatgaggccagcatcatcctgataccaaagcctggcagagaaacaacaaaaaaagagaattttagaccaatatccctgatgaacattgatgcaaaaatcctcaataaaatactggcaaaccaaatccagcagcacatcaaaaagcttatccaccatgatcaagtgggcttcatctctgggatgcaaggctggttcaacatacgaaaatcaataaacgtaatccagcatataaacagaaccaaagacaaaaaccacatgattatctcaatagatgcagaaaaggcctttgacaaaattcaacaacacttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgttcgcagacgacatgattgtatatctagaaaacaccattgtctcagcccaaaatctccttatgctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatatgaaggacctcttcaaggagaactacaaaccactgctcaatgaaataaaaggggatacaaacaaatggaagaacattccatgctcatgggtaggaagaatcaatattgtgaaaatggccatactgcccaaggtattttatagattcaatgccatccccatcatgctaccaatgactttctttacagaattctaaaaaactattttaaagttcatttggaaccaaaaaagagcccgcattgccaagtcaatcctaagccaaaagaacaaagctggaggcatcacgctacctgacttcaaactatactacacggctacagtaaccaaaacagcatggtactggtaccaaaacagagatatagaccaatggaacagaacagagccctcagaagtaataccacacatctacaaccatctgatctttgacaaacctgacaaaaacaagaaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattgacaaatgggatctaatgaaactaaagagcttccgcacagcaaaagaaactaccatcccagtgaacaggcgagctacaaattgggagaaaatgtttgcaatctattcatctgacaaagggctaatatccagaatctacgaagaactcaaacaaacttacaagaaaaaaagaccccatcaaaaagtgggtgaaggatataaacagacacttctcaaaagaagacatttatgcagccaacagatacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacgcttttacactgttggtgggactgtaaactagttcaacaattgtggaagacagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaggatctgttcatgtcctttgtagggacatggatgaagctggaaaccatcattctcaaaaactatcacaaggacaaaaaaccaaacaccgcatgttctcactcgtaggtgggaattgaacaataagaacacttggacacaggtaggggaacatcacacaccggggcctgtcatggggtgggtggacaggggagggatagcattaggagatatacctaatgtaaatgacgagttaatgggtgcagcacaccaacatggcacatgtatacatatgtaacaaacctgcacgttgtgcacatgtaccctagaacttacagtataataaaaaaaaagaaattgcaaaattacacattctttgtaagcacacaaaggaaacatgttagaattttccattttaagctacaaataagctacaaataaagtagtctcaaatttcagataatataaaacatgttttctggtcacaatacaattaaagttgatataaataagaaagataactataaaatcttcctatgttagaatcaagaactatacttttaaacccatgtgtcaaataagaaatcataaattagaaaatattttaaactgaatgataacaaggcatgacatattaaaatgtgggaatcagctaaagcaatatttagaaagaaatgtatagcgttaaaaacatatattggaagagaagaaagcctgacaattaatgagctaaggtatgtctcaagaagctagtgaaacagcaaaataaaccaaaaggaagtagaagcaaggaaataataaagatatgaagtaaatgaagtaaaaaagaaacatacaatagagagaataaagaaaaccaaaagttggttccttgaaaattgacaaacttctggcaagagcaatcaagatgaaaagaaggcacaaataatatcagaaactttaaaaaactggacatcaataaagatcccacaaaaatttctgccaatataaaaatataaaaaatgaggatacttattaatattaaatgttctttcttgttgtatttaccagggattaatccattttacctaattttccaaacttagtgttaaaaggttattaatttaaaaaatccagatccagatggctacactaactatattctaccaatttttcaaaggagaaataatattaaccttgcaaaaattctttcagaaaatggaaaaagatggaatgttattcaattatcttatgataatagcataaccttgacaaccaaaccgaacaagaacaatattagaaaggaagataataggcccgttttattcataaacataaatcccaaacaaaatattagcaatatggatccaaattggatttatgctaggaatgcaagtttggcttatacattagaaaactgatataatttatcacagtgacagactgaaggattatacatattggctgtcctaagcagtgcaataagatgagaaaaagaaggaaaatatgtaaggattgaatatgatgaaacaaactcattgtatgtggaagatatgatggcatagatagaaaatccaaaggaatttatatataaattattagaatttttaaaatttttcaagcttgctgaaaacaaaataaataccaaaattaattgtatttctgtatacctgaaacagttggaaaaatagttttaaatagcatttaaaaattccaagcaggagttgcacattcctgtcagataatggcagctgcctaaatctctccacagtcttcaaaaaccatacatacacatacacacacaattttaaattatgactaaaaccacccataacccatctatagaataaccagaagacaaaaagtactataagtttatatttacaagtagaaaataaatatataaatctagccaaccttgctccagagagaaaccctgtctcaaaaaaaaaaaaaaaaaaaaaaagaagaaagcaaatgttggaaattaactgtcctataaaaacaaaagtgaattactaaatcacaagacccacaaacctctttggtcacatctattaaataaattacacttccatttatcaacagtagagggtactcctggctaagaaacctagtaagccacccagccctcatgtctgcctgcataaatcacctcttattgctgaaacaagaaaatgtaaggaatttctaaatgaacagaaaatagcatatgaagcagatggtattaatgttcttgagtttttattccctctttccttgaaaacctcatcaactttaggcatggccgtacggctcatcttgatcaatagaatgtgattggacatgacatatataccacttccaaatagaagctttaaatgtgattttgtgtttgacacactcttttgtgcctctgctccaggctccagactttaagcctctagaacgataagtgaataaatttcttttgttttaaaggcaccaagtgtgtggtgaatttgttacagtagccctagaaatctaatactaacaaaaagaatgttagagttgaattagaagtgtcagtgagaacttaggaatttaaaaaatcatattcttagcactgttcactgagggaatctagaagtaattacactgcagtaataacgagcccatcccatgcccaaatcttggtctctaactaccattttccagtcaaaagaatctgagctccctagagaaatgactttttcaaggctggatcaaggaaactgccaggcaatcttagatgatcttggtgatcttgatgtgccagaagattaatgggatcatgtgaaaagaacacagaaactggtctgaagggcttcctgttggccagatttgagacaatttgagcatcaaaaggaataatgagggtaatggatcataactggaaaatcagtttgcaaccatcaatgtacttactattgaatacttgtaaagaactttaagggttgctaataccattggataaaagcttgttgtgaaacagaatatttgcatggtctcaaagtctcactccacagattgttaggaaagggaaagggttacctttataaatatagagattaggtggacatcttaaccaagtgatcaaacttagcatcatcaataatgggacaatctggcatcgcatgccccctgatttaatgcagtaaggattaagtctaacaaaagatgtacaaagcctccaaatacagcgtaaacatttgtaaaataatctcagaacagggaccttaatgtttctcaaaaatttttccaaatacagaactttatttctatagatgtttatggtatatttgccatgctatatacattatgctatatattctatgtgctgaagatacaacaatgaccaaggtctttgcccttgtggaactgacatttggtggcggagacagaggaaacagtcaataagcatgtaaagagataaaggaaaagatactgaatgctacaaaggaaacaaataagttgagatttagaacaaaaaagagtcctattttacaagaggaataatgaggaagacctttctaaagaggtagctcagcactttgggaggccgaggcgggtggatcacgaggtcaggagatcaagaccatcctggctaacacagtgaaaccccatctctactaaaaatacaaaaaatgagccgggcatggtggcgggcacctgtagtcccagctacttgggaggctgaggcaggagaatggcgtgaacccgggaggcggagcttgcagtgagccgagatggtgccactgcactccagcctgggcgacagagcgagactccgtctcaaaaaaaaaaaaaaaaattgaggcagaatttcgctatgttgcctaggcttgtctcaaactcctgggctcaagcaatcctcctgcctcagcctgctgagtagctgggactccaggggcatgccactatgcttagtttaagaggtggtatttaaactgagacccgaagggtaaaaaacatggataaaagaagaaacagaaggggtaagagccttccaagcagagggaatcacatatacaaaggctctcatgttaaataaaacaagagttgacattgttgagaaactgaaagatcagctcatctgcgatgcggtaaaataggaggaatgcagtgggagaacagatcagagacttgggcaggggctatattaggcagaacttggagaccagagtaagggggccaaggtgggaacagaccgattaaattggcatctcttgggggggtgggggggtggggaacttacccatgcatcattttttaaaagctccaaaggcgattccaataagcagccagggttgggaacctagggggaaaatgtagctagatgaatgaagatggcccaaacgtcttttgttctgatagctaaactctctgtaggatcacagtgttacttcacagtgcatttgccaggaaaagtctcttcccatttggaatccgaagtaaaactgacaccacacttgaagatgccaggattgttagaggaaaatgtcacccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttcagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggagacaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacata

SEQ ID NO: 4102 - DNA, 42239 bp, human
attcccacggcggcagcggaagagggagggccgggcgcgccgcggctgcttgcagtctccgcaagcggctacatcacagagctcagcgtgcggtgtcacaggccccgcggtcccgcccaacagatgcaccgagatgcgcgtgcgcagaaagcgtcccgggggtgaggctccctccctcgctctccctctactcccgccccactctcccccactttcccccctccacccaccgcggccgtcggggctcgctcgctcagtacctggaggcgagttcctgacgcgactgcgactcaatcctcgcctggtgaagaatattttacctatgactcactgaaaataaagacggctgagtgaccgtgtttgttcatgtaaacattgaacaaatatttatcggcttctgcgatgtgtcctactcttttagtggaggaagacacattttatttatgtatttaatttttcttttgaattttacatgcgagttatacttaataaaactcacttcaaaatataccttcaacagaaaatccagcaacagtttctattatgttagttaaaacagccagtcttttcctttacttttaaaaattattcataaatgtaattagtgaatgataataaacattgacatctgatccactgctttaggagtgacacaaatgaagttaactcaggctattttctttataatcattgtgctattgttttctttttcttttcaattatactgcttaatataggattttgtggcaccataggagttgagtaaaaataaaaggaataaaaatataccttatctggccgggcgcggtggctcacgcctgtaatttcagcagtttcggaggccgaggcgggcggatcacgcggtcaggagatcgaggccatcctggctaacatggtgaaaccccgtctctactaaaaatacaaaaaattagccgggcatggtggcggccgcctgtagtcccagctactcgggaggctgaggcaggagaatggcgtgaacccgggaggcggagcttgcagtgagccgagatcgcgacactgcactccagcctgggcgacagagtgagactgcgtctccaaaaaaaaaagaaaaaatacgttatctatgaagatttccaatttgatttctatttatcacaaatggccacagtactcctttgtactttaccacataccatattgtattcagtaattatttgtgaatatgtaattgataatattgtaggttttagagaatccttgaaaacatgaaaatttggtaatggggtctattttgattatttatttatttatttatttattttatttttgagacagagtctcgctcttgttgcccaggctggagtgcagtggcgcgatctcggctcactgcaagctccacctcccgggttcaagcgattctcctgcctcagcctcccaagtagctgggactacaggcacgtgccaccatgcccggctaattttttgtatttttagtagaggaggagtttcatcttgttagctaggatggtctagatctcctgacctcgtgatctgcccgcctcagcctcccaaagtgctgggattacaggtgtgagccaccgtgcccggccatattttgatttaaaatttagcaataatagataaaattttcaatcaactaagcccttgggccagggaatgctattccttaaaaagtgcttctatcaatatagcctctgactcattactttgttaatttttaaattgtatttcattcctgattaacattcccacccagattattaattatacaatctgttaactgtagaacctcaaacatgttggattgtactgtatttgtctggaagacacatttttaaaacattgtaatcgctataagagaagcactgggaaagaaaggagcttctatgcctgcagtgcctgaggagccctttaacagtgtgccccgcccctaagctactcatgcagtcatccccatcccagttagtcaactttattccaaaaaacttggtgttccaaatttttccttctcaaagcccacagatccaaaattcatcagcagttcccacaaacgttaccctcacaatgaatccagccatttttcaccctctccagtggtaccatcatagcccaagccgccaccatttctcacccccggttaacaggccaccctccttctacccttatcctgctagagtttgttttatctacagtgatcagaaagatcagcctaaaagataattctgatcaccaccctcctctactcacaacccggccgtgtctccccattgccctcagtgtagaagtcaatgtccctttgctgaaatgcaaccttagtgaaactttccatgactaacctcctttaaaattgcaacctggtccacccttactcccccttaccccacttctcttttttgcacagcacttattttaccttctaacatactgtataatgtactcatgtattgtaattattgcttatcatccctctttcagttgcttatatttttcatcaatgtgtacccagtgcctaggacaatatctgtctaggacaaatgggtagttatgtggctgtaggcaagccatttaacctctctgtacctcagttactttatctgtatccactttgcggtgttgtcatgaggattaaatcagatagcctatgtgtagcacctggcagtgaatttatcaccctgtactgtaactgtctacttttctgtctcctccattggactgtcattcccagggggttgggaactgggatttcttcatttctgaggcatagaagtatagcatagtggttaggagcatgacttctggagccagagtacatgggtttgaatgctaccactcacaagctgtgtggccatggagaagttgcctaacctctccgtgcttcagtttcatcacccataaaatgaaggtaagaatagtacctgtatttaaaagcacctagaacagttcctggcatatagtgtcagctgtcatctctgcatccttgtacctgtcagagaggagtgtttatcaaaggggcttcttgctgcctgtttccaaaccagtcgacaatataccaattgctccctaacacattcttgtttgtgcagaactgagctcaatgataacatttttatagcaaccctgatcaagtttcttctcataatctcttacactttgaggcccctgcaggggccctcactctccctaataaacattaacctgagtagggtgtttgagctcaccatggctacattctgatgtaaagagatatatcctatacctgggccaaatgtaaacagcctggaaaagtgttaggttaaaaacaaaacaaaataaataaatgaataaatgccaggtggttatgagtgctattgagaaaaatgaagccaagagggatatcagtgatgcaggtgggggtaaagagcttacaacataaatgtggtgttccatatttaaacctcattcaacagggaagattggagctgaaatgtgaaggagttgtgggagtggaactacgtggaaatctgggggaaaggtgttttgggtaaaagaaatagcaagtgttgaggtccaggggcatgagtgtgcttgatattttagggaagagtaaggagaccagtataaccagagtgagatgagactacagaggtcaggagaaagggcatgcagaccatgtgggatgctctaggacctaggccatggtaaagatgtagggttttaccctgatggaggtcagaagccattggaggattctgagaagaggagtgacaggactcgctttatagttttaaattataactataaattatagtttttaaaacaatagttgcctaacctcatgttatatgtaaaactacagttttaaaaactataaattcctcatactggcagcagtgtgaggggcaagggcaaaagcagagagactaacaggttgctggttactcttgctagtgcaagtgaattctagaatcttcgacaacatccagaacttctcttgctgctgccactcaggaagagggttggagtaggctaggaataggagcacaaattaaagctcctgttcactttgacttctccatccctctcctcctttccttaaaggttctgattaaagcagacttatgcccctactgctctcagaagtgaatgggttaagtttagcagcctcccttttgctacttcagttcttcctgtggctgcttcccactgataaaaaggaagcaatcctatcggttactgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaaggtaaaggcatgtcctgtagggtctgatcggggccaggattgtggggatgtaagtctgcttggaggaaggtgcagacatcgggttaggatggttgtgatgctacctgggccccaaagaaacatttctgggtaaggtgtgcacacatctgtgttattagcagaaatgctaactgccaattcttttcataggtctgacctatttgttgatattttgttctgttttgtccattgcttctcttcgtcatatgctgctcctccagaatctagagactggagtagagggagggtgaagggacaaagacaaaacttccctctgcctgcccaagcttccatagagagaatcaaggcaatgaaatccaatcaatatcacacacaagtttcatgtctggttctcttgtgtgtacatgcaatgtgtgtttttataatatcttttcctactttgggtgtaaggataatatgagccttgagttcagaagcttttcgtgttttgggggttctggtgcatttaggcagagtattaaataactttatcaatattgtctatggtcatcagttgattcagatttttctacctcttcttcagtaaatattggtatattttggtctatactttcatagaaagcaatctactgtccctagatttgataatgtattggtatcaagttatgtaagagtctcctgtgattttgttaaactgttctgtgtctgtagttatattttctttttcattccttatgttgtatatgttctcttcctctcttttaaaaataatatttccaggagttttcttgattttattggtcttgtcaagaattttcttttggtttgatttatcaatctcttttttctttctgttgcatcagtttctgcttctactttcattgatttattccttccttctaatttcctttggttcattttgttgttagatttttgcttcttgagttgaatgctgaaatcatttattttatttttttgtcttctttaaatgtgtattataaagatttaaatataatacatagattgtggctgtgtaaacattaaatgtggtcatgttgtacatactttatattctttttggttctttctgtttggctccccaccctctttccacatcagtccccttctcccccacctcagctaggtaaccccagtatgataatatatattcacatacacatacacacacacaaaggttttcttggacattatttgttttataaaattgggacattatacacacatttctcactcattaacacgtactagaactctaagtcaattggtatagctttaattcattatttttattggctatataagattctatggtatggctgtatcacaatttagtcaatatgttcactttattccagtttttggctactatatcctatatcattacatactggtgcttttacttctgttgaacaaacttgcaagaggaatattaatggaacgaagggaatgtttccttctaagttttaatttccaaagaggtcagaacttttcaaacatttctaccatcgaagtatgaaaatggccttctctctgcattcacatagcgataagttttatcctgtttttaaaatttgccaattttacaggtgtagagtgatattgcatcattactttcattgtgttatttttatttctaataagttgagcatctttttaaatgcttgttggctattggatttatttgggggatttaattagtcatatgatttgcccattattctttggactctttcatttaaaaaaattatgagaacccttttattattacaaatattaactctttgtcatgtatattgcagttttccccaagatctattgtttgtctgttgactttcttataacttttaccaaaacagtttttaatttttataatcagagatatcttttctttcatatcttcagagtcggcaaggttggttaaaaatgtttcccacacctcaagattgtacgtgtaatctcccagattttcttgcaagatgtttactgtttcgctttttatatgcattgcttcaattatctgctaattacttttgtcatatggcatgagagagggatttgtctagttttatttccatccagatcaatagcctattgtgatggcaccttttgccactgatttgaatcaacacattcatcatataaagttctcatatatattagcatatatttctggattcattaggctgtttcactaatctactattatcttgctatgccagtaccatagtgatttgattacagtgagcctatgatatcttctgatatctggtgggtgaaagcaatcctcactattctttttgtacctttcttagctattcttagacactttattcttccacataaaactgttaagatatttttcaaattaaaaagatccaagccctgttgtgattctaactgcaatttcattaaactcagaccttaattttattaatgtaataaatttaaatatttttcttattacatttatctctgtgtattttataagtgtgatgctattgttaataagatagttttctcctatttccatttatgagtgcttagtaccaaatagagataagctattggtttgtgtattttcagctttttcttttgagcctgggtctcattttgtcacccaggctggagtgcagtggggtgatctcaccttactgcagcctcaacctcctggattcaagcaattctcctgtatatcagccccccaagtagctgggactacaggagcaggccaccatgcccggaaaatttttgtatattttttagagatgggtttttgccatgttacccaggctggttttcaactcctgagctcaagcattccccccacctcagcctcccaaagagctaggattacaggtttgagccaccgcacccagccattgtatattcatcttaaatctagctaccttaccaaatttgcctattaattctagtaattttaccctaaagtctctgtgagtattgaatcatatcataagttaaatgagacagattttagctcatttccaatatttatagccagttatttcattttcttatcttattgaatttattagaaaacaagagcaaatgttaaataataacaatgaaagtgaacattccttctactctatgattttacttgaaataatttttgtattttgctatttagagtaacatttgctgttttggtttttgtaaatggtgtttattctattctcatttgccacaaaatgtttatcataaataagttttcagcagctggtatcatctgaattgtcttctttgatatgctgatgaacaaattatgttcatagatgtcctgacactaaatacccttacattcttggagtaaaatctactattcatggaatttgatcattagtgggttctatgtactatttctttagactattcttagtagattttcactactcaacctactaataataataaacaaagttttgttggctttatcaaatgaattgatgagtactccatctttttctattgcttagaatagcttaagtaacatttgaattatccattgtctaaaagttaggtgagactcacttatgaatccatttggtcctagtggcatttgcaatatctttaatcacccctccaggctcttctatgataatcagtcaattcaagtttcaacttccaataattatatacctttctaggaagtaactttatttattttttcaattttgttgccacagtgttgcatgtagcactcactcatgattcttttactccacattatctgtagttatgtgccctttcttattcctaaattcctctatctttgctatttatctttttttccttgaataagcttgccaatgacttgtctattttgttgctggtggtgctcttttcaaagaatgggcttttggattttttttttttctagttggtataaagcatttttattttcactgagcagaaaaagaagctattgattcattaactgtgctgctttattggcatgtagctatgcactgttcacacattaatatataaaactcgtcagtctgttttattttgtctgatgggaaaacatgaacagtgagatttcttatgcaaaaagtgaacagttcaactatgctagctccatatacctttattaacattccagagacttatcctctcaacatgatctgatttctgtaggataacttttcaggaaaagtattttctgatcagtgaagcttggagatataaataagcaatcggccaggtatggtggttcatgcctgtaatcccagcactttgggaggccgaggcaggcagatcacctgaggtcaggagtttgacaccagcctagccaacatggcaaaactccgtgtctaccaaaaaaaaaaaaaaaattagctgggcatggtggtgctcacctgtaatcccagctactgaggaggctgaggcaggagaattgcttgaacctaggaggcggaggtggcagtgagctaagattgtgctcagcctaggtgacagagtgagactccatttcaaaaaataaaaaaataaaaaaaagcagtatctctcatattcattaactggaccctgactttcttaaagctcaccccaaagctgaagtccatgaaggcactagttctcaaacttcagtgtgcataagaatcactcgggaagcttattaaaatttacattcctaggccccatcctcagcaaactatttagtccccaggtaattctatcccaccccaccccagctttattgtggtataattgacaaataaaagttgtatatatttaaggtgtacaagataatgttttgatgtaagtatacattgtaaaatggtatagcatgaagggttttcttttcatttttttcagaatagtttgtaatatcttctttgatttcatctttgataatctagacgtatgattttaattgctttttaaatttgtttatcaagttagtttgtagtatttgggtcaacattgaatatcctgttaatttcctattgctgtgtaacaaactacatcaaatgtatcagcttatgacagacccatttactgtctcacagtttctgtgagttagaagtccaggtggactcagctggatactctgtgcagggtcatacaaggccaacaccaaggttttaatagggctgcactccttagtgaaagctcttggggagaatctgcttacaggctcatttggaatgttagcaaattcagttccttctctcactttccatgtagtgccctctaccagcaatggtgcatcaacactctctcatgcttggaattgctctgacttcaattttccgtgcatatctctggccttttttgcctctctcttttacttttaaggactcatgtgattacattgggccgacctgggtaattcagaatactctccccatctcaaggtcagctaatcagccccttaattccatctgcaaagtttaatttgccacataatatatttttggacatgacaccaaggagcaaaggtgatgtgggccaaatttttacctgccacaggtatagtttacatacaatgaagctcatcaattttaaatatgcagtttgatgagttttgacaaatgcatacacttgcataaccaccaccctaatcaacatgcatttacatcaaccctcctgcaactttttaatgagtctctcccactgacctggcctcagccaataaactgctatctggaagttacagatttgttttcacatgttctagaattttacatcagtggaatcatacggtatgtattcttctatggctttttttcttcagcatcatgatttggaaattcatgcaggttgttgtataaagtatttctatcctttttattgctgattactgctccattatgggattatatcataattttggattatttccagttaggagcaaatacaaataaacctgctatgaacagtgctccacatgttttgtgtgaacatctattttcatttatcttagttaaatatctaggagtggaattgctggatcatatggtaagtgcatgtttaagagaaactgccagacagatttcttgaacgtaccattctatactcccaccagcaatgcatgagagttccagttgcaatatatcctggacaacatttgatgttgccagtacttaatgactgcacagtggtatctcactatacttttttttttttttgagatggaatctcatcccatcacacaggctggagtgcagtggcgcaatctcagctcaacatctgcctcctaggctcaagcaattctcatgcctcagcctcctgagtagctaggactatggtcacacgccaccgtgcccagctaatttttgtatttttggtagagacggggttttgccatgttggccaggctggtctcaaactcctggcctcaagtgatccacccgcctcggcctcccaaaatgttgggattacggcttgagccactgcacctggttatacttttaatttgcgtgtctctgatgactaaagatgttgagcatctttgcatgtgctaattagccattcctatatcttcttggaagtgtctattcaaatcattggtcctttgtttttaaacgtagtttcaacttttattttagactgaggaggtacatgtgcaggtttgttacatgagtatgttgcatggtgctgaagtttgggttacgaatgaatgatcctgtcactgaagtagtgaacatagtacccaataggtggtttttcactccttgctacccttcctcctccctctttcctctagtcgtctccagtgtctattattctatgtccatgtgttctcatcatttagctcccacttctaagtgagaacatatggtatttggttttcagttcctgtgttaattcacttaggataatggtttgccagtttttaattgggttgtttgtcttgttattgttgagttttgataattttttatatattctgggtacaagactattcagaggtacctgttttgaatgtttttttccaatctatggcttgcattttcattttccaaatggtgtctttcaaatagtggaaatttatagttgtagttaagtccaatttagcttttcttcttctatgattcatgcttttttttcccctgtcctaggaaatctttgcccacctcaagttcacaaagcctttcttctgttttcttctagaacttttatcattttagcattagtatttaggtttataatacattttgagttaaattttctgtatggtgtgacttttctttctctattgaattcccttggtgcctttgtagaaaattaaatgactgtatataggcaaatctgtttatggattctctagttccatagatgtgtatatctgtgcttatgccagtaccagattgttttgattgttgtaactttatagtaagtcttaatatcaggcagtctaaaacctccaacttacttttttattgaaattgcttttgatatatttaggcttttatatttctgtattaattttatagtcaactagccaactccaccaaatagccaactgggattttgactggaattgaattgaatctgtagatcaatttggggagaattgacatttaaacaatactgaatctttcaatacaacaacatggtatggctttgtttctttaaattttctttaatttccctctaggatattttgtagcctacagagtagttcttgcaagaattatattaattgtatccccaagtattttgagggattcgatgctattgttaattgtatcatttttatttgttttcgttttccaatcatttgttactaaaatatagaaattcaattgatttttgtatattgaccttgttcactctaatcttgttaatttgcattttagctctagtagcgttttgcacttcttttagaatttctacatatacaataatgttgtctgcaaataaagacagtttgcttcttcctttccaaactggatgctttttattttttttttcatgccttactgtactggcaagggcctccagtacaatgttagatagaactgatgatagcagaatccttgtcttcttcctgatttcagagggaaaatattcattattttaccattaagtacaattacttgtaaattttttcatagatgccctttgtcaaattgaggaagtttccttctattcttggtgtgagagtttttatcaagatttgatattagattttgtcaaatgctttttctgcatctattcaaatggtcatatggtttatcttgtttattctgttatggtgaattaccttgattgattttttaatgaggaactagctatgtattcccagggaaaaaatccacctggttgtgacatattacattggtaatattttcgctatggactgaattgtctccacctccccccaccccaaattcatatgttgaagtcctaactctcaagatgattatatttggagatagggcttttaggaggtaaacaaggttaaatgaggccataaggatggagtcctaatctgataggactggtggcctcataagaagagagaaggttctctctctacactcatgcactgaggaaaagccatgtgaacatacagcgagaaggcagccatctaccagctgggaagagggctccactagaaactgaccgtgctggcaccctgatattggatttccagcctccggaactgtgagaaaataagtttctgttgtttaagtcacccaatctctagtattttgttatggcagccctggccaactaaaactgttttgttaagggttttggtggtgatggtggttttttagtttttgcgtctgtgttcatgatggatatttggctgtgattttcttataatgtcattgtctggttttgatataagagtggtattagtccgttctaatgctgctatgaggacatacccgagactgggtaatttataaaggaaagagatttaatggactcacagttccacatggctggggaggcctcacaatcatggtggaaggcaaaggaggagcaaagacacatcttatatggcatggtggcagacaagagagcattgtacaggagaactgccctttataaaaccatcagccctcatgagacttattcactataatgtgaacagcatgggaaaaccccactgccatgattcaattacctcccacctggtccctctcacagcacatggggattgtgggagctacaattcaagatgagatttaggtggggacacagccaaaccatatcaaagagtaagactattctttttttttttttttttttttttgagacggagtctcgctctgtcacccaggctggagtgcagtggtgcgatctcggctcactgcaagctccgcctcccgggttcacgccattctcctgcctcagcctcccgagtagctgggacgacaggcgcccgccaccacgcctggctaattttttatactgatagtagagacggggtttcaccgtgttagccaggatagtctcgatctcctgacctcatgatccgcccacctcggcctcccaaagtgctgggattacaagcgtgagccaccgcgcccggctgactattcttataaaatgagttgagacgtgttcactcttctatttaatgaaagagtttgtgtagaattggtatcatttcttttttaaatgtttattcaccagggaaatcatcttatcccagtgttttttgttttggtttggttttttttttaagggtcttaattgtgaattctatttttaataggtaaagggctatttgaattttctatttcttataggataaattttaataatttcttttaagaaattccatttgagactgggcatggtggctcacacctgtaaccccaacactttgggaggaggcagcaggattgctctaggccaggagtttgagatcagcctgggcaacataacaagacttgacttctacagaattttttttcattagccaagtgtggtaacatatgcctgtagtcccagctacttggaaggctgaggcaggaggatcacttgagcccaagagttcaaggctgcaattaactatggatcatgctactgcactccagcctgagcaacaaagcaaggctctgtctcaaaaaaagaaaagaaattccatctgagctgttgaatttaatagtataaagttcagaatatttccttaccattttttcactccttggaggtatgatttacatactgtaaaaatcacttattttcagtgtggagattcttttcctttcctaaatctccacatttttattgacatatactttacatatcataaaattcaccatttgaaagtgtacaattcagtggtttttagtgaatccgtaaagtgtacaactatcatctttatttaattccagaatattttcatcacctcaaaaagaaaccctgtaatcattaaacagtcacttctaattttcttcctttccccagcccctggcaaccattaacctactttccgtcactgtggttttgcctattctggatatttcatgtaaatgaagggataaaatatgtggccttttgtgtctagcatcttttgcttagcatgttttcaagattcttccatttttgcagaatgatagaggagttaaaataagaaaataaagatatagtaagaatgaaactattttcattttttaatttaaaaaaatcttccatgttgtagtatgtatcagaatttaactcctttttatggctgaataatactccattgtatggatagaccacattttgtttatccattcatctgttgatggacttttggattgtttccccttttggctattatgaataatgctgctatagaacattcatgtacaagtctttgtgtacatatgcttttatttctcttcggaatatacttaggaatataattgctaggtcacatggtaattctatgtttaacttttagaggaactgccagactttttcaaagcagctgcaccattttacattttcactaccaaagtatgagtgttccaatttttccatattcttatcaacacttgttactgtctgtctttttaattatactcatcctagtgtggataaagtgatatctcattgtagtttggatttgcatttccctgatgacttacgttgttgagagtcttttcatgtgtttattgaccatttgtgtatctcctttggagaaatgtctatttaaatgctttgcgtgtttttaattggattatttgttttttagtactgagttgtataagttctttatttattcttaatattatacccttatcagagctatgacatgaaaatattttttcccattctgtgggtagtattttcactttcctaatagtatcctgtgatgcacaaagtttttcattttgatgaaatccaatatttatttattttacccctttggttgcttgtatttttgttgtcatatctaagaaatcaatgtcaaatcaaagatcactaagatttaaacctatattttcttttgagacttttatagttttagttcttacattgaggtcattgatccacttggagttaattttggtatatggtgtgaggaggggatccaagttcgttctacagcctatatagcctgcagatgagcaatgttagtgaccttgaaagtagaggcccaggttgtcagtagcctggcatctaactaaacaaccatttatccattaaagttagccctgttaacaattaatattgagataattttacttaatacactgtgtatattagtgtccatctagcatgcagcctgaggcacagagaataatagtttgagtataaaattgaattgaatggaatacatcattaatttattatctagctttctgttattgtataggcagtcacatgtatttaccagaaaaaagttgatagaatttttattttaatgaaacccttttatactttagattattttgatgctgattaacaggataagctgactctggacacatcctgacagcctctgccaaggtttgaaataaacagctgggaaaattcagttttatattatctgttcccgcagctgctcagtttcttctaaccacaggtcagggaatataataggttttccgattagttttagataaaatgtgaaagaacagttcatgtcaaggacaatggttgccaaatatatttggcaggatttctatattgaatcccaaaggaaatacacaaacaaaaccccacaaaagttaggaaggagtaaaacccaggaaccctggaacattttgtcatttactatgcagatttgcctgaaagtgagacaggcaaataaatcacatgtttctgccagcgtggaaaatattcactcaaatggcaaaggtctcaggctggggagctggatattgtcctgtaataggttcatctcagaactgaatcacacacttggagggtgttaatgctcttaggaacatctagttattccctttgaatagagtcctgtcctgaatcacatatacttgacctagggcctaggcctttttgtttttctgtctcacaatcttgtttctccatcaattatgtgttttcactcttccctcagagagggaaaaagtgtttctgtgtgctcttgatcctgttccctctctgatcttccaatctattgctctataacatattttatatgtgtcttatatcttcattttagtcagaaacatttatttatttatttatttatttattttttgagacagagtctaactctatcccccaggctggagtgcagtggcatgatctcggctcactgcaacctctgcctcccgtgttcaagcgattctcctgcctcagcctcctgagtagctggcattacaggcatgccccaccacgcccagctaatttttgtatttttagtagacagggtttcttcatgttggcccggctggtgtcgaactcctgacctcaggtgatcctcccgcctcggcctcccaaagtgctgggattacagatgtgagccattgggtctggcctttaatcagaaacatttaaagtgaaagcactgtggtaacttatgttgaaataccttagaaatcaatggaaactgcacagagagggggtaggatagacgtagtggaaccaaggatatgatatggaaaaaggagaaaggtagcaaactagggatgagttggtgaatgtggaagggcataataatgttaaatgactgaaaactacataggcttatgttaagactagtgccatggaaatttttagaggtagatgacattagagtatgtttaaatataaattaatgttcttgcagtgagccgagattgcgccactgcagtccgcagtccggcctgggcgacagagcgagactccgtctcaaaaaaaaaaaaaaaaaaattaatgttactggttgtgttccctagatgtagactctgagatgaagattaacatgcaggaattttatttggagtgttcttgggatcaacacctgaggaatcagggataggcagagggagaagcgcgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccaatggctgggactggggagttctttcctagactgccatccgggcgcccctcaccctcttgctgctcagctccaggtcgtcgtgggttcagggctcagctgcacgctcctgcccgcgccctgggcgtgatggcacccccagcccctgccattcttccccctcaccccctctccctgccactgctctgcattgccctgggttagcctggcggggccaggtggcacccgccgtatactcttgcctttctgctgcaggggcctttctgctgcgggtcccagagctgcagggaggggcggcagagactccccacgtggctcattggcgggggtgctaatcagagttcttttgctgccactctttgattcccaaaccccatgtaatcttcttagtggggacacagaatcatctttgaattcatacatatacagcaccttggaggctggccctccatcctcacagagacctgcctccaagctggagttctacctgtgcctggttgtggacccactccctcatctcttttgctgtacaatgattccccaggtctacacggtgctatatggaattccacatcagtgaatcaaatcctctgtaagatttcagatagtggtgctggctaaggccctgaagggaggaaaggctaagttacgccaagattaggtatcacaatgaagtcctgtcctttctaggatggaaggagttcagtgtgtctggccaccgagaagctggtttgtctctgtgatggacaataccatattgcagcaatccccaacctttttggcaccagggactggtttcgtggaagataatttttccagagactttggggttgttgggaatggttacggcatgaaactgtccgcctcagatcatgcggcattagttaggttctcataaggagcacaaaacctagatcccttgcatatgcagttcacagtagcattcgcactcctatgagaatctaatgcagcagctgatctcacaggaggcagagcccaggcggtaatgcaagtgatggggagccgctgtaaatacagatgaagctttgctccctgcctgctgctcacttcctgctatgtgaccccattcctaacaggccacagaccagtactggtcaggggcccaggggttgggcccaatatggcatattgggagctcagcattgatttttgttgctggcaggttggactttggtggcaacagtagctagatcagccttagtcagtgggaagccacgcttttgggtccatgcattaattctctccctgctgctgtagccacttagctcatgtcttgccagtactgcgatggcctatgcagaggctagctgatgtgaattgccagagtcatttttatatgtgttgttggtttgtgcttccttcaagatggatgctttctgttggcattaacgtattacttggagatttttctagtttgtgtccactcactaatatgcctttgtcccaacttttttctggaagagcttccttatcagtacgctgggccctggccctcagccagtacagaaagtcatttgtcaaggccttcagttggcagacgtgctccctggactacgtgctttctcgggtgtcccagaaaccctggaatggagtgaaatgcagggctacgtgggagagcagggaggcaagaattaagtcggccccacctttgcccaactcagtgggtctccttgagagaggtctgcagtttcaaggagacttttcagccaatctgctgcgagatcctgtgaaggggtgtgaaggtcttcctctgtgactatagattggccagtctctccttgtgtgtccaacagttttcattatactttatgtgaattaatgcaaaactgctaggtttaaactgctcaccattttagggatcccttctggattttaccttccttaaggggaaattttcctcctttcctcagttcatcctttctgccttggctttgacgtggtctggaggccacagagcctcctcctgagaacctctctctggtgtgtctgtttgtgtccgtccctctcctttcgatcattccctgtggttcctgttgggcgcggctcccataaacgcacagagcagggtctgctttgtctgcaacctgatgcattgttatttctcaccaaaacttgcagtccaaacatcacatttccgggccacactctttgtcagagctccaggggcacaaccccggggacctgctggaaggtgccaccgtgacgtgtgcctagatgcgttttccctcagttaccacagcgttcctctggttctggtggctggagggtgaccgcgtgcttcatgaagggggtccttactgcttcgcatccacccttttcacggaaagcactttgtcacatgttttcagtgtttctaagcgattttctgccaatcttgtgtgctaagattgtgtggcagcgtttccacagatttatagctggcaatgaattctcccaaaggaaatcagacaaaataaaatgtttccaacattgttcacatactgacaacttatgtgcttccttgggtgattttacaactttttaagcacatgaataaaaattattgtctgcttttttctccttttttctctcttttttttcttgcatgcagaaagtttataggagggggatcctctggatcaacacccatgggggagtgaaggaagcaggattgggtaaaagaagttgaggtgatacagtctgaataaaggtcagtcccacagggagctcaagctaggatggctctgcagagatgttctctattgaggcaagttgtctggacctatatagtcccacctttaccaggaataaggcatgagtttggatgtggtgactgacttcagccaaaattggttctcagagaggaattcagattagagttgtcagctgtcagcacacccagcagcttaggaaataagtgctttagtcctgaagcggtgaatctggacaccagcctccactgtggtccaccctttctgctgctcagattcatttgcttcataagttctggaatggttccttcaggattctgatgggctccctttcctggggaaacaaaagagaaaggtttggaacacagcacaactcctgctgctttagcttttcttgagtctgcaactggtactcatcatcttccccttctactacccattctagatccctccccccaccaccctctcaattcatacttctgctgctccaagtgggttaccagataaggtatctggtcatcatgccctttgtaagccatgactgtacttgtccatttatcatcaacattgaacaagggaatactaagagatacccaggcagatgacctggctgccaaatatattctcctctgtctccattgtgtaatgtcagcccttcctcctgatgatcaggatcggttacgcttgccaggatagtgactcttttccttacctcttggtctcttaatagtgatctgaagtaatatgatggcaaccatagtttcaagtttaatgagactcttggtgtgtccactggcggacatattccccttttaagaaccagtacttctaaactctcagagcccagagttgggataagaggcatagtttccctaattgggtcactgggagtaatggtagtgtgaggctgctcctacttacactccttgttttccaaaaccatatattttacttcgggacacaccccactaaacgatggccattgatctagagtatatactgcatcctgcaggatggtgcctcgtccttaggtattatgtctaagctagtgcctcagctgtgccttcaacaagctgtcctaccactctatcaagtgggtagcttctgggtagtggattccatggtcatgtatcttcttgctttaaagtaggtctcttggtctgatgcagtgttatgtaagatcaaatattctgtgaggccttgaatggtggtgtttactgaggctcaccaagcaactgaatgattttcttgagaaatggtgacatatcagagccttagctttggtctctgttactggcaagttgaacattaacaacatcagtagctagatctgtattgatgagtccatgatgttgggcccatgcatagcctctgccatggctcctcctttcatacatccattttgtaagaattggggcaccaacagcagagactggtaagcatcaaagtggctaagtcattcagtctacttggttgtttagtgctgtttctgtggctgatgttcttttcatttattcattctgtaatgcgtatcctttgtagattcaatttccttctctctgaacaacttctttggatatttattgaaaggcaggtctactgtcaataaattccttaatttttattgtctgagaaagtttttatttctccttcatttttgaaggatactttcacagagttcagaattttaggttgactgttttttctttctctcaacactttaaatatgtcagtgcactctcttcttgtttgcatggtttctgaggcgaagttggatgtaatttttatctttgctcctctatggataaagtgtttttccccatctggtttcttacaacattttttgtctttgattttctggagtttgaatataatatgcctaggtgtagggtttttttatttgtttgctcgtttgcatctatctttttttttttttttttttttttgagacagaatctcgccctgtcacccaggctggagtgcagtggcgcgaactcggctcactgcaagctccacctcttgggttcacgccattctcctgcctcagcctcctgaatagctgggactacaggcacccgccaccacagctggctaattttttttgtattttttagtaaagatggggtttcaccatgttagccaggatggtctcgatctcctgacctcgtgatctgcccgcctcggcctcccaaagtgctgggattacaggcgtgagccaccgcgcccagctgcatccatcttctttggtattctctgagcttcctgaatctgtggtatggtgtctggtgtctgacattaatttgggggaaattctcagtcattattgctttaaaaatttgctcctattcatttctgcattcttcttctggcatttccattatgtgtatgttacaacttttgtagttgttgttccacagtttttggacattctgggcccatgcatagcctctgccgttgttgttggtgtttttttttttttcagtctttttttctctttgcttttcagttttgattggaagtttctattgtcatgtcctcaagctcagagattctttcctcagccatgtctcatcaaccaatgagcccatcaaagacattcttcatctctgttacagtgttttgatctctagcatttcttttttattctgtcttagaatttccatatttttccttatgatatacatctgtcattgcatgttgtctactttttacattaaagccattagcatattaatcatagtttaaaaaattcctggtctgataattatgacattcctgccatatttgactctgattctgatgcttgcttgttcagtctcttcaaattttgtgggttttgccctttagtgtgccttgtaatttcttgttaaaaggtggacatgatgtactggctatgaggaactacagtaaataggcccatagtgatgtggtgagatggaaagaaagaaaagatgctcaacatcactaatcattagagaaatataaatcaaaactacaaagagatactgcctcacacccattaggatggctactatcaaaactaaaacagaaaataatgaatgttggtgaggatgtggagaaattggaacccttgtgcactattgcaaatgtacaatagggcagtttctctaaaaattaaacagaattaccatatgatccagcaactcgacttctggctatatatgcaaaagaactgaaatggggtcttaaagagatatttatacatcaattgtattagggttctccaatgaaacagatccgtgtgtgtgtgtgtgtgtgtgtgtgtgtgtgtgtaaatatatgccaatggtaaaagtacagggtctgagtcagaaggcagaaccaagaatgcttatgtccaagggcaggagaagacagatgtcccagttcaaacagggagagtgaatttgcccttcctctgtctttttgttctattcaggccctcagtggaatggataatgcccacccacattggtgagagtgatcttctttaccaattcacatgctattctcttctggaaacatcatcacagacatacctagaaatactgttttgccatgtatctgggcatctcttagcccagtcaagttgacatataaaattaaccatcatatccatgtttataagcagcattattcacaatagctaaaatgtggaagtactgcaagtgtctattgacagatgaatggataatctaaatgtggtatatacacacaaagcattacgaaagaaggaaattctgacacatgctacgacatagatgaaccttgagtatattacgctaagtgaaataagccagtcatgaaaagacaaatgctgtatgattccacttatattgggtacttagagtagtcaaaatgatacagaaagtagaatggtggatgccagagactggaggaggtgagagttattgtttaatgtttatacagtttcagtttacaacataaaattaattctggaggtagatgggagcatattacacgttttctttttggagatgggatctcactctgttgcccaggctggagtgcagttttgtgatcatagctcactgcagccttaactgtctgggctcaagtgatcctcccaccccaggcaccaaagcagctaagaccacaggtgcacaccaccacgcctggctaattattattatttgtagaggccaggtactgctgtgttgcccaggctggtgttgaacccctgggctcaagtgatcatcctgccctggcctcccaaagtactgggattacaggtgtgtgccaccacacctggccagaatatttaatgctactgaactgtatatttaaacatgcttgggctgggcatggtgcctcatgcctataatcccagcactttgggaagccaaggagggtggattgcttgagcccaggagtgtgacaccagcctgggcaacatggtgaaaccctgtctctacaaaaacattaaccgggcatggtggcacacgcctgtagtcccacctactctggcggctgaggcgggaggatcactcgaacccgggaggtggatctcgccactgcactccagcctgagcaacagagtgagaccctgtcaaaaaaaaaaaaaaaaaaaaaagatttacgatagtaaattttatgtgtattttaccacaattattaaaattgaagaaaatccccatgggtcactggtttaccaatttagccattttcaccatttttagattgcattttccttctctatctcagcattctgactaaaggaaaagcaaaatttcttacaagaatgaatgattctccagtgtggctgctcctgaaaggaacaatgagacttttgttatttcaccacaagactgagaaagaaataaacaagtgataaatgcccagaccccttcttattcattccacatcctggtaatctgaggcatggtgtggcttttactccaagcatatgaatacttacaatcagaagctgcctctcctttccctcactttatcattattgccatcatttatgacaatggagggagtgtctcactggatgatatttggggttctttcttcagtggtccgccataccaagcatttatttgtgctgttctccatctttcacatctaccacttttcaaaagtccctgagagtcaataagacatgcgactcgaacaactgcttcacatctaagtgtatgtctttaaaaatctctccttttccatgtttatgtctgatgtgttttgttatggcaaagtggcatgtagtatacggttcataagtgaatcgatgtatatctgtggagggcaaatgctcaattttagatctacacatgaaagcttttttccagggcaggagccttgctttctccaactaagccttaattacccaaatgcccatgtgttgtgcctttggcttgttgaaatgataccaactggtaaaatctgatgggagataaaagttagatgtccagaagcataaaagtcaggaagagaggctctttatggcatagagaaagctgcagaactgctccatggtgtgcaaaactcatcagcacatgaaactagtgagtggagatagtcaccttcaaccactttgtaatttctaccaattcacttggggccagtgtcccttattcaccaagattcacattggtccttttgattatttggcgtgaggaggcccccagacatgctaaactgtcatgcagggagagaggaaaagttgggaaccagcctttgcttaaaagggctttgacaatggaggcaaataataacattttgggaacatttatataagtaattatataatttctgattcagtagctggttcatgaataaatgagtaattgggagtatctgagtggagacaagaatgaacattaatgtaggactgattctgaattacagcttctggcactagtaggtttcaatatacatagtctgctgaaaggtaattttctctgtgatattcctggtatccctaaggagggaagtataattttaggtacatactgacaaaatttgaacacaaggtacttagatgaaagttatagtctgttttagagatgaaattgaaggatgcagtagctattgctttggcaaaggatttttggctgatgcagtgtatggttattgattttatgattcttatcatatggcacctaatgtatcagttgagttgtgaaaacagtgtttcggtttaatggatgttagggatttatatacaacttcaaatttgcctccttgctaatagtagaaaagagtagtatggaagcattacttccagctgctttttgaagtgtccaccaaaatgaacgactttttcctttcttcacgcagatttcctcctagagtgccaaaatcttttccattcaacacctcagtcgtgtacaaaaagactctgtttgtagaattcacggatcaccttttcaacatcgctaagccaaggccaccctggatgggtaatgaaaacaatgttgaatgctatttatgaaattgggtatcttattttctatcacagattccccaatcttgaggttgcagttaaaaagtgcagctgccaaagagaatgtttccctaactgctacctatagggaaatacactgactgcattttctgtctttttgctgggccgtcttcctctgcttggtctatgccaactgcttacctccacttagatgtcaaataaagtatgtaacaacatgttatgacaggacattttctgtcttagaattgttgctgagaattataggtgggaagtatccccttattctaaagagagatatcagcctatcgatttagaacttgttcaggtagtagtccaaaattggttctgcaacccttaggccctgactcacctccaaccttgtataaaaaaaggctaggaacttatggaagactttagatttgaatatttattatttggagagcctcttcggtgttttatgtgttgcttaccccatggggagtgggaggcctgtccctcatgtcaaggtataatgaaggaggcttcaggagaaccacttagaagactggacaaggtacctatggaacttgggagacactgaccactgcctggtttttatctggataaattttcaaggtcagaggccaaaaggacttctcctgatggaatagcagggggagtgggcaatagtgggagctaactgcactaccattgttaggtgtaaggccaggaaggtcactgaatgggacttgtcttacaaagactctgcctgagaggtcttcctgccaggattagataaccccaatagaaaaagcctgtatgggttgtactgccagaagcagaatctgagaggagagatacaagtgaccagctggagaaggtatatcccatgccaagatcaggagcagtggggtgtctccttgttggcagggagaggtctccaaataactcataagttccctaagaaagaaaggcagaattttggtatgtgtcacaactagggagtactaatgccacattatcactgctccttccaagaaagactttgtcattgtgcctatttgtttttaccctcccccctcctttccacttgctcctaccttggcaggtccagagacacaaaggtgagttggggaggaagattaggagaggaaggtgggaaagcagcgaagctgccaaaacaaattacctttacatattgcagatttctggggctgtcagaatgtagctggagaaggaagggaacttgcaattgcagaagacatcaaaaatttggtattagactggactggacttgttagaacctaagagtgatactgttggttaatacctgaaggttactggaaaagatttgggatcaaccaaagtgcaagaaaagggagatctcacataaagtaattaaaagcagtggtctaagaaaaataaggctattttatgtttttatcccactcaatccagttcattcaacagactgtttataggcattttatacttagtgtattcataaaacagagctcttaattttcctcctgattttctgtcatggcctgactaacaacccagttgcacaagccaaaatcataggagttttctttgactcctctctttttttctatctccacatcatatttatgagcaagtcctgttgactgttcctccaaaacaagttccaagtcttcttattttacttcttgtaaaatccaaattcatccaaattcctgtggcctgcaaggtcctacatgttatgtttcctttttgaccatattttctgttactcctctgctgattcactgtgcttcagccacactttacttgactataccaaacttatttctgcctctggacgtttgcatttgttttatctgttttcaatgctcttccactagatctttgaaaatcttgcttctttttcattagtcagatctctactcaaatgtcacctcctcagagaggcccttcctgactactacactgaaagtatcctctacctcctgcctcatcactttctagcagaccactatcttttatatttataacaacttgaaattttcttatttatttctttatgtgcttaatgtcttgagaatatgatctccattatctgtcttgtttgctactgcacctccagtgcataagacagttcctagaatatagtaggaactctagttgaatgaatgaatgaattgaatgattgccagaaatcttgcctcagagcaaccataaggttaggctgatgttggcagcaagcaaatactactttttgtcagtaattacaggggcatgcttctccactgtgaccttgactctaacttttggaataacaggttttctggagtactatccccaagtaacctttggcggacatctcattcttacaggtctgctaggtcctaccatccaggctgaggtttatgatacagtggtcattacacttaagaacatggcttcccatcctgtcagtcttcatgctgttggtgtatcctactggaaagcttctgagggtgagtaaaataccctcctattgtcctgtcattctatgaatagaacagtgagatgtgtgtgctttgtaatggtggcgttacaactcttttaaggtcctaactgaacattatgtgtatttcttaacatttactagattataaatatctcaagatagggaaatccatcttatttattgctgtgtccttagcatataacatattgcctaccctatagtagatactcaatacaagaatgagggtgtagtggacaccagtcattttttcttcctaaaattaaacatttctcacctgtataccccctaggaattgcttttctgaatatacttcaaacagaacctgccattttcttaaagcccatgcctccctagccatagcagttgatctaggagtgagcagttgacacgggtatcccacctccttggccacagttgattggtccagagatgggcaccttacccaagctaggccaatgagagtacttgcactagcattttgaaatttatgagaaaaaggacctattattaccaggtaatcctatacttaggggatggagcccaaatataataaaatcaagattctactacttcatgtatatcatgtgggccatggatcttataggagtcttaagggggtgttggtcttgtccttttcttagttgcctagctctttgcaggcatggtgcaaaggcaggacaatctacctttatctgctccttctataccactgatcctaccctaaacatgtagctgtataatcagagacaggaagccatggcaaatctggagggtctcggcttggctatatcttaaagagttacatgtattcgtagttcaacattggggaaattttccaaaaattggtggagaaacgagtggccaatgcaattttatctttttttttctgctgacatcagggagagataagagctttaaaatcacaattatggggagataatattttaaaatccagctcaagttaaacccatcagaaaaggtaacaccttttgggacccccaaatggccacatcttatccaatgaggggacaccaaccatagagtctatactgcacagttcaaatggtagccatgagctatcaggcacttgaaatgtggtgagtcctacttgagacatactgtaaaatatacaccagatttcaaaggttaagtacaaaaaagactaaaaatatctcattcattgtttataagtacaagttgaaatgcttatatttggatatactaggttaaacgaaatacattattaaaataatttcacctgtttctttttacttttcttaatgtgactaccagaaaatttaaaattacatatgtggtttgcattatatttctattgaacagtgaaatgtttagcatatgttgaagttgctgctcctgatgcagtggctcatctcagatttggccaagttcttctgtccaaggaaaactaggttcaacccattcctggagaggaacagactcaaatctttctgggctgggtcacttaccttggttaaatctgttctccacctattctaccaacaaccaaagggatggacatagctgaaataaaaatcacgcaatcacactgaatggtatctcacctcaggtgggccttcagcattgcctagccattctactgctacatttcccctaatccatttactctccctctccccaagacagctataatgtttcacacattgttagcctctcattgaacctccaacatgtgctcccgcccctgcccccaccacaacgtgagccttgggaaaaagggtatttttttcctaatgaaatatttcaaacaaagataaatacagaaaataatataacaaacaaacatgtgcccatcacctcactttgccaaatcttaacattttgtcatctttgcttaatttattttacaaaattaagcattttacatacagtctgtactcctctatggggctggcaggaaaaggctctcattgtcaaagttcaaagtaattgatcattgaaaaaataatgatcacattaaaaacaacacttatataatagagatacatattgtaatactcataaatgaaatgatatcctgtctaggattggcttcaaacacatccaagctgatgttacaatcattaggtgaattcctgatgtggaatttgacatttgtatggcgccaaaataatatcccagtgatttttttctgattgtaagtggaaatgttaactttagaatggaggtatcaggctaatccacaggtcagttttagtgtcactaaggatgggatggccagatattatctgcccctgatatggcacaatatgagggactcagcatcatctttgatatattttagccaaaaaacttatttaatttgaatctaatcagaacttaggcatattcaatagcatgggatattctacaggactacaagccaaatttctttcaccaaatgagtgtcagaaaaaaagggactactccatactaaaagagactatgggcctaaacaaccagatgcaatctgcagtcttaggttggattctgatttggaccaactagctacaaaggatgcctttgaggcaattaagaaaatttgaatattgcattgatattaggtgatattaactggatcaggtgtgctagtgtcattttgtttatgtgggcaatttttttttaaagatgacttctaaagtatataggagtggactatcatgaaatttgtaatgtacattaaaatgcatcatcataaaaagtgtgttgaaagaaaaaagtgaaagtagcagtgcaattctaagaataattttctaacatccactcacaaaaatattaaattctttatattaaacacatgaaaaagaacacaaatatatctgtctttcaagattcatctcaaattccacctccttcatcaagcattactgaagagtaggaagcttgtttactttttttatccactgtgttgctcgctccaagggcatagagacttctatcttgatctttatattttcagcttgtagctgagtctggtaaagaataagaactcaataaatatttgtgaataaataggtgaatatttccacatggtattataattatatctttatatgtctatgtcccccaccaaacatagtgttgtaccactaggaaagaacaaagtttaagaaattttcttaaatctctctttcttactgttccgtgaccctcactagtgcctaccaaagagtctgtgacaaagtgtatttgttgttgaattgaattaggcaaaaagatgcaataatggaagcaatttattatttaacagaatgtggagatatcaaccagaacctagtttttactgctcatgctagggttagtgatctcaagatcctctggagtatatgaagcttctccccatttgtggctgctgcttgttagtttttcaaattaagatgcagaaagtaggccgggtgtggtggttcgcgcctgtaatcccagcactttgggaggctgaggcgggtggatcacaaggtcaggagtttaagaccatcctgaccaacatgatgaaaccccatctctactaaaaatacaaaattagccgggcatggtggcacgtgcctgtaatcccagctgctggggagtctgaggcaggaaaatcacttgaacctgggaggcggacgttgctgtgagccgagatccagcctgggcaacagagtgagactccgtctcaaaacaacaacaacaacaacaacaaagatgcagaaagtccgtttcttatgtagaacctattggtgacaataaacttgacatgtttctttgagtgtacagtggatatagaaaggacaattttatttcttcctgctataggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaaggtaagtgtatgaaagcgtaggattgagatgaaataagcagagaagtacaaacaactgaatctatctataacagttagcatttgtgttccttcacctgaaagaggcttttttactctagcatcatgctcatggaaaggagaataatccagtttctgagagaagcagatatgcattctatataaccacaataaactctaagctgggatcaggaggagctgagttccagaattaaatctctctcctcaaagcattgctattttcctcttcaaatctgtgggctttatcagtagtgatttctactgtcctctgccttttgcaaactttgagctaggttccttgaaaacttcatggaggtaaacacatccaagtgtgtgatcaatggcatatagactggttcaggtggttagtttgtcatctgtaaaccaaaagtatataaaaatctaagaaaagtcagcatttatttatatgttactgaaaattaattaatttggattgaattaatatattctaaaataattctaatcaaacctgtttttaatttataccttagcataaattagggaagtaaattttgcataatttgtttttatcctattttttatggtgaaatcagcttcactgtaccttttccttgttccatttatcttttactgcataactccacaatttagtggcttaaaacaacaacagtctcttattatctctcatggtttctgtgagtctcatggaatttgtcagtgttttgacttggtggcctatctaagtgtgtctcatgaggctgtagtcaaacagtggctagagctgaaatcatcccaaaggtgactttattcacatgtctttgaccttggcttgatggtactctccacatgatctctctcacatgggttttacagggtagccagacttcttatatggtcctgagatagcccattagaagctgtttcacgatttctaatgtaaccttggaaatcactcacataacctacattctattagttagaatgcatcactaagaccagtctataaagggagactccaccttttgatggggaataggcaaagaatttattaacaggaatcaccatactctttctgaatggtgatgatgaatgtgattcaaaaaaaggatgggagcggggagtggagaagatgagaaaggtttgtagtttataatagtttcagatgaaagtatgatttctcatatactgagttcagtttcatagtcataattaatgagaaagtgccaaaaccacagtgtattatttatgggatgtaaaggctaatggaacaatgagatcatcaaaacattagtgtttacatatgacatataaagaaataagttaaaaacccaaatgattctttgacacagagttgaactaaagagtctacagaggttctagttccaggtgaaatggataaacacactccaccctttatttcccattgaacttaactataaaaccttgacaaaatgcaaagcccagatatttaaaaatttctaaaaagcaaatagaacaagtatatagagaaaagacactagaattgaaagtattaccaaacttgtgggggagtatacctttttccccactctagtattccttaacctgaattaaaacataactggagacttcgaagtgagtactatgttgcaaagagagctccaggacaaaccctctggggtttcaaggagtgagaaaggtaactctaaatgctcagagagcgtgggaggggaaatcccctagggtttttgtcctcttttccaccattctctcaagcttcagtcccaggttgcctgtggcaatgacagtggctggcaacagaaacctgccggagtaaaaacttagggaggggaacattattcttcattcagtacagctacagatctaagacattgggggaaaagcacattactttctctctgtctttccccttccattgcttgaccttagctatgatgtagttgtggaaattggaagcttctggttagaaaaccaaaaaagggagctcacagaactggaaagtttatagatgacagagagaaaagatcccaggaaagtaaacccataaagttgtgcattaactcctggattcacccccaacctacacatccaggtatgtagtttcagtgtcagatctgttttaaaccccttgcagtgccattgagtccaacgcagtggccagtctggtgcttgaggggaaatctcagtttcacagtcttcaacatgttccattagcctttacgtcccataaataacacactgtggttttggcactttctcattaattatgactatgaaactgaactcagtatatgagaaatcatactttcatctgaaactaacgcccacagaattccttaaaacatgtctgatggctgaaagcaaagatagaacattgtgagataggttttttaatgtatggtagatacaatacataaaagaatcatagcataacaagaggagggtaaggaaaactttatggtccattcaacttcattccaattcaaatggtaaaatgttgactctaagtagatgatagtgaaaggttaagtatgtattttgtaatccctagagcaaccaataaaaaattataccaagagacacagtaaaaagtcacaataaactaattacaatggtatatcaaaaatattcaaataactcaaaagaaggcaagtaaggagagatgaaaatcagagagaagaagcagtaaaatcataataaaatgataggcttaaatctaaacatatcaatacttacattaagtgcaaatggctaaaacacaccaattaaaaacagagattagcatactggatataaaagcttgaaccaattatatgttgtttacaagaaactcatttcaaaaaaatgatataggtaggttaccagcataaagatggaaaaggatatatgatgcaaacatgaatatgaagaaagttgaagtagtacaaatctgtaatcacaacattgatttttgccaggagtgccaaaaccattcaataggggaaagaatagtgtcttcaataaacagtgctgaaacaggtgaatatctgcatgcaaaatactgattgagtatcccttacctgaaatgcttggaaccaagaacgtttcagatttcagatactggaatatttgcacatatataatgagatagcttggggatggaacttaagtctgaatatgaaattcattttggatataaatcccttgccagttatgtgattggcaaatattttctcccactctatagtttgttttttcattcttttaatggtgtcttttataaagcaagagttatatggacaaacatatgaaaagatgttcaacatcattaaccattagggaaatgcaaattcaatcaacagtgatgtatctattagaatagctaaaataataatataaaattgccaagaatcctgtcaagaattcagagcaacagaaagtttcacaatgcacaatggtatagccattctggaaaacagaatggcagttttgctgcttggtagagaaacagtctctggcagtttcttgtgaaattagatgtacactatagagggatagcaggagggagttctttttggatattgaaatggatctgtatcttgacgatgatggggtttcatgagcttatatctttgttaaaagttatagacctatacaccaaaagaaaaagtcaatttcactataattgaaaatttatataaaagtaattagaatgttttaagacagctttatacgtattttaaatgtgtctctaaagtttttaatccagtacttctggtaaagatggcacagggtcttcctacttagccatttttccatcctccacctcaaccccaacctcgctgaaaaccaacaacaaagataggtaaaccataaatagagaaaatcgaataggcatggtcagctgaaaaagaagataaatatttgtggaccagaagcagaacaggaactgtgagtagtaaaaggggtggaaattacaggccaactgagatctgggtcaggaagccagctgcggtagccaaggagtcaggatgacaaggataaatagtgctccccaccagagggactgagagcccatatcatagagttgggctcttcttcacttgaaagagagctgagcacagctgctgctcactctttgtttagggccatggctttgtggaaactcagagtcctagaagaggggaaagcaaacccagtcctagaataggaactgaactaagttttcttggttcagtgggggaatctgcaatatccccaaggtttccattggccagtatctccaaaattccattctagggtatgatttgctagatagagaatagtgaacacatcctttgcttaatcaaccaatgatcacaagggacagcaaagatcactatagttcaacaaagtcagatttattggctcatggcaacaagagactgtggacacctccctaaacaaagggaaatactgtatagagttagtaaagaattttggggaagggtggaggttaggtgatatttaaatgaagcaaagtagagttgtgtgtaaagaaataaccatgaggtctagactgtgaagtgttctaaaaagttaacatagacatgaaaggttaagtcaaggcaccccttacctgaagcttgagctttaaattgagctgcttctttgtgtcaaagtaatttagatgacctaggaaagaatgagatgtttcattcttgttgctattagttcaaacatttctggcaggctgtgaattcagagaacaaacaactcaattgagtaagaaagcaagagataatcaaagcaaatagttggcattcagtgagtttatacagtggcaatgtgtccttgggagaaatggtgttgttaactctgcagttagctttatctatgtctcttatcccagcctgatgagtagcagcacacgtactgttgctttcttagtccaagctaatttttatttctaagcattaagggtgcgagagagagaaagaacggcaaaatgtcataaacaaaaatctttctactcaaaataagcctgtaaacaaaagtttccagtcaaatttaaaaaatatataattctaagaaagatagccaacaagctcaacagttaaagcatgaaacaagctagtttgttccattaaaaacttcagctatcgatatacacggtatttatttaaaatgtgagtataattagaagcactgtgggctattgaaaaaaaatcatgagtatagatgtttaatatggacaattgctattttactcaaaacttttaatttacaattgcagaagtataaaaagttacaagagtaacagaaattatctataatttcactattatcacacagtgtgtgagggcttgtattttgtaagtgtttttaatttttttctttagtaattcatttttatcatattttacacaagtagtggtcttcatcaaagttgaaataaaaaaattctttgctccagatagttttagaaacactgctataggagacctgacatcaaagccaagttatcaagagacagaagactacatttgttcttactgtcaagtaactgatgaagaactgtctcctcctagtgacaatttcctacaatgagattttttaaatagaagataaatgttctcacttctttttcagggagtctggccaaggaaaagacacagaccttgcacaaatttatactactttttgctgtatttgatgaaggttagtgagtcttaatctgaattttggattcctgaaagaaatcctctgctactattaagaggaggtgattatagaaagatcataaattacattactgttcaggaatgaaggagatggggttaaaaatgaattccaagaaaacaaaacgtaacctcagttccactggcagctatgaggtaagaagatagaggagctggataacggactggcctcatccccctcattaagactgtcaacaaatactttgggctctactttctaaatactttctcttatcttcatctattattaagtgcacaacctttggcaagttatttaacctctctgtgtctcggtttcctaaatggaaataatagtacatttttcataagattgttgtgagtgctgagtgatttcacttaagtaacctagagcactgtgtggcatagagtaggccctcaatagtgttagtacctccgcctcttcctcctcctcctaatgtaatcactatgtaatcatagtaacataatattcttcttgcccccttatcaatttacattgccatcttcttaattgaggccctcatgatctgtctcataactctcaaaggaagcttactgaagtgagtatctgatcttgtcactctagcctctacaatacttcagtttgccagtttcggtggctcatgcctgtaatcccagcactttaggaggctgaggtgggcagattgcttgagcccaggagtttgagaccagcctgggcaacagggcgaaaccacatctctacaaaagaattaaaaaatcagccggtcatggtggcgggtacctgtactccagctacttgggaggctgaggtgggaggatcacttgagcccaggaggtgaaggttgcagtgagctgtgattgcgccactgcactccagcctgggtgataaagccagaccctatctcaaacaacaaaacaaataaaataattcaatttcaaggtaaagtgcaaaatgcattatctattctctggtgacatttccagccttgttgtgttccatttcctgccttatcttccatgtcacccaaatatgtaatgctttttcttgcatgagacctctgcatatgcagtttcctctgcctggaaaaatctgtctccctctttacactaagtaagcttctcctttttctttaagtctgacttacttcagttatccccttccttaattccttctcccaggatgacctctagtctggattagatgcctgcttatatttccacagcatcttgagcttattccttatcatactatatcagtattttctactttatttaatatttatcttctttgatctcatatctttttcccttcaagcaaagtgaaatttcttctcctctctgctccctgtaacaccctactctcatctttattatatcactctttactctttattataattatcagcttctctgacgattccagctagagtgtaagcatcttgaaagcagaggctgtatcttcctctctatcatcagtgtctacaattagtagtgctcaataaatatgtgtttgaatgaatgaacaaatgaatggctgcctcataaagttttagcactagctaccagtccttcacacaaaggggtaactccagggagtcactgttcaatagtatttccagtgcttcagcccttatcaatttcagagacagtgttagggagctttcaggttcctggggtttcataaatataagctgggatgaagcaattataacggagacagggactgacagacagcctttttcctaggacaattttcttttttcttttcttttttttttgagatcgagtctcactctgttgcccaggttggagtgcagtggcacaatcttggctcactgcaacgtccacctcccaggttcaagtgattctcctgcctcagcctcctgagtagctgagattacaggcacatgccaccatgcccgcctaatttgtgtatttttagtggggatagggtttcaccatgttggccaggctactctcaaacgcctgacctgaagtgatccacctgcctcagcctcccagagtgctacgattacaggtgtgagccaccgcgcccggcccctaggatgattttcataagctttcttttaaataattcagctaataaaaagaattgaatcctgatgcctcaagctaaccaatattctgtcttctattattatccattcccacttattgtcatggacaaatggagggagagaaaatcagtttgagcaagagatgtctgcctttacataattatcttctccctccctcacactgactttgagaggataagtgctgtgtgcctactttgctgacaaaaatgcttaaggtgtgagcacactgggagcagggaaggagaaaggggaggcggtcattcatgagacacatgcttagctgactctatctttgccttctctctcatcagggaaaagttggcactcagaaacaaagaactccttgatgcaggatagggatgctgcatctgctcgggcctggcctaaaatgcacacagtcaatggttatgtaa

SEQ ID NO: 4103 - DNA, 190082 bp, human; identical to SEQ ID NO: 4100

SEQ ID NO: 4104 - DNA, 186958 bp, human; identical to SEQ ID NO: 4101

SEQ ID NO: 4105 - DNA, 23455 bp, human
gcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggtaagaggcacgctgttccctggcatcttggcttgaggccttggactgcccctttcttcccggctcccacccaggcctcgactgttggaaggagctgagccaagtgttcagggagggggcgctcggtctgctctcacccctcgcacctggacagattgagctctgctgggggcccgcccggaagaaacgtagctcgagaaggccgtagaagagaacggggtgcggggccgggacgaggggcgaggggcgaggggcggcgggtggcagggcagggcggcctgagggacctccgggctgccgccggttttcgtccccctgctggttggaaaaggggaggtggtgaggagctctcgactcagcatggatgctggagacacagtacaatgaataggcagaacagccagtgctaagatgtgaaaaccgggaatatcactttgtctgttgaaggaatgcagtggtctcgggaatgttgcctcgggaaatggaagaagagaccgatgggaaaataggatgataggttgggagtgtaaagtccttctgtgtcttgctaaggaattgaggttttccagtaggcaacgggctgtcatcagaaggcctttcgttttaactacatcattctaacaacttagtggagaatgaattgttgagagaggaggctgaaccctcctgatggcgctaggtcccaggttcgctagtgtcctagaggggatcgggttgctccacaggccgttctggagggcgctgcctgtgctgggtggctttttaaaaattttattttatttatttaatttagaaatagtagttgaaaactatttgactaatgagagaaaacatctgactggccctccaggccaggtcatctgtctgtccccacttagctactataaaatcttcatggaagtttctcaatcttttggtttgtaccttaccttacctctgccttttttttactaactacgtcttatatccttctaaagactcatttatttataccacacttgatattgtatattcgcatttgctgattgaatttcgtaattggttattattttgtgtttttatgagctgtgtcatttatttctctacattgatctattatctaaccataacaaggaataaaatttgttgagtgccaggcactttcttaatgattttacaaaattcgaggtggtagctactactgttatgcccgttttttagatgataaaactgaggtacggggcacttgagtaacttgccccaggccacacaggatgtaagtgaggtatccagggtttgaacttggacaatccgtggaggtccagactggcagcttacccctcatgctctgctactgggaggaggtgaggtagttctcatgaatcgccctacttctcctggtcatagcatagtgcctcacacatagtataagctcaaactaagtgtctaattgaatttccatagggccttaaatgttacattcatggtgctcagctagagatggcgtcagaaatctaactcgggaggagacactttatctgagggctttataatgtcttgaaatgctttttccctacaatgtcgtggttatttttttctagaccttaaaatttctaccaacataatgtaataagcaacccaaattttatataactgtttatgtttccaaactattaataattgaagtgacatggtattgtagaaagattattggcctctaaatagaccagggtctgaatcctggctctgcttcccagttgctgcttaaccttaagcatattattttaccactttgagcttgagtttctttaactgaaatagggatgacaatacttagagagttgttatgggaaacagagaacatgcttgcagtattgcagtgtagtaggtgtcgaataggtattaatattcatgatgataggaagcaatataccatagtggttagaagtcagacccagtccattccccaaccccgctgaggcagtaatttgttttctttctctgcttgaattgttgtttcacccttgtccatttcatgacctcttcatctttccacatctagttcagatatcatctccctgtagttttctctgacctctaccccaaaacaaaatccctggcactttgtgtccctgtggcacattatgctatacataggtgtcacgtactcttataagcgtttcacatatgctaactcatttaatccctggtgacgaaaaggtacttgtacagatgatgaggaaattgaggcaaagagaggttaaataacttccctaaggtcaactcatctaatgagtggcgaagctgggattcaaaccaggcacctcctgtctcttaaccacagcctatgccgctatagttaattcttgctaaactccagcacctgataacatgtatcatgtgccagaaacttacacttctttctcttccctgcagtgacccttctaggaagatggcatctctctttaacatacagaactcagccattatctctcagcctcaccttttcaatttcctttactgtctagtttgatggcttcttagttcactcccttgctgtgtttctcttcctttttcttccttgtttcagctaagatattctctggtagctagtaaatatggataagaataatgatgtgaagatcttagaagctataagataattgaagttacttataataaagaactagagttctgtaaagtactagacgactcttgtagcatctcttttaagtttcatatattttcatcttgtttctgatccttatctaattaactagcctttcttcaaggatcagcatgtggtataaaaaatattttaacatcagttttactgcttttcttttgatcagttattactgttacaaaagattattctgtttgccttttaggtttactttgtttcagttatttgatactgaaggaagcatttgtggattgccttgggaacccagtaaccatatttagtatgatttctatggtaaaacttgttgaattaaaaataagtaataaaattgataatcttgacatgcaacctgtaaaatcattttgtgaataggatgcatgaataggcaatgtatttgattgttagtttcatatttactactagggatgcatgggaaatgcataaagtggtgggcaaggtcattcttcttttcctatttttgaataaaaaatgaagaggaaagtgaaagaataaattagctatataatatatatgtaccatctgaaattgtctctaactttttataactacaggttgagcatcctaaatctgaaaatctgaaatccagaatgctctaaaatccaaaactttttgaacaccaatatagtgctcaaaggaaatgctcattggagcattttggactttggatttttggattgaggatgctcaactggtataatgtaaatattccaaaatctaaaaaaaaaaaaaaaatctaaaatccaaaacaattctggtcccaagcattttagataagggtgcttaacctgtacttttagttaaaaacaaacctttggagaaaaacaaagcttttttttcttctatgttttaaaaacaaagcagtcaaaaaatctgagtggcatgaattctaaaatttgtaaagtattatttttgatattaaaggaagatgtagattccttcatgaaacagcctgggaatgagactgcagatacagtattaaagaagctggatgaacagtaccagaagtataagtttatggaactcaaccttgctcaaaagaaaagaaggtaagtgtaaaaatttctaagttttgaaaatcttatatgacttgaacttttaaaaaattgagatataatttacatataataaaatattcagatgtcaagtgttcagtcctccaaggtggctgtaccatatgaaattcccaccagcaacgtacaagagttccagttgttccgtatccttgccaacacttggtattgccagtctaaatgtggttttgaaaacataatagaatggttgttaaagactgtattccaaagctttcaaaatcataacgtcttatatgtctagttcatccttctaattttgccagtgagattagagacccacagagtctgggcataagacttaattagttatgaaatcccaagatttcataactaataggcataggaaaaaagctatccttactctcaactctttatttccctacattattttatatagcttataaagtcaattcactgtaataaatatttatagatctctgttttgtgcatgtgccagcattcttctgtaagataaatatttatggaatgccagctagatgccacatactgttttgggtgaaataacatccagtatctgctttcaacaaggacacaggactgggcatggtggctcaaacctgtaattccagcactttgggaggctgaggtgggaggatcacttcagtccaggagttcaagactagcctgggcaacatagggagacccccgtctctacaaataattaaaaaataattaggctgggcccggcggctcgcacctgtaatcccagcactttgggaggctgaggtgggcagattgcctgagctcaggagtttgaaaccaccctgggcaacatggtgaaaccccgtctctactaaaatacaaataaattagccagacgtggtggcatgcgcttgtaatcccagctactcgggaggctgagttgggagaattgcttgagcccgggaggcgaaggttgtagtgagccgagattgtgccactgcactccagcctgggcaacagagtgagactccatctcaaaaataataatagtaataattagctgggtatggtggcatgcatctgtggtcacagctcctctagaggctgaggtgggaggatcgcctgaacccaggacgttgaggctgcagtgagatgtgatcatgcccctgcactccagcctcggcaaaagtgcgagacccagtctaaaaagcaaacaaaccacacaaaaaactagggacacagtttggtggaaattataggtatataaataaaattagcacacaaagtagaacagtagaggtacagggggatggtaactcattactttgtaccaaagcacctcattaacctggaggggccaaggaggttcagaggaagcttctaagaggaacagatagctgtgtagaatttcaaagattagttgtgagtttggaggcagactaaagtgaggaaggggtagtctgggcctaaggcaccatttatgcaaaggtacagaagtttgtaggtatattttctcatttgattttggtgacagttgtacaaagttgaatatgtactgagtattagatgagatgaaaagtcattgacatggaaagatggagagtgttaatggacagaagcaagatagaaaacattaagaacagtgtgctctcgttttggaaaaaaatgtatgtatgcacaggaatatctggagaaatccacactaaaggcatattaacagtggtaatctctgggtagttagaatatggcatttttcttgtttttgcttagctgttttcttaattttttacaatgtacatgtactgcttttgtgatagtaaaagtttatttgaaaaagaaaaataaagccattggatttgagatcacctacagggaggttacagatagagaagaaaatgtgccttggggcggggtgcagtggttcatgcctgtaatcccagcactttgggaggccaaggtgggcggatcgcttgagcccaggagttcaagaccagtgtgggcaacgtggcaaaaccctatatctacaaaaattagctaggtgttgtggtgcatgcctgtagttccagctactagggaagctgaggtgagagtattgcttaagccagggaggttgaggctgcagtcagctgtgagtgtgccactgcactccagcctgggcaacagagtgatgataccccgtctcaagaaagaaaaaaaggaaaagaaaatgggccttgggaccaagtcctgggagagggggaaatttgcgtatcaaacttaaattgctcttctaactagtaaattaatgatagacaaaaacaaaaaaaagaaaaaagttatattgctaactctacaactgtggtatgtagcaggatactcactctagcttaacatatggtctaggcctaaatgtggggagaaggggtaaaaattcaaagcacttaggaaacatcagtgaacgttggtgttctggatgagaacagtgtttgtctagtgttttaaaagagaatggtagagttggagatagtgagttaggaaaattttcttgagttttacctattttaatagtgggttggtcatttttttgagacaggctttctctctgttgcccaggccagagtgcggtggtgtgatcacagctcactgcagccttgacctcctgggttcaagcaattcttccatctcagcctcccaagtagttggagggctacttttctctttttatttttctggaatttctctcactcctatgatgtcagctatgcaacaaaactatttttgtgtcatgatctagttgttttgcagcagatggctctatgtagtttacatgctagcctttttgttttttttttttttcaatttgctattattttatttaggatttttgaatttctgttcataagtgagttcagcctatttctttctttttttttttaatttttttagtattgatcattcttgggtgtttctcggagagggggatttggcagggtcataggacaatagtggagggaaggtcagcaggtaaacatgtgaacaaaggtctctggttttcctaggcagagggccctgccgccttccgcagtgtttgtgtccctgggtacttgagattagggagtggtgatgactcttaacgagcatgctgccttcaagcatgtgtttaacaaagcacatcttgcaccgcccttaatccatttaaccctgagtggacacagcacatgtttcagagagcatggggttgggggtaaggttatagattaacagcatcccaaggcagaagaatttttcctagtacagaacaaaatggagtctcccatgtccacctctttccacacagacacagcaacaatctgatctctccttcctttccccacatttcccccttctctattcgacaaaacctccatcgtcatcatggcccgttctcaacgagctgttgggtacacctcccagacggggtggcggccgggcagaggggctcctcacttcccagacggggcggccgggcagaggcacccccccacctcccggacggggcggctggccgggcgggggctgccccccacctgccggacggggcggctgccaggcggaggggctcctcacttctcagatggggcggctgccgggcggaggggctcctcacctctcagacggggtggctggtcagagacgctcctcacctcccagacggggtggcggcggggcagaggtgctcttcacatctcagacggggtggctgggcagaggcgctccccacatctcagaggatgggcggccgggcagagacgctcctcacttcctagacgggatgacggcctggaagaggcgctcctcacttcccagagtgggcggccgggcagaggggctcctcacatcccagacgatgggcggccaggcagagacgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgagcgagactccgtctgcaatcccggcacctcgggaggccgaggctggcagatcactcgcggtcaggagctggagaccagcccggccaacacagcgaaaccctgtctccaccaaaaaaatacgaaaaccagtcaggcgtggtggcgcgtgcctgcaatcccaggcactcggcaggctgaggcaggagaatcagtcagggaggttgcagtgagtcgagatggcggcagtacagtccagcctcggctcggcatcagagggagaccatgcaaagagggcgagggcgagggtgagggtgaggctagcctttttctttgtatgtgttgtaaatcttgcagcctgtcatttaactttacccttcaagctgtgtaaaagttccttagtatttcatgtgttaatctctttttcgacacttgaatctgagatcttttatctttctttaattggaaattttgtgattatcactttttctatcgtctgttaattttttttcctctttctttctgggattcctgtttacagatgttgacacttctaattctgccttccatttatttatattatttcccttttttctgtctttgtcatttatcttttggcaattagatggatagccatgagttctttgtttcagctgttaagatttttatagctggtagttctggttggttcctcttcatattaccaatatcctttcttttctctttgtggtatctttaagtatttaatgtatagttttatcttttggtatttgttaattttgtttcatatggtagaggttgttgaatttattgtctttatttattataatgatcaaattataatgtcttttccctgtcagcttagattccctcagggatatcagctactttggccagtaatgtacgtggaggtgggggtaatttaagtcactcctggtgggtagcagtggcgctacctcggctcactgcaacctccacctcctggattcaagggatcctcccgcctcaacttcccaagtagctgggattacaagcatgcaccaccacgcccagctaatttttttgtatttttttttagtagagactgagtttcaccatgctggccaggccggtctcgaactcctggcctcaggtgatccacccgcttcggcctcccaaagtgctgggattacaggcgtgaatcactgtgcccagccaagctactttctcttcaggtgaagcagggtagggaggagtgtattgcttgggcatgtgctgtgtcattggtggtctggttcctaagttagctagggctgcatctgattgattcattaatatgctttatagcatattacatataatatttatatatacagaatgcatcttaaaagtcatttacatgacaaaaaatcttgatctgaacatactccttatgttgtgtgtgtatcacatattttacaaatgtataacatctttctgtttacctatatgaacatatcatgcaaaaataagcaaacttgagcaatctatggcatccagattgaattgtagtgaaaaaatgaatgctaggtgtttctagattattcactggactgtattatcaaatgatgacactatgtttttttcttaagcagcaggctcatttaacacatttcttgccaggtcagtagcacagggtgtagtaaatttgccctgccaacctgctgcacacatggagtgacttcttttatgtgacgcaataagttcattttcattgttgtgtttatattttgtttacattttggtctctaataatatttagtaaatttacctcgaaagaaccagagcttcgtttttatatccttagtctgttttgctagaaattacatttgacagagaccctagaactgttttgcatatatctccatgcaaaacacatgcatctaattaccataaagagctaaaccccagtgacaaaaacggtatcattgttttctctctttaattgactgaatgtttttagcatactgtttttctcttatgttcttgtcagtgaggttgattgcatttgggagtcacttactagcattttgctagtagctatcatataacttatccattaagtcggatcagttgtatcatgtccatcattgtttttttaaatttcttgtgtttaaatcagtgatccatttataattttaagaacgatcgttacctcatttgaaaagaagagcatttatcaacataaaagttaaggaagaaatacccaaagcttaaaagaatcactaaattatactgtatcataatgtggtgtgtttggcattcagatgattctgtacatttttcacagtgtgacaagtgcacatactgagaaggtgtcactgtgctttgcctggcatttagctgactgtgatgtacatgtgtgtatacccaatgcacacaccaggagtagctatgtgcatcactggataggggattggtgtcttctattttagaatgtaacttttgaatccatgttatttttaaaattagttttaaaattaatctatttaaaatttcattctaatcaaatgcagaacctatgaatcacctctgtggaatatagtctgctctagaaatgttaaatagccatggggtatttgacataatagaacagagctttgtcttcatggaatgggcattccataaacattcactagtatatcttaaatatttttattaagtatttatactttaaatattttatgaatattttactaaatatattttcttttggtgaatatttctttaaatattttatttttataaatatttatatcttattttatctcatatctaaaaatatcttaagtattttatatctataaatagtcctcaagaacacattagtagaaaatgcaaagttagtaagaccgtgtcctgttgtttatttttgcctgcaaaatactaagttactctttttcttgttcacaggctaaaaggtcagattcctgaaattaaacagactttggaaattctaaaatacatgcagaagaaaaaagtaagtgcatttttgtttgtaaatatgagcaagctaggatatgtcagcagaaactcgtcttctttgactctttggtcactgatatttgatctgtgctgtggaatccagtctgccttcttaagcacatacactaatgttatgatgtgcttctgtagcaaatgtggctttgtggccttcccccaaaagtcaagtttaattctagggcccacacttggattactttgcttatctttagtgcttgtgaaacttaaatgcaatttgaaattgttttaggtgtacaaagaaaatgtcttattctgtgctagcagcatctagggttttttctttgttgttgtctttctccctaagaataaggagttagtccaagatttatagagctggaacgaatcttagagatcatctgttacaggttctcatttcatagttgaggaaatggttatggagaggttatactcgaccattgtctatgtagttagttactggcagaactaaatttgagagtcttctaagtcttaatccagtattcattaaataaaagcaggttgtaaagattaaatctcataagcatattgtatttaaaagattgtgtgtatgcttatgattttgcttgactggtagaataactatttctagtacattttaatatgtggtgaactttgtaagacttcagcaactgattgattgggcatgaagcaccaatgaaataatagaagaatggctaattcttacaataatgccttctctgtatgtcaggcactcgggggtgtgtgtgtgtctgtgtatactcagtgcttaccactgacttcataggtgtagggactgttgtaatcctcattttacagatgaagaacctgagatatagaagttaagtgagatgccagatttgtacagctagtgagtagctgagccagagtccatacccagccacctgggtctagcattcatttcttttaccactacacttagcctgcatgatggtactgttttaaatgtcctaggttcaactgtgcaatctctcctttataaccttggtatcaaactggcctgtttatggtactgtcattttttttttttgttttgaaggagtccaccaactcaatggagaccagattcttgctggcagataacctgtattgcaaagcttcagttcctcctaccgataaaatgtgtctgtggttgggggtaagtaaatgttatagccacagctgatatatttgtaaaccagtgtgttttctgtagcaaacacactggttttgctagtatttgctagtattttagtagtattgctcgagatatgtaaagtgttcatctccttttgattgtggaagggacaaagggacagagtccaagtggttcatattagaaattgactagaatcagaagtgcgatgaagatcgcagtaaaaacatactgaagtctctcccaatcaagataaaactgatcaaacaaaccctgcttctcttccagttagtgctttatctctcttaaatataatggaggaagagcaatagaagtaaaatagaaggtactgctgaactttagataaacgcttcttcccataagagtttaataattctagaaagatccctctcaatttaaggggaaaaagagtattgcaaaaagtttgaggttagagtttattttttaaaaccatgtatttcagttttagatgatttcattgagcttatctgtgatttacctattttgctcttctcagtcctctgactatccagctacctgtctgtggatcttgttacctcaggcaagttctcatacaaagtagcaagccaagtgtacttctaccagctgtcctacggggaggatttcccctagctgctgtcctgtaggatcactctggagaggcactctagattagcccaaggaggtttgctcaaagtttgtacaacatttatatttcactctacaatctgcatttcagtatttatcttttataatttatcactaaggctttttaaaaaataactttgaagcatagcaactacacctgagtgtccaaggattcaatgattttctgtattcagtttttttgtagaaattgcatgaccttttgattcacaaattcaagtgttactttatttcaggaaagataatttctgttgtgtacttgaatgtgacttttgccccatttcttttattatcttttgggaataataaatatgcatatgttcgatctcctttatctgttttcagtacctatcatgttctctgttttcagttattcgatgtgtttcattctgtgtgatttcctctggctgcttccccatgactttgtgttttccctggtagttattctgttttgttgcttttactctgtctttcgtaactgttcttctgtttctctttctcttcattttctttgctgagctcttcttgctcttttcatgtttttcttctttcattcctcttgaatgtttaaatcctcatttcaccactcatagactggcacttcccacaatcttctccatctcagtaaatggcagaatcttttgcctggttgctcagaacaaaaatctttgagtcttctttgactcttctttattttatatctctcaaccagtccttcagcaaaccccactggttccttcttctgaatagattgagaagccaactatctctcacttccttactgctgttaccatggtccaggccacctttgtctcttgccaggactgtgggaatactgtctattagtttttagggatgccataataaaattaccacaaactgggtggctttaacaactgaaatggactgtctcatggttctggaggccagaagtccgtgatgagccccagaatcagggtcgattccttctgagagctgtgagggaaaatctgttctagcctcctctcttagctttggtgttcgcggacagtctttggcatgttgatgtgtagaagcatcactgtgatctccgccttcatcttcacatgtgtgcatgcatgtgtccaaatttctccttttgaaagaccttatctccaaataaagtcacattctgagctactgggggttagtagtccaacttattttttgttggggagacagaattcaatccataataccttacttccacgtaaggtcacattcgctagtataaggggttaaaacttaaatgtatcttttttggggacactgtttaacccataataataccctaattcactgtcttgcttctgcccttgctggaattcctaaagtctttccagcacagtggtcagattaatcctttgaaatctcaatcaggtcattccattattctgcccaaaatctttgaatggtttcttatcacattccgaggaaaagtccaagttctttgagtggctgacaagttcctatacatcctggtactctctgttacttctctctttttttttttttctgagacagagtctcactctgttgcccaggctggagtacagtgttgtgatctcagctcactgcaacctctgtctcccgggctcaagcgattcttgtgcctcagcttcctgaatagctgggatcacaggcacgtgctaccatgcccagctaaattttttggtagagacggggttttgccattttggccaggttgatctcgaactcctggcctcgggtgatctgcccaccttggcctcccaaagtgctgggattacaggtatgagccaccgtgtccagtctctctgttcttctcttacttcctcgcttggccacacttggacttcttgccagacttagagcatgctgggaatggccctgcctcagaacctttattctagctctttcttctgcttaagctgccagagtagtgcttttaaaacatgtcagatgattccgcttttctgctcaagaccccagtggtttccctgtcaccaagggtggaatacagaggtgtcctttccacaggacagccctactccctctcagcactcatttatgctcattcttttgctcactctgctgtagccatggtggccccctaactgttcctggaacctgccagtgtggccccacatttctacttctgtgttcttcacactcaatcctttgagttctcagttccgattgttagctcccccagggacctgctatgacttgtctgtcagcatttcttggtttcacttgtactgtttatcttgtattgttttccttcaaagtacttagcactccctgatatgttattgattggtgtatttaccagttccctgacacataataagtgctcagtaaaaatttttcttgggtgaatgacatttttgttagtttttcatcagagttcatacatgctaatggttcaaagagcaaatagaaagcagcaggctactgctccatccccagatgcacccacttttaatcatgtctgtatatctgtatgtacctaaatatttggaattttgttaattgtttttacaaaaatgggatatatattgtatattgttcagcacagatgtctttatttgtgagtagacacagagtttgcctccttggttttattggcttactattctgtggtagggctatgtgataatattcccaagtcaaggggtgtttggattgttttaaaatttcttgtacagtgagcggtgctgtagtaaatatttttgcacgtatagacttgtatacaaaggcatatttttgtatgctgctttgaaatggaattgttgtgtctaagagtatgcacatttaacatgttgatggatactatcaaattgctctccagaaaagactaccaattttcattttctccaaccgtatataaaaatacccttttattaacagtctcacccacatttttagatttttgctagttttataggtgaaaatagtatcatcttataggtttttgtatgacaaaatgctcatttgtatttcctcttctgtttcccttcctgattatgttgttgctccatttttctgttggattctttttctttttttttttgatagacatttaggtcttctttatatattatgtatttcggatgcacagtcttctcttaatattgcagatactttttctcatctgtcacttgtcttttgtggtagctcttagaagttttaaattttaatgtaatcgactttatcagatatttataattttatcttaacagtgtactcctttcaccaaatctgcaaacatttttttcctaatatttatatacttaaattttttagaaaacttttttgttaaggataacatggaaagataagcaactcctcaggataatgggtgagtgacttccaaaaagagggcctcccaatggccagtaaacatatgaaaagttgtcccacttcattagtaaacagggaaatgcaaattaaaagcacaatgtgatctcactgtgtacccaccggaatggtagggtgatactaagtgatggtaggacatggaatagtgagaacactgatttactgttggtgaaggtgtaaatggacacagccactggggaaactggcagtatctgttaaagcagaacatatgcattgcctatgccatagcagttccatgcctgtctctatctctttctgcctcttgctgtatataagaaatgtataaatattaactaaaagaaaggtataagaatgttcatatcaactctgtagtaaccaaaacctggaaacaacccaaatgttcatcatagtcgaatggatgagtaaatcatgatgtgttcagactgtggaatactatacagtacagaggaggaatgaactgctgctacacgccagcactgcaagggtgattttcacaaacaaggttgagtgaaagaaactgcatagcaaattaccacaaactcagaggcttaaaacaatatccattatctcctagctgtataggtcagaaatccagatgggcttggctgggtcctctgtgcagggtcccacaaagccagaattaaattgtcaacagggctgtattccttactagcatctctgggggagaattagatttcagccttattcacgttattggcaaaatccggttctctgtggttgaggtccctgtttccttgctgcctgtcgtccaggagtcagtctcagcttctagaggccacctgcaatccttggctcatggtcctttctgttttcaaagcagtgatatgactagtctttcttacactttagatctttcaaacttctcattctgctgccagccagaaaaagttctctgctcttaagggctcatataactagattaggcctacctaggcagtctgtatattaaggtcagctctgacaaatgatgtaaatatctcatcagagtcacagattccagagattagaatgagacagctgttatgggagccataattcttgcctactatagaagtcagtcacaaaagagcacatatactgtgtcattctgtttatgtaaagttgtaatacaggcaaaactatgctgtaagtcaggttaatggttacctttgcggtgggggtgctggtggtaactgaaaatgttcacaaggaagctttggggtgttggtgataacctgtccttgatctggatgctggttccatgagtgtgttaagtttgtgaaaatacatcaagctatatatttatgatatgaatacttttctatatgtatataatattaaatataaacaaaaaaatcagaaaactgcataaagcaaagtgtaagtgaacgaatctgttgtcagggttcaaccggagaaatagaaccagtaggatatagctaacctgcataaacttgtgtgcaaaggttcaggttaatatgtgtgtacctcatggtttcatactgttacctccaattcaaattcaggacaacagagttttcactttagttgttcctctgttttttttttttttttttttttttttttgagacagagtcttgttctgtcgcccgggctggagcgcagtgacgtgatcttgggtcactgcaacttccgcctcctgggttcaagtgattctcctccttcagcctcctgagtagctgggattacaggcacgtgccaccacgcccagctaatttttgtatttttagtagagacggggtttcgccatgttggctaggctggccttgaactcctgacctcaagtgatccactcatctcagcctgccaagtgctgggattacaggtgtgagccaccgcgcctggcccccctgtttcttctatatcaagaatcctggttttcagaaataccaagggtgatagaattaagctagacaacattactattcacacgcaaagcattcttagaataacaccacccaacactgttaccactgacatttttgcatatgttcttcctgtccttacacattctttataaggttgttcccacattgttggagcacagagccattatatactgtttgctctctctctttctctctctcatctttcatttatcctagttcttcgtgtaaatattgaatgcacatcatagtctttatgttgatgtccccccagtcatcatccagtcattttgattgtatgttactcattcgtctgataagtagattgccttaagatttatgggaatgatattccctgagttatctcatgttgctgacaacttgtctgtggcctttgtacttgaaattcagttttgctggatataatatcttaaactcacattttatttccttgagcatcttatacagtgccccattttcttttgttgtaaagcatcactgtcaaaaagtgtgagggcaaactgatttctttcttctatgagtgatgtgttctttttgcctggatgctcaaaggacttttgggtcagtttcccccaggtatacaaagtaccctttcatttcattttgcgtgtcatttcacccagtgtgtgtgtgtgtatgtgtgtgtgtgtgtgtgtgtgtgtgtgtagtatgtgcatgtgtcacatttcaggaacattttgttgaaatgaaggatttagaaatttttttggtcccctgctttggtttttttttctttgtggattcttgttatatttatgttcagtctttgcttatgttgaatatttttgtcctatctgaattttaatacagttttctaattatggattggattatttggtcaataagtatttatttggcatttactttgtgccaaatactttcatgttgtcttgtttaatccttacaacaatcctttgagtaattttaaaattgcatttgtgagatgaggaaagtggtttaggaaatgccagtggtaagtcaggtgatagggagagttcaaagctgtaaaaggtgtggcttcccaattccagggtacatgcatccctgaatgttggcagtaacactagatcttcagaatgacagacacattaccttgtcttaatccctaacatctgtcagaagtagtaggaagggacaggtaaaagctagctgtcttttttacctggtcaaatatagatgataataaatgtctttgaaaaattttaaattaatatcatatctcaagctcagaatttatttaaattgatacaaacaacactatttagtttcacgatggaggtagtagaaagataggattttgtatctaaacatactggtttcttatcctgattctcccatttacccactagctatgccagctaaggaaacctgagccttcatttctttaactgtgaagaagacaactttggcctcagcagggttgaggattaaatgatacaatgtatgtaaatatattctttaaccaaggggtcagcaaactttctgtaaaaggtcaaatggtaaatatttttggttttgtagatcacatggtctctgtctcaaccactcagttttgccattgtggtatgaaagcctgagtagagaatagctgggctccagtgaaacttaacttacaacaaaaggcagcaagctggatttgacctgagggctgtagtttgcccacactttactctaacctataaagctctgtgtaaatattgagtaattgtcatgactttctctcttcaggctaatgtaatgcttgaatatgatattgatgaagctcaggcattgttggaaaagaatttatcgactgccacaaagaatcttgattccctggaggaagaccttgactttcttcgagatcaatttactaccacagaagtcagtatcctttcttaaaacaaaaagcaagggaaaaaaggagaaagatttttttaaaaaaacattctttcatgggcagagggagagcattaggaaaaatagctgatgcatgctgggcttaatacctaggtgatgggttgataggtgcagcaaaccaccatggcacacgtttacctttgtaacaaacctgcacatcctgcacatgtaccctagaactaaaaaaaaattagaatacaaaaaacctcccacattctttcttacattgctttagtgggaagaatttccttattaggctaatataaaggttatagattttataagataataaataagatattcggaactagtacttaaataagtttgtagatagattagtgattttgaaatgtgatgtggaaacagcaaattcacataggtgagtaagtatttttcttccaaatattttcccaagacaactttataactggttaaatagtttaatttcacaagcatttaagggtctcctatgttcctgcaactgtgctaagacatatggggcatgaaaatcaattttagaaaagagtggcagtgcctttctctggtagaactgtacatgtaaaacagctgaatgataattcatagcaaactataagtaagttaacatatgcaacaccaaggcaatttaaactttgggaaagatagatgtaggctggacttagttcaaagaaggctttgttgagaagataaaagttaggctgcttttttaaaggcggcgtagggtttaaagatcagcagagagaagaggtgggagtggggtattctggtcaagggggaaggcaagctctttgcctttcttctctggcctgtcttttcctcctacttcctgtcacagtcactcaagacaaaatcacgggagtcacctttcacacttctctcttcctcactaccaataataaatcaatcgccagattcacatcaaatttccctcataaatctctctgcccattactgttctcgttctggggctccaaaacctgcactcagaacctttttaggttcctctcattccatctgtccttcccactatctctagtatgaatttactaggtcactcatttttattcctctggttacaatatttcaacggttccttgttacttacaagatatacatataggcactcttgtgaagtgcccccagcttgtctcacctcatgccactgacctcttcttgcctttccccagtgcattccaggttccagataaccccagtcagttattgtacacactccccaattgtgccacaccctttgcatttctacactttgttcctcctaactggaatgactttcccatatttacaggatgtgctctttttttacccttttaccctaaatatctcagtccaagcatcagagctttcctgaacattttctgatcctcagagtgtttcttgtgtgcttgcttaacacatactgcttagttttaccttgccaaaccgtgagctcttcagatgtaggagctgcactttctcttcttttccagtgtgcagcatgtggcagttgtttatggttggctgagggaaggcaggcctgttggggcctagtgcagtggtcatcatcatctgacgggtagtgtggaaacttcatccagctatgagatgacgagggcctaggacgggtggcttgtggaaaggaaaagatattaaacgtgtgagaaaaaaacaggatccagtgacttagatgggtacaggagccaaaagtgaggaaatcctctaagatgagtcctacaagcttagttaaatgccatttgttattgctagtactgcaaaaggtaggaaaggaaggtgtgcagacaagtgagggagctagggtggacagtctctgttacattgacattctactggagtctaagctccacgaggaaaagaacttcacctgtcttattcaggtcagggctttgtacagtgcctagtcaaaaatacagtagatgcttaataaacttgttaagccaaagggagggtaagagataaaattattgataattgtaataatataaatattacatggcaggatatgggttgagtgatctttcagatttcttggatgagggactgtctttaaaactatcgagagtgtctagtacatatttgttaaatatatcatagttgactagctgacagttgactaataccatagtaaacaatgggttaacaattaatttgagtccttagttttgatagagtttaattatagtattttcctaacaattgacattatagcaggatgtcttacaatactatttgttaccagtatttgtatatgtttcatttctgtgtctttgattcattgtgtgagtggagtgaatacttagtcattgcatgcattatctttagaattgcatttgcattttctttgacaattcttgcagatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaacta

SEQ ID NO: 4106 - DNA, 42041 bp, human
ttactcagcttttcatctgctgtgttgaaagccaacttatcatttttcacattattgtatacatctaaaagacatcataaacgaagactggaagtgaaaactgaaaaactgagaaagttttatttgttggaggtaatgtgattatggttgaaatttttatttaatttgtctattgttattgttttgtttatgcagtacagaaaagtcacaactctttctttcttagctaagttcacattactctctgatgtgcaatgttttccaagcaaattcctgttcctcaggaaatttgagctattgtgaactctgctctgccttctaaaacaacacagcaataattagatgtctttaaacctcttaaggaaagataattgcttaaggaaagatcactgtcttggctataaaaagttcactatgaatttgttctcaatgttaaacatatagcagaaaatgttctgtatcttttaatattgcttattaaatactagtagaaaatttactttttgtcaaggttctacctccagtgactccccagcaaatgcctatgtatagaatggtaagaaaaaacgctcttttttaatcattcatttgagtttattagaaaattttgagagctggcagccaagatggccgaataggaacagctccagtctacagctctgagcgtgagtgacgcagaagacgggtgatttctgcatttccatctgaggtaccgggttcatctcactagggagtgccagacagtgggcacaggacagtgagtgcagcgcactgtgcgcaagccgaagcagggcgaggcattgcctcacttgggaagtgcaaggggtcagggagttccctttactagtcaaagaaaggggtgacagacggcacctggaaaatcgggtcactcccaccctaatactgtgcttttccgatgggcttaaaaaacggcgcaccaggagattatatcctgcacatggcttggagggtcctatgcccacagagtctcgctgattgctagcacagcagtctgagatcaaactgcaaggtggcagcgaggctgggggaggggcgcccgccattgcccaggcttgcttaggtaaacaaagcagccaggaagctcgaactgggtggagcccaccacagctcaaggaggcctgcctccctctgtaggctccacctctgggggcatggcacagacacacaaaaagacagcagtaacctctgcagacttaaatgtccctgtctgacagctttgaagagagcagtggttctcccagcacgcaactggagatctgagaacaggcagactgcctcctcaagtgggtccctgatccctgacccccgagcagcctaactgggaggcacccctagtaggggcagactgacacctcacacggcggggtactcctctgagacaaaacttccagaggaatgtcagacagcagcattcgcagttcatgaaaatccgctgttctgcagccactgctgctgataccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacgcagttcctcaccagcaacggaacaaagctggacagagaatgactttgacgagttgagagaagaaggcttcagatgatcaaactactccgagctacaggaggaaattcaaaccaaaggcaaagaagttaaaaactttgaaaaaaatttagacgaatgtataactaaaataaccaatacacagacatgcttaaaggagctgatggagctgaaagccaagtctcgagaactacgtgaagaatgcagaagcctcaggagctgatgcgatcaactggaagaaagggtatcagtgatggaagatgaaatgaatgaatgaagtgagaagggaagtttagagaaaaaagaataaaaagaaatgaacaaggcctccaagaaatatgggactatgtgaaaagaccaaatctacaactgattggtgtacctgaaagtgacggggagaatggaaccaagttggaaaacactctgcaggatattatccaggagaacttccccaatctagcaaggcaggccaacattcagattcaggaaataaagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaactctacaagccagaagagagtgagggccaatattcaacattcttaaagaaaagaattttcaacccagaatttcatatccagtccaactaagcttcataagtgaaggagaaataaaatcctttacagacaagcaaatgctgagagattttgtcaccaccaggcctgccctaaaagagctcctgaaggaagcactaaacatggaaaggaacaaccagtaccagccactgcaaaaacatgccaaattgtaaagaccattgaggctaggaagtaactgcatcaactaacgagcaaaataaccagctaacatcataatgacaggatcaatttcacacataacagtatcaaccttaaatgtaaatgggctaaatgctccaattaaaagacacagactggcaaattggataaagagtcaagacccatcagtgtgctgtattcaggaaacccatctcttgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagtttcataaagcaagtcctgagtgacctacaaagagacttagactcccacacaataataatgggagactttaacaccccactgtcaacattaggcagatcaacgagacagaaagttaacaaggatactcaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaacaacagaaattataacaaactgtctctcagaccacagtgcagtcaaactagaactcaggattaagaaactcactcaaaaccgctcgactacatggaaactgaacaacctggtcctgaatgactactgggtacataacgaaatgaaggcagaaataaagatgttctttaaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaagttaatgaatccaggagatggttttttgaaaggatcaacaaaattgatagaccgctagcaagactaataaagaagaaaagagagaagaatcaaatagatgcaataaaaaatgataaaggggatatcaccaccaatcccacagaaatacaaactaccatcagagaacactacaaacacctctgcgcaaataaactagaaaatctagaagaaatggataaattcctcgacacatacaccctcccaagactaaagcaggaagaagttgaatctctgaatagaccaataacaggccctgaaattgtggcaataatcaatagcttaccaaccaaaaagagtccaggaccagatggattcacagccgaattctaccagaggtacaaggaggaactggtaccattccttctgaaactattccaatcaatagaaaaagaaggaatcctccctaactcattttatgagaccagcatcatcctgataccaaagccgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaagacctttgacaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaagcaggagaaggaaataaaggctattcaattaggaaaagaggaagtcaaattgtccctgtttgcagatgacatgattgtgtatctagaaaaccccattgtctcagcccaaaatctccttaagctaataagtaacttcagcaaagtctcaggatacaaaatcaatgtgcaaaaatcacaagcattcttatacaccaataacagacaaacagagagccaaatcatgagtgaactcccattcacaattccttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcagtattgtgaaaatggccatactgcccaaggtaatttatagattcaatgccatccccatcaagctaccaatgactttcttcacagaattggaaaaaattttaaagttcatatggaaccaaaaaagagcccgcattgccaagtcaatcctaagccaaaagaacaaagctggaggcatcatgctacctgacttcaaactatactacaaggctacagtaaccaaaacagcatggtactggtaccaaaacagagatatagatcaatggaatggaacagagctctcagaaataacgccgcatatctacaactatctgatctttgacaaacctgagaaaaacaagcagtggggaaaggattacctatttaataaatggtgccgggaaaactggctagccatatgtagaaagctgaaactggatcccttccttacaccttatacaaaaattaattcaagatggagtaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattctcacaacctactcatctgacaaagggctaatatccagaatctacaatgaactcaaacaaatttacaataaaaaatcaaacaaccccatcaaaaagtgggcgaaggacatgaacagacacttctcaaaagaagacatttatgcagccaacagacacatgaaaaaaatgctcaccatcactagccatcagagaaatgcaaatcaaaaccacaatgagataccgtctcacaccagttagaatggcgatcattaaaaagtcaggaaacaactggtgctggagaggatgtggagaaataggaacatttttacactgttggtgggactgtaaactagttcaaccattgtggaagtcagtgtggcgattcctcagggatctagaactagaaataccatttgacccagccatcccattactgggtatatacccaaaggactataagtcatgctgctataaagacacatgtacacgtatgtttattgtggcactattcataatagcgaagacttggaaccaacccagatgtccaacaatgatagactggattaagaaaatgtggcacatatacaccatggaatactatgcagccataaaaaatgatgagttcatgtcctttgtagggacatggatgaaattggaaatcatcattctcagtaaagtatcgcaaggacaaaaaaccaaacaccgcatgttctcactcataggtgggaattgaacaatgaaaacacatggacacaggaaggggaacctcacactctggggactgttgtggggtgggggcggggggagggataccattaggagatatacctaatgctaaatgacgagttaatgggtgcagcacaccagcgtggcacatgtatacatatgtaactaacctgcacattgtgcacatgtaccctaaaacttaaagtataataataataaaataaaaaaaagaatgcttggaatcaattacacccaattgctgttaaatttctccaatttatcatgctataccttgcatgagtagtcaaagaggacatagtatacaaagtatataacacaaagatagtttgagtaatacggtggaaagactatatcacaagattggaaacaccctgggatcaagatcaaattctaatgatttgcacagctatcggaccttgtggtgtaacacatggattatgcattatgtgttagaaatggtttgtgaaggaattcatcgattttgtagcttgttttatttaggctctgcacagaacatctatactgtatgattgttcactttatctcgtgcagctgtttgctagagaaccataaagaagggttttgaaaacattttttttttgagatggagtttcactctgtcacccaggctggagtgaagtggcacgatgtcggttcactgcaacctctgccccccgggttcaagcgattctcttgcctcagcctcccaggtagctggggttacaggcgtttgacaccacgccaggctaatttttttatttttagtagagatggggtttcgccatgttggccaggctggtcttgaactcctgacctcaggtgatccgcccgccttggcctccgaaagtgctagaattacaggtgtgaggcaccacacccggccagaaaagcctcttttaagatatcaagagttggatatatggttacaactacgaacagaaaaaaattatacagatatttttaaatggaaggtaatccatccacattcttttcttgcattggaaaaaatggcagctctctgaaaaataatatagcacatgccttgtgagatggctaacagtaataaagaaaggaaccctggaaatggggatgaaaagagatgcacagaagtggaatagtcaagagaaagctgcttcagaattaatagataatccaaaataggaattatcaacatgcacataatagagattcaagtattaatatggtttagtttaggttacattcttggtttattctaagagttatgaactactgtttgctgctggtttttctccccttctgaaggattttattgttgtctcattttgttttgttttatttgccattttgctgtttgggatcacttctagtctatattaatcaggtttaaaaagttgaactgattttgctgttatcatataaagcttctaatgggagacattgttaatacagatagaatatctggaatttttctgattccaactttcttttaactcatttttagtttattgtttatattctgcttatttggcaaattttcatgatttaaaatttttcttagttaaaaattgtttgtaatcactagttctatttgtagcttcagtgcactgcataaattttatgcaatacaatacaggtaatggaaactctgaagtcatttagttgctccagccacacaccaattagctcatgttgtttttgctgttggtccattccagaaaatggtaaatatacaggaacatacagaggataacaaatattcatgtttctgatacatctcaaattgcacgtgtccaaaactgtacccttgatctccccaaagctgttctacttgcagccttcccaatcacagctgatgacatctccatccttccagttgctcaggccaaaagccttgcagtcctccttaatacatctttctttcactccacatacaattcatgagcaaatgcaatggcctttattttcagaatgcatcctaactttttcctaatccattttctttcacctgggtcactgcagtagcctcctacctgggctccctgcttctgcccttgctccctacagtgttcttcacactgcagccagagtgattggcttacagtttaagtcaaatcaagcaacttcattgcaattgcccccacttctcccagagcaaaagccaagatcctccatgcttcctctctgcttccatctcctgacactcctgccttgcttagttctttctaggcacagggctactcggtatatattcttgaagtaaggcaggaacaacccatgtttgtattaaaggacattgaggttgtctccccggttcacttttcaactcactttaatgtgacttctatccccactgttccactaaactgctaacgtaaaggtctctaatgactttcatgtgactgaatctaatagctacttctctgtccttgtcttacttagtccttctgtcttatcactcaactagcacatattctaattctaggaatatggcaataattaaaagaaacaaaaacccatgtccctgtgggatgtacattctagtggagggaagaaataaataaggtgacaagtgccatggagaaatttgcagcagggaagaagaattaagagtattggagtaggtttccattttaaataggctggtcagtgggaactctattgaaaaggtgactcagtcttgagtagaattttttttttttttgagacagagtcttgctctgttgcccaggctggagtgcagtggcacaatctcgactcactgcaagctccgccccttgggttcacgccattctcctgcctcagcctcccgagtagctgggactacaggcacctgccaccacgcctggctaattttttaatatttttagtagagatggggtttcaccgtgttagccaggatggtctcaatctcctgacctcgtgatctgcctgcctcggcctcccaaagtgctgggattacaggtgtaagccactgtgcctggccttgagtagaaattttaaagagtagaaggagcaagtcaagtggaagagcattccaggagagggaataatcagtgcaaacaccttgaagtaagagtgtgctgagagaaagaatggatgaaatcaactaggggtgagtggagaatgagcccaagggtcgtctgtcactggggcaaggaaatgagaaggaacctgcaaaagaggtggaaaaggagtggccagtgagagaggaggaaacactctcccttcctagagttagaaacaccattttctcttagttttcctcctacctcatatctcttttgagtcctgtttgtggacttctctatacatcctctataataatatactgtatgtgccagttagtttccagaagaggattcgagtataatatgatactaggtgtgcatgcatgttagaactatgagtgaacccaagcccagaaaaaatagacttagtaagaatttaaggtagaaggagtagaactgagatactccacaggtcagggtccaagtaccaaaggagtgtggtagattccaggttaggcatcagtaaccaaagtccatttattagtataacagggcttgaggcaaaagtatgggttgcagaaaaaactatgaagggctacgtaaaaagccaggctatttcagattctttccaaacaatggtgaacagaacagggcccatttcccagggagagaagctgacaggaatcgggtaaaaagtagaccctagcattgacttgactacagaatgagaatcccactcctcaggcatgaataactatggacccaggtggactgaaggaggtatattcacctaggtttcctaaaaggactaggtgctcagtctagtcaccacatggggctattccagggtgtactatctgatagcatcacagaagtagaccaagatcttcatcctcaggcaagagcaatttcaaggatttctaggcagcactggtttgtaaggcaagaggtcttggtaccttgctcacttaggccctttgtttgatactgcagaagtggcatccctgcacactgaagatagctaggaactgcttccaaattgctggcatggggctgagacaggaggaaggactggaaaacttaaatgttactatcaactaaaattcttttaacttcattttcacttctcatccattctatatatatgtgggtatttttttaagatccaagtgctagactctgttaaccttcctcttattcagttgggaccctatctctagtctgtcgagaaaattaatgtttctgattatatttaatatattcattatcctttccaatgtgtatgttattcacatgctcagtgaacatgtcctctacaacattttcattgatagatgaagatgaacaagaagatcaagaacataaccctgtagtgtatcaccagaaacctctcagcaggtcaacatattaacccttagcctttggttatgagtcatttgaacagtttctaatttacccagttgttcttaagtaagcccatatttcctcaatcagtgagggagaagtgagggaaaagatcaagaggaggaagcagtaggcttggtaagccatgccaaggagtttacacactatctacagtcaatgagggtccatttaatggttttaaacagtggagggagatggtcacagtcttatattaatgggtctgtgcaacctccttagtttgttcttcattaattgctattctttcatcttttgaatataatttaaaatctgagctcataaagtaactagaagagtaaaacaaactaaagagatgtcaaagcctttctagttccacctacgtccttgacctgatgtgcttgcgcttccttcactactttcatctggcaaatttctatacatccttcacatttaacctgtagatcgccatatcaaatcatatgttcatactaaagtatttcatgaaagatacatacataccagtatacatttaacatgttccatgtccacctacaaacttcctttctttttcctatgagtattattggccttgagatgttggagttctgtcttgaaaagagtcatttgtaggccttactttgtggctaattcatccctgcttttcaataactattctttaggttttccacactctttggtctgtcacactttatcactagcagccccttcacagatacattttcgtctttttctttgcatctggcatttagcattcctttcaattgatgcttattaaatattaatataatatttactctagggggctacttgttctcatggtactattgtattaggagagcaattaaatactaattaatttttaactgattgttttcttttacaattcataggttccaactccattgggagctccttctctaatggcacctcaacccatgattcatacccagcaaggcctaaggaccagtagtccttccactccatccccagagcatcaggtacgtttgggctgttgttgctaagggccttggcagagataggcagtcactggaggcaggatcagtgttataatggagttttgcaacatagccatcttttgtatactgttggtctctcatagaagaaagcatagttctaacattttcatcatcatagaaagacacagaactgtgcagacctggtgcagacctctataaacttgtgttgttaagcctcaactggcttcttatatttattcagccatccttttattcatttatttgtttattcagtcaacaaacccaactgtgattagtattggagaagtggctaactcagtctggagatttcaaggatgacttaccagagaactgatatttaagtttaataataagatttaaaaatagacagagagttaacagagtgagaaagcgtgctccagataaacacagacacagagagggaagcacaaagcaccatgggaactcaaagaacggaataattaatttagcaaaggaagctttcaagtactgaatgataaagaagatttcaaatagtagatgtatagcggatagaagaagtttggcattacaggcagaaagaataggttgaacaaagaagtggaagtaggcagtggtaatatgagtgagtatagctgaagtgtatgggagagtgtcatgatccaggtgtccattgtctcagagtattgttttctagaagactttacaaggtttcttctttcagtcttcagctgatgtgctgagccccctgatacctgaacatttgttttaggaggagtgacaaagcttcaggtgttagataatgagaaaaatgacgagagttttgtattaaaatatttgtaatttatttcataactacaaataaaaatatgtataaatgattaaatatttacagatctgtctctcattcagacgcagtccaagtagaggtcccaaagcaaaaagattcagattcagaagtgaataaaaagatctttcaacaggctgaactgaatcctccacatcttccaagtaaaataaacgtttacttggaagacattcaatactcttgaaattctttaatttgacgtttggaggttatgtactctatttttcttattttaatggttaataattcacctaacccactctagtcttccaaccacaccccttccctaacaagttcctaaaagcacgtgtgtcagcccggtgcagtggcccaagcttgtaatcccagcactttgggaggttgaggtggcaggaggatgacttgaagccaggagtttggaccagcctgggcaacattgcgaggccccatctctacaaaattacaaaataaagaaattagctggatatagtggcatgcacccatactcctagccactcgggaggctgaggcaagaggactgcttgagcccaggagtttgaggctgcagtgagctatgattgcaccattgcactccagcctgggtgacagagagagaccctgtctctaaaaaaaagcacatatgccatgtgtcatacaggcgcagttctgggccctctgagtgccctcagtagccacagtacaagccttacttcataccaggtgttcttcagttgtttggcccctttagggactgctacagatctagtcatgactctcatctaatccagagccaggtccctaggtaaaatctcaggacttcatcccctgaagactgccatggagtgacaattcgcttccttcctgtcctcatagcaaggctgatggcatcattttgctgaaattgatttcctgagcagactctccagactcccagcatgtaattgctgtagctgctctctaagtaacagcaagagcaatggttgcctatgattccttgtcttgggcagggagtgtgatccctgagtaactaacataaactcaccttgccatgggaaatttcatcaagtattctggtctctgctggcttggctttcttgaaactgtaatgtgcccacacaccgttatttttgagccatcatctgtatcacaaataaacagagactacaatatgtgaaaggtgatgaattttctagagattagcaattccaaaatcctctttaggaagaggaaatggaggccctaagagagatgacttccaaggtttcttggctccaaatccagaattttttccaatgtgtaggcaaaagcaggtcttccatgcaagatggagtcccactacacttagtgtctctggcacttagcattaactgtcttgcccagctaggtggtttttcatgtgagtgtcttagtttcttaactagatttattatctccagttatacactgcatcggattcttctagtgtaatttatcttcactacctcaatgttgagcacattgtacatgctccacaaacatttgttgcttgattcacacagtcaataaataatgatcaagcaataaatattgatcaacttgatcaataaataatgatcagttatcaagctcagtgtgaggcccagagaagcaaaggcaagagaaacaagtccatacccttaagtatttataggctgatagaggcactcgtctcagcttctccttttctttggtactgacatcagacattttagagtcaagttgaaaagagttggtcgtatttttgggctttcatatttcaaggcatttcaacatatccacaaatagcaggcccagtgagctgtgcaatatcatggggctccaatgttttaggagttagtcctgagccagactgaatgctctctcttatctgtatatgtgaagaatagcccttcttcctccccaggaggctgtgagggatttaaaacagatgtctatctgagggaccctgcagatctcccatgctatgagcaggctgtgtgatttctccccatcatgaggccattatcatgacatgttatggctcatgtctcaaacccttgagtttcttattctgtgccatatccatgcctttcaattatcaggacagtagctgaaatttattgagggcttactaggtactgggcacagtatcaagtatgttattatgtgtaattccattcaatctacttaataatatgtgcccaaagccctattattatggttattttacaatggagaaaactgagacagtgttaaagtaactaacctaatatcccatagccaataaataatcaagcttgactgcaaagtgcatgctcttagccttaaccattgtgctggaaatgcaccatctctcccaattattatacaggaaaacttgtgactgggaatttaccatggcttatactgaaggtcttcatgtatcctaaggagtccggcccaaaggagattcaggaacatgaaagcagagtttgaacctttttacatccatgctttttattgggtttggttggaaaggaagagcttgggtggacatgggggcagagggatttggagggtgtaattactcaccttggggcccaagatcaggttttctaaattgagaattgcatagttacagaaggaacccggaggatccagtgggatctagtgacaaccatgggatgcagaattagtactagtgccctgatgactcaccagaggtcgtagtcaaaatgtattagcactagaagtgagtctggagatcctctagtccaaagctcacatttcacatgtgaggacactgagctagataggtgaagacacttgtctaatgaggcacagcctgttaaatgacagggttaaactagaacccaagttctagggcctattacacagtggcaagcctagaaatggattctggaaataaagcagggtaatgtctgggagtccccagggccatcattctggcagatgaggtggtggggtgggggttgcagaagggttagttccctgaacaaaggacctctccacatcaccttggataaataacatcagtcccaggaaaaaggaaatcacattgccacattttaccttgtctaggaaaatcctaccttgtcctctcttgtataaacagagcaaaaacactgaagatacaataacaatacacagtgagaacactaccagcacactcaacaacccagggtagtgagtatggaggcccattggcatgtctggaaatagaatacacatgtattctgacttactaggaaatagccccaagaggctggggtggcttagcatgcaggagcactatcacagttgagtgccctccaggggagttccaaagcccctaggggaaactgcactttctgctctcagaagtcaggattagaaactgaatcagaaggtcgagcagaggctgtctcagaacatcctgaaatgcttggcatctctctgaaggccttgggctctttcccagtgggcttcctgggaggaaatgaccccagtgaccaggctcaggaaaaaggagacacattcccccagcctcaggatttgcagctcttcagagtaatttcagaggcttgtggagattgggacagaacctgttacctgcacaaagcttccaggcaaagatggagtgagagttgttgtcggttcccggctgtacaaatttaagtcaactcttggttatctgggttctggaagttgctaaggatatcaccctcttcttccaggggactccaattgtatgtcacatcattttcttccttctctgcagagcacattagtgtgacatttacaggtactattcactgaagtcattaaactctggcttcccaaaatatgagccagtggtgcaccagagctggcttgtaccagcttgtgagaaccaattgttaaatttctagaaattctgcaagatggttgttaaacacagccatcatttaaaattaaattataaaaatttacaattaaattcttttaaaggcaaaggtaataaatattcaaaatttatcaccttctaattatttttcgacatttgaatgttacctatgctcttgaggttatttacatcgattgtatctgtgtgctactgggcatgtcctcccaactcgacatggattgaaatcagccattgtgggagtatccaggctacagaaattggtagatgctacaaactacggcttgatctatgtttgtcactctagacttgaaagcaatggagaaaatgttactaatgcagattcagcttaaaagtgagttgtgtctgtagccattattgtgaacagcaccataaaatgaggcaatatttttctggtatttgaaaaccattatccaattcagcaaataaatcactgacattgttgatgaatgatccaagtaccaatataaaaataattgttgaattacttttttcttattacttaacataaatgaaaatatcaagcaacattcatgtcagaactacactagttcatcaattgcaactgtaggttgtctagggagatatgtatttggcaaaaatcaaaagcatcctgtcagaattggttatacagaattaacgataaagagtattgtatattttattatcacttatgaaattgtgtgctatacaccttttacatcaatacaatttataataaatatataccccctttctaaagagaattagttgaacatttatcagcacaacactacgtgaaatgattgtttaagttgttctgtttcctgttgtatgcgtattttctttacattttgttttgttttgtttcaaaagtgtccatggtgaaaaactacaaccttttaaagtctgttttaaaaaatgcttttattaaagcaatctaaagataagctgtaaaaggtgtgggctactgaagggttgctaaagaccaatcatatttagtcaggtaatagctagatttggatctggcaagaggaagtttttttttttttcttttcctttttttttttgctaagagataagaaaatgaccacctatagagttgataaggttagtgtactcttggaaaagctgctgcagccatggcaggaaggaaagaattggtatacaactttctaattaagagaacactagaaaggaaatatattcagcagtataaataagggaatcttctgtttgtacctgtaagggagtaaaacatgagcgataagctgataaggcttttggctccaaaagaaaaacctggcccgaagtgtcaaatactatatctcttagagggatttattccaaattaaaattagtgataatttggagaaatatttcctaaagtttgaagtaagtccttgattggttctaacaatgattaatatagatagggatcagtgaagttgaacaaaatttgcatgtgtatctgatatctcaatgtttttctgtagaaacgttacctacttttcaaaaacaaaatttttttttggaaggcactgaggtgggggagagtggtgaagaatagaattcccatatacttttctctccaggaacagagacattatcttacaaaactgctgaccagaaaaggtcagagtcatggttagctaacatgtcttcatcctcccaagccaaatcgcatagaagccactggagaactagtttggaattccggcttcactactatgtagttgtaggattttggaggagctgtacaggttcactgagctttagtttcctcattcacaatatgacgataccaatttcttcctcatattatatctaaagacatatctatgtctatatgcttgatcgtacattatgtgcggagataaaccggtaacagtgattgcctctgagaagagagacttactttccattgcgtaattcttaggctcatggtagaatttgtgcaagtggatgaagcactgcctcactgggaaacactccagtgaaataaagcacagaaaagagcccgaagaataattacttggttctgtatgacacatgtgcttttaaagggttgtagtgtaggatgacattgggtaagtccatgggcctagaagcctaggtggagttcttaggattttgtatgtagactatgaagttttggaaacgtttgagctggagagaagacattctgatcaaaggtggctttcaggaaaggctggtgcgacaggcagggtatttattagaatgaggccagtgaccactctgaaacagacacaaagtaagttcccttcaaggggcaggaagctccctgggatggtgagaccagaaaggcacagaggctgaaccctcgtgatggcgctaggtcccaggttcgctagcatccgagagaggggattgggtcgctccagaggccattgcgaaggctgctgccagttctagggtcggggtggggtcaggctaggtccctattcctagggctttagcaccgctcactcacaagaccccttttcccaggaggacgtatgggtttttcctgtcgctccagcttctctttcgcggcccttccacgcttgtcacttacctgagcgcagccaatcagcacctagaggttgggctactttcggccaaaggagaacggggacttgtgggggacgctccctgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggtaagaggcacgctgttccctggcatcttggcttgaggccttggactgcccctttcttcccggctcccacccaggcctcgactgttggaaggagctgagccaagtgttcagggagggggcgctcggtctgctctcacccctcgcacctggacagattgagctctgctgggggcccgcccggaagaaacgtagctcgagaaggccgtagaagagaacggggtgcggggccgggacgaggggcgaggggcgaggggcggcgggtggcagggcagggcggcctgagggacctccgggctgccgccggttttcgtccccctgctggttggaaaaggggaggtggtgaggagctctcgactcagcatggatgctggagacacagtacaatgaataggcagaacagccagtgctaagatgtgaaaaccgggaatatcactttgtctgttgaaggaatgcagtggtctcgggaatgttgcctcgggaaatggaagaagagaccgatgggaaaataggatgataggttgggagtgtaaagtccttctgtgtcttgctaaggaattgaggttttccagtaggcaacgggctgtcatcagaaggcctttcgttttaactacatcattctaacaacttagtggagaatgaattgttgagagaggaggctgaaccctcctgatggcgctaggtcccaggttcgctagtgtcctagaggggatcgggttgctccacaggccgttctggagggcgctgcctgtgctgggtggctttttaaaaattttattttatttatttaatttagaaatagtagttgaaaactatttgactaatgagagaaaacatctgactggccctccaggccaggtcatctgtctgtccccacttagctactataaaatcttcatggaagtttctcaatcttttggtttgtaccttaccttacctctgccttttttttactaactacgtcttatatccttctaaagactcatttatttataccacacttgatattgtatattcgcatttgctgattgaatttcgtaattggttattattttgtgtttttatgagctgtgtcatttatttctctacattgatctattatctaaccataacaaggaataaaatttgttgagtgccaggcactttcttaatgattttacaaaattcgaggtggtagctactactgttatgcccgttttttagatgataaaactgaggtacggggcacttgagtaacttgccccaggccacacaggatgtaagtgaggtatccagggtttgaacttggacaatccgtggaggtccagactggcagcttacccctcatgctctgctactgggaggaggtgaggtagttctcatgaatcgccctacttctcctggtcatagcatagtgcctcacacatagtataagctcaaactaagtgtctaattgaatttccatagggccttaaatgttacattcatggtgctcagctagagatggcgtcagaaatctaactcgggaggagacactttatctgagggctttataatgtcttgaaatgctttttccctacaatgtcgtggttatttttttctagaccttaaaatttctaccaacataatgtaataagcaacccaaattttatataactgtttatgtttccaaactattaataattgaagtgacatggtattgtagaaagattattggcctctaaatagaccagggtctgaatcctggctctgcttcccagttgctgcttaaccttaagcatattattttaccactttgagcttgagtttctttaactgaaatagggatgacaatacttagagagttgttatgggaaacagagaacatgcttgcagtattgcagtgtagtaggtgtcgaataggtattaatattcatgatgataggaagcaatataccatagtggttagaagtcagacccagtccattccccaaccccgctgaggcagtaatttgttttctttctctgcttgaattgttgtttcacccttgtccatttcatgacctcttcatctttccacatctagttcagatatcatctccctgtagttttctctgacctctaccccaaaacaaaatccctggcactttgtgtccctgtggcacattatgctatacataggtgtcacgtactcttataagcgtttcacatatgctaactcatttaatccctggtgacgaaaaggtacttgtacagatgatgaggaaattgaggcaaagagaggttaaataacttccctaaggtcaactcatctaatgagtggcgaagctgggattcaaaccaggcacctcctgtctcttaaccacagcctatgccgctatagttaattcttgctaaactccagcacctgataacatgtatcatgtgccagaaacttacacttctttctcttccctgcagtgacccttctaggaagatggcatctctctttaacatacagaactcagccattatctctcagcctcaccttttcaatttcctttactgtctagtttgatggcttcttagttcactcccttgctgtgtttctcttcctttttcttccttgtttcagctaagatattctctggtagctagtaaatatggataagaataatgatgtgaagatcttagaagctataagataattgaagttacttataataaagaactagagttctgtaaagtactagacgactcttgtagcatctcttttaagtttcatatattttcatcttgtttctgatccttatctaattaactagcctttcttcaaggatcagcatgtggtataaaaaatattttaacatcagttttactgcttttcttttgatcagttattactgttacaaaagattattctgtttgccttttaggtttactttgtttcagttatttgatactgaaggaagcatttgtggattgccttgggaacccagtaaccatatttagtatgatttctatggtaaaacttgttgaattaaaaataagtaataaaattgataatcttgacatgcaacctgtaaaatcattttgtgaataggatgcatgaataggcaatgtatttgattgttagtttcatatttactactagggatgcatgggaaatgcataaagtggtgggcaaggtcattcttcttttcctatttttgaataaaaaatgaagaggaaagtgaaagaataaattagctatataatatatatgtaccatctgaaattgtctctaactttttataactacaggttgagcatcctaaatctgaaaatctgaaatccagaatgctctaaaatccaaaactttttgaacaccaatatagtgctcaaaggaaatgctcattggagcattttggactttggatttttggattgaggatgctcaactggtataatgtaaatattccaaaatctaaaaaaaaaaaaaaaatctaaaatccaaaacaattctggtcccaagcattttagataagggtgcttaacctgtacttttagttaaaaacaaacctttggagaaaaacaaagcttttttttcttctatgttttaaaaacaaagcagtcaaaaaatctgagtggcatgaattctaaaatttgtaaagtattatttttgatattaaaggaagatgtagattccttcatgaaacagcctgggaatgagactgcagatacagtattaaagaagctggatgaacagtaccagaagtataagtttatggaactcaaccttgctcaaaagaaaagaaggtaagtgtaaaaatttctaagttttgaaaatcttatatgacttgaacttttaaaaaattgagatataatttacatataataaaatattcagatgtcaagtgttcagtcctccaaggtggctgtaccatatgaaattcccaccagcaacgtacaagagttccagttgttccgtatccttgccaacacttggtattgccagtctaaatgtggttttgaaaacataatagaatggttgttaaagactgtattccaaagctttcaaaatcataacgtcttatatgtctagttcatccttctaattttgccagtgagattagagacccacagagtctgggcataagacttaattagttatgaaatcccaagatttcataactaataggcataggaaaaaagctatccttactctcaactctttatttccctacattattttatatagcttataaagtcaattcactgtaataaatatttatagatctctgttttgtgcatgtgccagcattcttctgtaagataaatatttatggaatgccagctagatgccacatactgttttgggtgaaataacatccagtatctgctttcaacaaggacacaggactgggcatggtggctcaaacctgtaattccagcactttgggaggctgaggtgggaggatcacttcagtccaggagttcaagactagcctgggcaacatagggagacccccgtctctacaaataattaaaaaataattaggctgggcccggcggctcgcacctgtaatcccagcactttgggaggctgaggtgggcagattgcctgagctcaggagtttgaaaccaccctgggcaacatggtgaaaccccgtctctactaaaatacaaataaattagccagacgtggtggcatgcgcttgtaatcccagctactcgggaggctgagttgggagaattgcttgagcccgggaggcgaaggttgtagtgagccgagattgtgccactgcactccagcctgggcaacagagtgagactccatctcaaaaataataatagtaataattagctgggtatggtggcatgcatctgtggtcacagctcctctagaggctgaggtgggaggatcgcctgaacccaggacgttgaggctgcagtgagatgtgatcatgcccctgcactccagcctcggcaaaagtgcgagacccagtctaaaaagcaaacaaaccacacaaaaaactagggacacagtttggtggaaattataggtatataaataaaattagcacacaaagtagaacagtagaggtacagggggatggtaactcattactttgtaccaaagcacctcattaacctggaggggccaaggaggttcagaggaagcttctaagaggaacagatagctgtgtagaatttcaaagattagttgtgagtttggaggcagactaaagtgaggaaggggtagtctgggcctaaggcaccatttatgcaaaggtacagaagtttgtaggtatattttctcatttgattttggtgacagttgtacaaagttgaatatgtactgagtattagatgagatgaaaagtcattgacatggaaagatggagagtgttaatggacagaagcaagatagaaaacattaagaacagtgtgctctcgttttggaaaaaaatgtatgtatgcacaggaatatctggagaaatccacactaaaggcatattaacagtggtaatctctgggtagttagaatatggcatttttcttgtttttgcttagctgttttcttaattttttacaatgtacatgtactgcttttgtgatagtaaaagtttatttgaaaaagaaaaataaagccattggatttgagatcacctacagggaggttacagatagagaagaaaatgtgccttggggcggggtgcagtggttcatgcctgtaatcccagcactttgggaggccaaggtgggcggatcgcttgagcccaggagttcaagaccagtgtgggcaacgtggcaaaaccctatatctacaaaaattagctaggtgttgtggtgcatgcctgtagttccagctactagggaagctgaggtgagagtattgcttaagccagggaggttgaggctgcagtcagctgtgagtgtgccactgcactccagcctgggcaacagagtgatgataccccgtctcaagaaagaaaaaaaggaaaagaaaatgggccttgggaccaagtcctgggagagggggaaatttgcgtatcaaacttaaattgctcttctaactagtaaattaatgatagacaaaaacaaaaaaaagaaaaaagttatattgctaactctacaactgtggtatgtagcaggatactcactctagcttaacatatggtctaggcctaaatgtggggagaaggggtaaaaattcaaagcacttaggaaacatcagtgaacgttggtgttctggatgagaacagtgtttgtctagtgttttaaaagagaatggtagagttggagatagtgagttaggaaaattttcttgagttttacctattttaatagtgggttggtcatttttttgagacaggctttctctctgttgcccaggccagagtgcggtggtgtgatcacagctcactgcagccttgacctcctgggttcaagcaattcttccatctcagcctcccaagtagttggagggctacttttctctttttatttttctggaatttctctcactcctatgatgtcagctatgcaacaaaactatttttgtgtcatgatctagttgttttgcagcagatggctctatgtagtttacatgctagcctttttgttttttttttttttcaatttgctattattttatttaggatttttgaatttctgttcataagtgagttcagcctatttctttctttttttttttaatttttttagtattgatcattcttgggtgtttctcggagagggggatttggcagggtcataggacaatagtggagggaaggtcagcaggtaaacatgtgaacaaaggtctctggttttcctaggcagagggccctgccgccttccgcagtgtttgtgtccctgggtacttgagattagggagtggtgatgactcttaacgagcatgctgccttcaagcatgtgtttaacaaagcacatcttgcaccgcccttaatccatttaaccctgagtggacacagcacatgtttcagagagcatggggttgggggtaaggttatagattaacagcatcccaaggcagaagaatttttcctagtacagaacaaaatggagtctcccatgtccacctctttccacacagacacagcaacaatctgatctctccttcctttccccacatttcccccttctctattcgacaaaacctccatcgtcatcatggcccgttctcaacgagctgttgggtacacctcccagacggggtggcggccgggcagaggggctcctcacttcccagacggggcggccgggcagaggcacccccccacctcccggacggggcggctggccgggcgggggctgccccccacctgccggacggggcggctgccaggcggaggggctcctcacttctcagatggggcggctgccgggcggaggggctcctcacctctcagacggggtggctggtcagagacgctcctcacctcccagacggggtggcggcggggcagaggtgctcttcacatctcagacggggtggctgggcagaggcgctccccacatctcagaggatgggcggccgggcagagacgctcctcacttcctagacgggatgacggcctggaagaggcgctcctcacttcccagagtgggcggccgggcagaggggctcctcacatcccagacgatgggcggccaggcagagacgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgagcgagactccgtctgcaatcccggcacctcgggaggccgaggctggcagatcactcgcggtcaggagctggagaccagcccggccaacacagcgaaaccctgtctccaccaaaaaaatacgaaaaccagtcaggcgtggtggcgcgtgcctgcaatcccaggcactcggcaggctgaggcaggagaatcagtcagggaggttgcagtgagtcgagatggcggcagtacagtccagcctcggctcggcatcagagggagaccatgcaaagagggcgagggcgagggtgagggtgaggctagcctttttctttgtatgtgttgtaaatcttgcagcctgtcatttaactttacccttcaagctgtgtaaaagttccttagtatttcatgtgttaatctctttttcgacacttgaatctgagatcttttatctttctttaattggaaattttgtgattatcactttttctatcgtctgttaattttttttcctctttctttctgggattcctgtttacagatgttgacacttctaattctgccttccatttatttatattatttcccttttttctgtctttgtcatttatcttttggcaattagatggatagccatgagttctttgtttcagctgttaagatttttatagctggtagttctggttggttcctcttcatattaccaatatcctttcttttctctttgtggtatctttaagtatttaatgtatagttttatcttttggtatttgttaattttgtttcatatggtagaggttgttgaatttattgtctttatttattataatgatcaaattataatgtcttttccctgtcagcttagattccctcagggatatcagctactttggccagtaatgtacgtggaggtgggggtaatttaagtcactcctggtgggtagcagtggcgctacctcggctcactgcaacctccacctcctggattcaagggatcctcccgcctcaacttcccaagtagctgggattacaagcatgcaccaccacgcccagctaatttttttgtatttttttttagtagagactgagtttcaccatgctggccaggccggtctcgaactcctggcctcaggtgatccacccgcttcggcctcccaaagtgctgggattacaggcgtgaatcactgtgcccagccaagctactttctcttcaggtgaagcagggtagggaggagtgtattgcttgggcatgtgctgtgtcattggtggtctggttcctaagttagctagggctgcatctgattgattcattaatatgctttatagcatattacatataatatttatatatacagaatgcatcttaaaagtcatttacatgacaaaaaatcttgatctgaacatactccttatgttgtgtgtgtatcacatattttacaaatgtataacatctttctgtttacctatatgaacatatcatgcaaaaataagcaaacttgagcaatctatggcatccagattgaattgtagtgaaaaaatgaatgctaggtgtttctagattattcactggactgtattatcaaatgatgacactatgtttttttcttaagcagcaggctcatttaacacatttcttgccaggtcagtagcacagggtgtagtaaatttgccctgccaacctgctgcacacatggagtgacttcttttatgtgacgcaataagttcattttcattgttgtgtttatattttgtttacattttggtctctaataatatttagtaaatttacctcgaaagaaccagagcttcgtttttatatccttagtctgttttgctagaaattacatttgacagagaccctagaactgttttgcatatatctccatgcaaaacacatgcatctaattaccataaagagctaaaccccagtgacaaaaacggtatcattgttttctctctttaattgactgaatgtttttagcatactgtttttctcttatgttcttgtcagtgaggttgattgcatttgggagtcacttactagcattttgctagtagctatcatataacttatccattaagtcggatcagttgtatcatgtccatcattgtttttttaaatttcttgtgtttaaatcagtgatccatttataattttaagaacgatcgttacctcatttgaaaagaagagcatttatcaacataaaagttaaggaagaaatacccaaagcttaaaagaatcactaaattatactgtatcataatgtggtgtgtttggcattcagatgattctgtacatttttcacagtgtgacaagtgcacatactgagaaggtgtcactgtgctttgcctggcatttagctgactgtgatgtacatgtgtgtatacccaatgcacacaccaggagtagctatgtgcatcactggataggggattggtgtcttctattttagaatgtaacttttgaatccatgttatttttaaaattagttttaaaattaatctatttaaaatttcattctaatcaaatgcagaacctatgaatcacctctgtggaatatagtctgctctagaaatgttaaatagccatggggtatttgacataatagaacagagctttgtcttcatggaatgggcattccataaacattcactagtatatcttaaatatttttattaagtatttatactttaaatattttatgaatattttactaaatatattttcttttggtgaatatttctttaaatattttatttttataaatatttatatcttattttatctcatatctaaaaatatcttaagtattttatatctataaatagtcctcaagaacacattagtagaaaatgcaaagttagtaagaccgtgtcctgttgtttatttttgcctgcaaaatactaagttactctttttcttgttcacaggctaaaaggtcagattcctgaaattaaacagactttggaaattctaaaatacatgcagaagaaaaaagtaagtgcatttttgtttgtaaatatgagcaagctaggatatgtcagcagaaactcgtcttctttgactctttggtcactgatatttgatctgtgctgtggaatccagtctgccttcttaagcacatacactaatgttatgatgtgcttctgtagcaaatgtggctttgtggccttcccccaaaagtcaagtttaattctagggcccacacttggattactttgcttatctttagtgcttgtgaaacttaaatgcaatttgaaattgttttaggtgtacaaagaaaatgtcttattctgtgctagcagcatctagggttttttctttgttgttgtctttctccctaagaataaggagttagtccaagatttatagagctggaacgaatcttagagatcatctgttacaggttctcatttcatagttgaggaaatggttatggagaggttatactcgaccattgtctatgtagttagttactggcagaactaaatttgagagtcttctaagtcttaatccagtattcattaaataaaagcaggttgtaaagattaaatctcataagcatattgtatttaaaagattgtgtgtatgcttatgattttgcttgactggtagaataactatttctagtacattttaatatgtggtgaactttgtaagacttcagcaactgattgattgggcatgaagcaccaatgaaataatagaagaatggctaattcttacaataatgccttctctgtatgtcaggcactcgggggtgtgtgtgtgtctgtgtatactcagtgcttaccactgacttcataggtgtagggactgttgtaatcctcattttacagatgaagaacctgagatatagaagttaagtgagatgccagatttgtacagctagtgagtagctgagccagagtccatacccagccacctgggtctagcattcatttcttttaccactacacttagcctgcatgatggtactgttttaaatgtcctaggttcaactgtgcaatctctcctttataaccttggtatcaaactggcctgtttatggtactgtcattttttttttttgttttgaaggagtccaccaactcaatggagaccagattcttgctggcagataacctgtattgcaaagcttcagttcctcctaccgataaaatgtgtctgtggttgggggtaagtaaatgttatagccacagctgatatatttgtaaaccagtgtgttttctgtagcaaacacactggttttgctagtatttgctagtattttagtagtattgctcgagatatgtaaagtgttcatctccttttgattgtggaagggacaaagggacagagtccaagtggttcatattagaaattgactagaatcagaagtgcgatgaagatcgcagtaaaaacatactgaagtctctcccaatcaagataaaactgatcaaacaaaccctgcttctcttccagttagtgctttatctctcttaaatataatggaggaagagcaatagaagtaaaatagaaggtactgctgaactttagataaacgcttcttcccataagagtttaataattctagaaagatccctctcaatttaaggggaaaaagagtattgcaaaaagtttgaggttagagtttattttttaaaaccatgtatttcagttttagatgatttcattgagcttatctgtgatttacctattttgctcttctcagtcctctgactatccagctacctgtctgtggatcttgttacctcaggcaagttctcatacaaagtagcaagccaagtgtacttctaccagctgtcctacggggaggatttcccctagctgctgtcctgtaggatcactctggagaggcactctagattagcccaaggaggtttgctcaaagtttgtacaacatttatatttcactctacaatctgcatttcagtatttatcttttataatttatcactaaggctttttaaaaaataactttgaagcatagcaactacacctgagtgtccaaggattcaatgattttctgtattcagtttttttgtagaaattgcatgaccttttgattcacaaattcaagtgttactttatttcaggaaagataatttctgttgtgtacttgaatgtgacttttgccccatttcttttattatcttttgggaataataaatatgcatatgttcgatctcctttatctgttttcagtacctatcatgttctctgttttcagttattcgatgtgtttcattctgtgtgatttcctctggctgcttccccatgactttgtgttttccctggtagttattctgttttgttgcttttactctgtctttcgtaactgttcttctgtttctctttctcttcattttctttgctgagctcttcttgctcttttcatgtttttcttctttcattcctcttgaatgtttaaatcctcatttcaccactcatagactggcacttcccacaatcttctccatctcagtaaatggcagaatcttttgcctggttgctcagaacaaaaatctttgagtcttctttgactcttctttattttatatctctcaaccagtccttcagcaaaccccactggttccttcttctgaatagattgagaagccaactatctctcacttccttactgctgttaccatggtccaggccacctttgtctcttgccaggactgtgggaatactgtctattagtttttagggatgccataataaaattaccacaaactgggtggctttaacaactgaaatggactgtctcatggttctggaggccagaagtccgtgatgagccccagaatcagggtcgattccttctgagagctgtgagggaaaatctgttctagcctcctctcttagctttggtgttcgcggacagtctttggcatgttgatgtgtagaagcatcactgtgatctccgccttcatcttcacatgtgtgcatgcatgtgtccaaatttctccttttgaaagaccttatctccaaataaagtcacattctgagctactgggggttagtagtccaacttattttttgttggggagacagaattcaatccataataccttacttccacgtaaggtcacattcgctagtataaggggttaaaacttaaatgtatcttttttggggacactgtttaacccataataataccctaattcactgtcttgcttctgcccttgctggaattcctaaagtctttccagcacagtggtcagattaatcctttgaaatctcaatcaggtcattccattattctgcccaaaatctttgaatggtttcttatcacattccgaggaaaagtccaagttctttgagtggctgacaagttcctatacatcctggtactctctgttacttctctctttttttttttttctgagacagagtctcactctgttgcccaggctggagtacagtgttgtgatctcagctcactgcaacctctgtctcccgggctcaagcgattcttgtgcctcagcttcctgaatagctgggatcacaggcacgtgctaccatgcccagctaaattttttggtagagacggggttttgccattttggccaggttgatctcgaactcctggcctcgggtgatctgcccaccttggcctcccaaagtgctgggattacaggtatgagccaccgtgtccagtctctctgttcttctcttacttcctcgcttggccacacttggacttcttgccagacttagagcatgctgggaatggccctgcctcagaacctttattctagctctttcttctgcttaagctgccagagtagtgcttttaaaacatgtcagatgattccgcttttctgctcaagaccccagtggtttccctgtcaccaagggtggaatacagaggtgtcctttccacaggacagccctactccctctcagcactcatttatgctcattcttttgctcactctgctgtagccatggtggccccctaactgttcctggaacctgccagtgtggccccacatttctacttctgtgttcttcacactcaatcctttgagttctcagttccgattgttagctcccccagggacctgctatgacttgtctgtcagcatttcttggtttcacttgtactgtttatcttgtattgttttccttcaaagtacttagcactccctgatatgttattgattggtgtatttaccagttccctgacacataataagtgctcagtaaaaatttttcttgggtgaatgacatttttgttagtttttcatcagagttcatacatgctaatggttcaaagagcaaatagaaagcagcaggctactgctccatccccagatgcacccacttttaatcatgtctgtatatctgtatgtacctaaatatttggaattttgttaattgtttttacaaaaatgggatatatattgtatattgttcagcacagatgtctttatttgtgagtagacacagagtttgcctccttggttttattggcttactattctgtggtagggctatgtgataatattcccaagtcaaggggtgtttggattgttttaaaatttcttgtacagtgagcggtgctgtagtaaatatttttgcacgtatagacttgtatacaaaggcatatttttgtatgctgctttgaaatggaattgttgtgtctaagagtatgcacatttaacatgttgatggatactatcaaattgctctccagaaaagactaccaattttcattttctccaaccgtatataaaaatacccttttattaacagtctcacccacatttttagatttttgctagttttataggtgaaaatagtatcatcttataggtttttgtatgacaaaatgctcatttgtatttcctcttctgtttcccttcctgattatgttgttgctccatttttctgttggattctttttctttttttttttgatagacatttaggtcttctttatatattatgtatttcggatgcacagtcttctcttaatattgcagatactttttctcatctgtcacttgtcttttgtggtagctcttagaagttttaaattttaatgtaatcgactttatcagatatttataattttatcttaacagtgtactcctttcaccaaatctgcaaacatttttttcctaatatttatatacttaaattttttagaaaacttttttgttaaggataacatggaaagataagcaactcctcaggataatgggtgagtgacttccaaaaagagggcctcccaatggccagtaaacatatgaaaagttgtcccacttcattagtaaacagggaaatgcaaattaaaagcacaatgtgatctcactgtgtacccaccggaatggtagggtgatactaagtgatggtaggacatggaatagtgagaacactgatttactgttggtgaaggtgtaaatggacacagccactggggaaactggcagtatctgttaaagcagaacatatgcattgcctatgccatagcagttccatgcctgtctctatctctttctgcctcttgctgtatataagaaatgtataaatattaactaaaagaaaggtataagaatgttcatatcaactctgtagtaaccaaaacctggaaacaacccaaatgttcatcatagtcgaatggatgagtaaatcatgatgtgttcagactgtggaatactatacagtacagaggaggaatgaactgctgctacacgccagcactgcaagggtgattttcacaaacaaggttgagtgaaagaaactgcatagcaaattaccacaaactcagaggcttaaaacaatatccattatctcctagctgtataggtcagaaatccagatgggcttggctgggtcctctgtgcagggtcccacaaagccagaattaaattgtcaacagggctgtattccttactagcatctctgggggagaattagatttcagccttattcacgttattggcaaaatccggttctctgtggttgaggtccctgtttccttgctgcctgtcgtccaggagtcagtctcagcttctagaggccacctgcaatccttggctcatggtcctttctgttttcaaagcagtgatatgactagtctttcttacactttagatctttcaaacttctcattctgctgccagccagaaaaagttctctgctcttaagggctcatataactagattaggcctacctaggcagtctgtatattaaggtcagctctgacaaatgatgtaaatatctcatcagagtcacagattccagagattagaatgagacagctgttatgggagccataattcttgcctactatagaagtcagtcacaaaagagcacatatactgtgtcattctgtttatgtaaagttgtaatacaggcaaaactatgctgtaagtcaggttaatggttacctttgcggtgggggtgctggtggtaactgaaaatgttcacaaggaagctttggggtgttggtgataacctgtccttgatctggatgctggttccatgagtgtgttaagtttgtgaaaatacatcaagctatatatttatgatatgaatacttttctatatgtatataatattaaatataaacaaaaaaatcagaaaactgcataaagcaaagtgtaagtgaacgaatctgttgtcagggttcaaccggagaaatagaaccagtaggatatagctaacctgcataaacttgtgtgcaaaggttcaggttaatatgtgtgtacctcatggtttcatactgttacctccaattcaaattcaggacaacagagttttcactttagttgttcctctgttttttttttttttttttttttttttttgagacagagtcttgttctgtcgcccgggctggagcgcagtgacgtgatcttgggtcactgcaacttccgcctcctgggttcaagtgattctcctccttcagcctcctgagtagctgggattacaggcacgtgccaccacgcccagctaatttttgtatttttagtagagacggggtttcgccatgttggctaggctggccttgaactcctgacctcaagtgatccactcatctcagcctgccaagtgctgggattacaggtgtgagccaccgcgcctggcccccctgtttcttctatatcaagaatcctggttttcagaaataccaagggtgatagaattaagctagacaacattactattcacacgcaaagcattcttagaataacaccacccaacactgttaccactgacatttttgcatatgttcttcctgtccttacacattctttataaggttgttcccacattgttggagcacagagccattatatactgtttgctctctctctttctctctctcatctttcatttatcctagttcttcgtgtaaatattgaatgcacatcatagtctttatgttgatgtccccccagtcatcatccagtcattttgattgtatgttactcattcgtctgataagtagattgccttaagatttatgggaatgatattccctgagttatctcatgttgctgacaacttgtctgtggcctttgtacttgaaattcagttttgctggatataatatcttaaactcacattttatttccttgagcatcttatacagtgccccattttcttttgttgtaaagcatcactgtcaaaaagtgtgagggcaaactgatttctttcttctatgagtgatgtgttctttttgcctggatgctcaaaggacttttgggtcagtttcccccaggtatacaaagtaccctttcatttcattttgcgtgtcatttcacccagtgtgtgtgtgtgtatgtgtgtgtgtgtgtgtgtgtgtgtgtgtagtatgtgcatgtgtcacatttcaggaacattttgttgaaatgaaggatttagaaatttttttggtcccctgctttggtttttttttctttgtggattcttgttatatttatgttcagtctttgcttatgttgaatatttttgtcctatctgaattttaatacagttttctaattatggattggattatttggtcaataagtatttatttggcatttactttgtgccaaatactttcatgttgtcttgtttaatccttacaacaatcctttgagtaattttaaaattgcatttgtgagatgaggaaagtggtttaggaaatgccagtggtaagtcaggtgatagggagagttcaaagctgtaaaaggtgtggcttcccaattccagggtacatgcatccctgaatgttggcagtaacactagatcttcagaatgacagacacattaccttgtcttaatccctaacatctgtcagaagtagtaggaagggacaggtaaaagctagctgtcttttttacctggtcaaatatagatgataataaatgtctttgaaaaattttaaattaatatcatatctcaagctcagaatttatttaaattgatacaaacaacactatttagtttcacgatggaggtagtagaaagataggattttgtatctaaacatactggtttcttatcctgattctcccatttacccactagctatgccagctaaggaaacctgagccttcatttctttaactgtgaagaagacaactttggcctcagcagggttgaggattaaatgatacaatgtatgtaaatatattctttaaccaaggggtcagcaaactttctgtaaaaggtcaaatggtaaatatttttggttttgtagatcacatggtctctgtctcaaccactcagttttgccattgtggtatgaaagcctgagtagagaatagctgggctccagtgaaacttaacttacaacaaaaggcagcaagctggatttgacctgagggctgtagtttgcccacactttactctaacctataaagctctgtgtaaatattgagtaattgtcatgactttctctcttcaggctaatgtaatgcttgaatatgatattgatgaagctcaggcattgttggaaaagaatttatcgactgccacaaagaatcttgattccctggaggaagaccttgactttcttcgagatcaatttactaccacagaagtcagtatcctttcttaaaacaaaaagcaagggaaaaaaggagaaagatttttttaaaaaaacattctttcatgggcagagggagagcattaggaaaaatagctgatgcatgctgggcttaatacctaggtgatgggttgataggtgcagcaaaccaccatggcacacgtttacctttgtaacaaacctgcacatcctgcacatgtaccctagaactaaaaaaaaattagaatacaaaaaacctcccacattctttcttacattgctttagtgggaagaatttccttattaggctaatataaaggttatagattttataagataataaataagatattcggaactagtacttaaataagtttgtagatagattagtgattttgaaatgtgatgtggaaacagcaaattcacataggtgagtaagtatttttcttccaaatattttcccaagacaactttataactggttaaatagtttaatttcacaagcatttaagggtctcctatgttcctgcaactgtgctaagacatatggggcatgaaaatcaattttagaaaagagtggcagtgcctttctctggtagaactgtacatgtaaaacagctgaatgataattcatagcaaactataagtaagttaacatatgcaacaccaaggcaatttaaactttgggaaagatagatgtaggctggacttagttcaaagaaggctttgttgagaagataaaagttaggctgcttttttaaaggcggcgtagggtttaaagatcagcagagagaagaggtgggagtggggtattctggtcaagggggaaggcaagctctttgcctttcttctctggcctgtcttttcctcctacttcctgtcacagtcactcaagacaaaatcacgggagtcacctttcacacttctctcttcctcactaccaataataaatcaatcgccagattcacatcaaatttccctcataaatctctctgcccattactgttctcgttctggggctccaaaacctgcactcagaacctttttaggttcctctcattccatctgtccttcccactatctctagtatgaatttactaggtcactcatttttattcctctggttacaatatttcaacggttccttgttacttacaagatatacatataggcactcttgtgaagtgcccccagcttgtctcacctcatgccactgacctcttcttgcctttccccagtgcattccaggttccagataaccccagtcagttattgtacacactccccaattgtgccacaccctttgcatttctacactttgttcctcctaactggaatgactttcccatatttacaggatgtgctctttttttacccttttaccctaaatatctcagtccaagcatcagagctttcctgaacattttctgatcctcagagtgtttcttgtgtgcttgcttaacacatactgcttagttttaccttgccaaaccgtgagctcttcagatgtaggagctgcactttctcttcttttccagtgtgcagcatgtggcagttgtttatggttggctgagggaaggcaggcctgttggggcctagtgcagtggtcatcatcatctgacgggtagtgtggaaacttcatccagctatgagatgacgagggcctaggacgggtggcttgtggaaaggaaaagatattaaacgtgtgagaaaaaaacaggatccagtgacttagatgggtacaggagccaaaagtgaggaaatcctctaagatgagtcctacaagcttagttaaatgccatttgttattgctagtactgcaaaaggtaggaaaggaaggtgtgcagacaagtgagggagctagggtggacagtctctgttacattgacattctactggagtctaagctccacgaggaaaagaacttcacctgtcttattcaggtcagggctttgtacagtgcctagtcaaaaatacagtagatgcttaataaacttgttaagccaaagggagggtaagagataaaattattgataattgtaataatataaatattacatggcaggatatgggttgagtgatctttcagatttcttggatgagggactgtctttaaaactatcgagagtgtctagtacatatttgttaaatatatcatagttgactagctgacagttgactaataccatagtaaacaatgggttaacaattaatttgagtccttagttttgatagagtttaattatagtattttcctaacaattgacattatagcaggatgtcttacaatactatttgttaccagtatttgtatatgtttcatttctgtgtctttgattcattgtgtgagtggagtgaatacttagtcattgcatgcattatctttagaattgcatttgcattttctttgacaattcttgcagatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaa

SEQ ID NO: 4107 - DNA, 60585 bp, human
ctcctctgggagcgggcagttggcgaccctgcactgacccgcgtccctccgtcccgagcccgcgcgccctcagagggtgcccggacaggtaaatggagtggggtgcgcctgcgggaggcggggagagaactgcggagggagggcggaggtgtcgatggaaaggtgctggggtggagcgaggaggcagtgcaggggtgacttgggcttctctggtgtcgacagttccagttgtcgggcaggaccagttttggcgaggtgcgtcttatgccactggaaaggcctcgagttaaagagtgtcagaatgcgtcacttaagctgtcattacaggagggaaaaaatgttaactttctctcagtttgtattctacaagacctttctgtagcatttaaatctcttgagatcgccagagtcttctaaaaactctctacgtccttgttcgatgacgtcactttctgcttcaccttctacttctggctgtttatgctccttcgtgggttcctagccccttattcgcccttcctccactgctcagtattgacagtccccttcttcctctgttcagggactgtatttctgcctagacccgtttcctcagcttcagacctgtttggtgtttttattaatggccaatgtttatcaaattctgactgcgtactttggtaaatgctttacatctccgtctcccataactctcacaaccaaccaactgtcttcatttggcctcattaattgctttcaactacctgtatctccattatccctcccttgatcccagaggatacagtcatgtttaggatattaattccctttgaatacctgtggctgagagcagatccattcatacatttaacaaatatttattgaacggctggtatatgcttgacactcttttaagtgcaggggatacagctgtaaacaagacttaggaggttgctactctcaggaacttacatgtttgtgtctagaggggaaaacaggaataatcaggattatgttatatattggttaatgcaaaataaaacaggtggttgacttgaaaggatgggatcctatcctaagaaagtcagaggtcagggcatcgtccagaaagaatagttgtaataccaacaggaataatcttgatctgtaacatgacttttcgtaaacacctcttcttttcccctgtctaagcagtgtttattcttcattcttctatctcctccaaggttattgcatcagaattcatggtttatctgtagttggtttattccttctaagacccagagagaagagtgggggattggattactattagctcaactgctttatcttacttagaaagatagtttggttgtgaaaatattattcttaccaggtccttctgaatataaagttatctaccatttatagtatattttaaaaccaaaatatgctcaatgttcactcatttattcaacagatatttgagggaatattagatggtaggcactgtgctgagcactgggaaaatagggtaaaatagacactttgacctctcttccaaggagaaataatcctaacagtatactgaggaaatttctaaggcataggctgacacctgcattcctgttcttcatccgaggtgagatcatcacaaaacattaagacatttcctgagcaattgcggacattcttagattattcacttattatactttattgcatttatttatatctgtcttccccattgttctatggctccctcaagtataggagtcccttcttccttaactttatacctctagtgtctactttgactgtcatatagtaacccaccagtatatacgtgttgaactgaaatagactccctatttgatcaaatttaaatgacatgatttatacaaggccttctttatgtaaggccatcagccgtattcctcaaccttctcattcaccaaaggtggaccattccatcttatcaggctagcttatgtaccttctttaccttgctctcagtgccttctcttcttccatccatccctcctaaaaggatctcccatctcttcccaagcaccttgtgtacctccctccattaatttggtgggccagttaatttaataatctgctcatgatacaggggtggaaaaaaattaatttcctttttatatttcctatgaaacattctgccaatgaactcttgcaagaattaatgtaatagatcctactgcaataatataatgatacagaatactttttaaagattttgcattgactatcaccatgtgctatgtaatgagttaattctactactttatttgaacagttgtataacctctgttcacacagcatgttttggtatcatttggtttctacttggtagaaacacatctttttttttttttttttttttgagacggagtctcactccgttgcctgggctggagtgcagcggcgcgatctcggctcactgcaacctccgcctcccaggttcaagcaattctcctgcctcagccccctgagtagctgggattacaggtgcacaccaccacgcctgactaatttttttttgtatttttagtagagacgggatttcaccatttttggtcaggctggtctcgaactcctgacctcaggtgatccacctcggcctcccaaagtgctgggattacaggcatgagccaccatgcccggccaagaaacacatctttgagtattactttctcagcctgaggtaatttaagtggtaatgttattctgccacattgtcattttcaggatgtcagataaaagcctcaagtattaaaattaaacttttttttttcttttgagacagagttttgctcttgttacccaggctggagtgcaatggcatgatcttggctcacctcagcctccacttcccgggttcaagcgattctcctgcctcagcctcccaagtagctggaattacaggcgtgcgccaccacgcctggctaattttgtatttttagtagaaacggggtttctccatgttggtcaggctggtctcgaactcctgaccttgggtgatccgcccgcctcagcctcccaaagtgctgggattacaggcatgaaccactgcgcccagccaaaattaaagtcttattccatgcaggtatctttcaattgtaaatcattactgcaaaagacaaattttgtctttataactgattaaaaacaacagcagtacaagagtgcttgagtcatgactgtcgtgaatttaggatgtgccaacctaagatcagccagatacttctaagatgtaaacattaagcattgttattttaggtgatttattgacacctatttctttatagacaggaatgcaagtgcagcactgaattgtgtgccattgctcgtttataagatacacatgtagatgatccagaatattcttatacatttttcagtgttatcaaaatacaaatgcagaattaaaagatttctcaaaacacatggacttggcctttccccttactcagttacctgaaactgtcttcagcctctacttgaagatgcttctgctgaggaggagcattttcatcattgctgttctatgttattaccaaattttttaatacaggcaatttcttacttacaaatggatatattctaaaagtactgttgtaagcttattgtttggaacgctggatgcatttccttctataaataatgctatccatgacatttacactgttatgccaaccagtatcattttattaacttttaatttagtggactcgaagaccttccccacaatttacaataattcctctattaaaaaactgcatttataattctcatttgaattcccttatagcatatctttttttagaaacccaacaactagaacaaaaatatcctttctttagtcccttaacatagtaaaaacaggcttttctaactccaaactgttgtgggtgacccttctagcccttagctctaaggacagtcctccaatatgagcaaggaaaacgaagggacagaggttttagagagggaggcaagttgggtgatatgagtatctggaaagggaagggtaggatttatttgggatgaacagtgagtttctaaaatggaagtttgcattgcttgtcagccttttggctaagatcaggtgtagtatcagtttaaaatgggggtttgttgtgggttgaattgtgtcctccagaaagctgtgttgaagtcctaacccgtggtacctgtgaatgggatcttatttagaaataggatctttgcagatgtaattaagatgtaattgaaaatggggtcatactggagtagagtgggccctttatccaatatgactggcatccatataaaagaagagagacagagagaatgcagtgtgaagacacagatacagagaacaccatgtgactacagaggtaaagattgaagtgctgcacctccaagccaaggaacaccaaggattgccaccaaactatcagaagctagaaagagataaggaaagattctcttctacaggtttcagagggagcataaccctgccaacatcttgattttggacttttaaccctcagaactggtaggcgatacatttctgttgttttaagcaaccaagtttttggtactttattactgcagctacaagaaactaatacaggattcttagcaggaataaagtagaattgggatggtggctgtgggaccaagtggggagtgaataggagaacaaagaggaacagtgttgatatggggctttcctttatgttgcattatctttttttcttcccttctctctctggcttatcttttcattctttttcttcttggatcttatctttatatagcactttatggtttattaggcatttacatactgctaataattagcagagccaggttttctaacttcaagtgcagtgttcattgtgccacaattgtttctgttatcccaatactcatcaagacgttatggattctattacaagacacttacaatgggggcaggtaagacttcataggtgggatttttagcagtatagcagagaggaaggaattcctattagtgacatctggaaggaaagtaaagtttctgttgctatgtacccactgtttaacagtcatttttaagttggggactgcttttattggaagaaacactacttgcgtataacttatattcattgttcctagttatattctgaataatgtgctccctgttccaggtgactgtactttatataaactcaaaaactattgtcatgttccctctaagtcctctctttctcatgttacatatctctagttcctccagccagtcttcagatgacacaatctccatgtctctcacccatattgtattgcctcccttttgtctagtcgttaaatattctacccagaattgaattcagtattttacatatgttctaaccagcacagagtgtaatgggactagtacttaaacaggtcaagacaccctatttcttaatgtactttgagattatgtaagcatttttaagcaatatcgcataccgttggttcataatgaacttacagtccactgaaacactagatctttttgtattaattgttgccaaggtcaagtttccttctgaacctgcacagggactgaggctgctgctactttttcatctctctgttccagggaccatatgatttcttatctctgtttctctttgtgtttttgttcctctctactgtgtctctttgaccctaagcaatgacctccttccttgttataaaatttcactgattgttttacagtcttcattctctttctttcctttcggcttctgggccaccacacttttggctttcccatttggtcctcctcagtctttgtgagtctctatttatctacctttccctcaactgttggttgtgctttgggttttatctttggcactattttttttttctgtatgcaatatatcttcagcaaataaatcatgtttaaaatggcagatctaactgagctcatctgggaataaaagggcacagaatcagtcccggaggaaagtcgacatttagaggtcaggtagaggaggaagagtcagcaagaagacaaaaagagcagccagagatgtaggagcatttcaagaaggagggtcggtcagcagtgttgactgtgcctaagaggtcaagtaaggtaagaatagagaagcaaccactgtattttgcaatatagaggctgttggtgaccttaggaagcatggttttctggagttttaagggcaaaagctggattatagtaagtagaagagttgaaaggaggcagaggagcagagataatgcgtaacgatgctttgaagaaacagaacagggccaggtacggtggctcatgcctgtaatcccagcactttgggaggccaaggcaggtggatcacttgagcccgggagttcaagaccagcctgggtgacatggtgaaaccctgtctgtacaaaaaaaaatacaaaaatagccggacatggtggcacacacctgtagtcccagatactccagaggctgaggtaggaggatcacttgagcctgataagtggaggctgtagtgagccaagattgtgccactgcactctagcctggagcttgggtgacagagcaagaccctgtctcaaaaaaaaaaaaaaaagaaaagaaacagaacagtaggatccacagttagggaggctttaggatcaagggagataaagtataagacagcaatttggaaactataacttactgcatatgtgtaaggagaattctagaaagaagatggttgagatcacaaccctggggaacaacttcagttagagagtaggaatgaaaaagagatccccaaaaggcattcagcccaagagacagatgagcaccttctgctctgtgtgctgtccttccatgctgggattgcaataaggaatctgcacattccttgatctcaaacagtttatagtttgctgttgtgtttcacaaagtatgtttgtgtgaatcacctgcatccagacagacttgtattaaatacagattccagggccctacctcaggcctacggaatcagaatttcaggaagtgatgccaagagtttgaatttttagcaaatgactcatactctgccacacaagatgattcgtattcccactacagtttgagaaccactggtatgttgggtactgagcatgttaacaaataagagtaggtttaacagttaatcgaagactagacaaggatttgttcatctctttttatgtttatgccattaaataagagaagctgggcttgttaggtgggaaataatagcacatattcataggcagacataaggaaaataatcttaaactcatgccatatggttttagtaatgttttgtttatgaagggtcttaccattcctttcttgtggaagctttgagttattttcactttgtttctgttatggataatgcctttatactggcagtgtacagtaaaaggctaagattatgagctctagaaccatactgcctaggtttaaattgcagctccacacttactagctctgtaatttgggggaaattatttaagtcatctgtgcttcagttttctcatctataatagaagtatcataatagtgtataatctcattgagttgtgaggattaaatggattaataattataaagtatttaaaatggtacctggcacatagtaaacaataaatataggctatttttattgttaatagttatctttgtgaatctagagtcttaacttctgttgaactatttctctaggataaattttcaggatggaatttctacattaaagaatgaagacatctttatgtccctttgctatctatagtcattgcttttcaaaagggtgatatctgtttgtgctataataatttgtaaatgcaagctatcaatggtgtgtgtgtgtgtgtatgtgttttgtatgtctctttatatgaatgcatacaagcatggcttaggttgtaagtttgtagaaaactttgaccttctttttaagcctgctcttaagtctgttgttaagtttcatgttatagtgcctcgttagatactatctccaggtagtatgttgataaatgatagtaagttacctttgaaagattatgtcaaagaaatattctaaatctgtgtctttttccttttgatagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaagtgagttctgttctgcatgtggtaagggatgaaagaagggaattctgttactctaatcagaacggtagaaaagtagaaaacaagcttctaggtacataatttgaataagctgacagaatagtaaccttcaccaacttagaaaatatatctggttttgttacttataaatttaacttgtaattattttattctattattgaagtgatattttattttgaagaaagatgaaatgttaaatgtaaaaatgactttgctctagagctgtgtgatatgtgaaaataattcagataagatagataatgttcctttgttcattctttcagtaaatatttactgagcacttaactattgccaggcactttgcttggtgctggggatataacaagatatgtggtatttgccctcataagggttatagtttaatgagggagaaagtcaaatccacgatgtcaagggttggggggatgggaagtagtagataggagaatggtattccaagtagaaggaacagcaggtagagaagtatggaggcatgagatcatagggcgggcatatttagggaactgcagactgttctctgtgactggtgcccaggatggtgaaaataaagctagagagatgggtagaagaaaagtcatgtagggccttgtaggccatattaagagcttggactttaccttgtgggcagtggaaaggcattgaaggttttcagccagggtgtgacagagtcaggtttgttttatttatttatttatttatttatttagaaacagagtctcactctgtcacccaggctggagtgcagtggtgcgatcttggctcactgcaacctccatctcccaggttcagatgattctcgtgccttagcctcctgagtagctgggattacaggcgtgcaccaccatgcccagctaatttttgtatttttagtagagttggggtttcaccatgttggccaggcttgtctcaagctcctgacctcaggtgattcgcctgccttggcctcccaaagcgttgggattacaggcgtgagccactgcccctggcccttcagtcagtttttgctttagaaagatcactctggtggcttattagagtggccatagttgggaaatcttagtaattagttttaaaaagtgcctcaaccttccccgttggcacttaaaaatcttttcttacttaacccagccttacttccttagttcttatctcagaatgaggtccttattactttctatggctaaccccttatacagtttaaggtgtactctaagctactatgagagagacccccaagatacagtattaattttaatgagatagtccagagatgagtggtttgggatgttggggtggctctgccatttccaattccctaattcccaaagcaattagtgctttccacttctggccaaggcagctcctttggtgcttgttatatcccagtgcttgcccagtaattttaaaggcagggcccagaagtggcctgatattgttgagaagcttccacttacatcttactgttcactacacagtcatgtagctagcatagctagaagggaggccaggaattgtcatctctggctatgtagtcgtaggctcaactaaaactctgttactctggaggaagttataggatatcaggggatgacttgcagtcttccagtctactctcctggccacccagatatttcagtgaacctttcttcccaaacatagaatacgcctcttctctgagagaggtagctccaaagacctatctagtcactgtgtttggctccaagtccagcatgtctaggtggtacacagtcctatccatcaggccctggtgtggctcctgtggtccactgaccataaagtaaaagataagtcatatgttttccctgctttcccagcctaacccagtagacaatggtgaaataagaaaaggatcatcacagtgagagttacaaactcccatttggaaaagggaagaatgagaaacatgtagaagtcattgctttccagtaatgatcaaataattgcctcacacaatttcaaagactccctattctgaccaggaagtggttagtggttctgctttcttggaggaactccctcaccctttttccctgactcctggctttgttctccaggaagtttttcctttctggccacatccaaaatggtagttagagagtatatcatctttgggaattgtacccattttgtagtcctcttgctgccagcgtaggtttgtgggcctagaggttaggggttaaataatcttagcttcttatgattttggctttatactttctctaaaaatgtattagacttacagtctttgtgtttctaggcagttcctgggaaaatgtccagggaaagcacatgtagtcgtccttttagaggcaagactgggaaatagggcatatatcttccactcatgtattatgagccagaatttagtcacagccatatgtagctttaagagagtatagaatatgtaatccaattaaaatgcagttatagtagaaggagatgttatctgtctgccatgcctctctgcctgtgtctctgatctagctgtgttatttcgagctttggtacctttttttcatgcttttgttatcttctaggaatgctgttctccccctaagcctccttgtaaacttttgctcactttacaggtcccaagcgaaatactttcttaatttgtactttaatgcttctaaaagggcagttctgatcatattccttccttcaacagatactgtctgccctcaaggtaaaattccttaacgggacttggaatattcttcaagatctgccactttttccttctgtgggctcatcttttactactttagtcctcagttttgctttccagccatacttcatacttagccatttacaattcaatgctaggttctttctctcttcctagcctttgcaatagctgttaccttttactggaatatatttatctacttaattttttaaaaatctcactttgtgtgcctgagcttagatgtttccttttccagaaacccctgaacattaacactgagtcaggcaccgcaatcagacactctttttatgtgtctacatagcatctagtttgttcatattgtaacacttttcacactgtattattattattattattattattattgagacgaagtttcgcttttgttgcccaggctggagtgcaatggcgcaatctcagctcaccgcaacctccacttcctgggttcaagtgattatcctgcctcagcctcccgagtaactgggatgacaggcgtgtgccaccacgcctggctaatttttgtatttttagtagagatggggtttcaccatgttggccaggcaggtctcgaactcctgacctcaggcaatccgcccgcctcggcctcccaaagtgctgggattacaggcatgagccaccgtgcctggcctcagactgtattataattgaaatgattgtttatttctgtaccctgactgtaggcttcttgatggcagggatcataccttgttaccttttgtggcctgtgcaccaagtgacttacaagtctggtttaggagaaacaaattttatggggaaagtgatgactttcattctgggcatgtcatgtttaagctgtctatggtatgtccagttggatatgtctagtagacagtagtgtaggtagtcctggagctcaggagataggtcagatggagatttgggaatcattggcataattgtggtagctgaaaacaaactacaacaaaacatgagagtgcatgctgccctccagggagtaagtaagtgtgaaaaaagcaggaggctaaggaagctagaaaacgttagtgtagagggaaagggactatgatataaaccaggtatattagcctgcttgggctgctataacaaaataccatagactgagtggcttgaacaacagatacttgtttctcacagttctggagactgcgtgaggtgcccgctaattcagttcttgatgagggccttcttcctggctggcagatggccaccttcttgctgtgttctcaggtggtggaaagagagtgatctttttcttcctcttttttaaagccactaatcccatcacgaggaccccaccctcatgacctcatctaatcttaagtgcctcccaaaggccttgtctccaaatatagtcacactgtaacatatgaattttgaaaggacacagttcagtctatagcaccaggcaagcctgatgtcaagaaatctagtgaagataaaacactttccaaaaggaagtggtcaacactatcatatgtttcagagagagccactggatatggcaatgtggaagtcattggtggaaatggtgcaaatagttttagagtattggaggaaaagattttgcctgagttcctgtatctccttgtaattcatgtcagtcctctgtgaacattaatataattcaacaggtacccctatctatccacttgcccaaggtacaaatgtgggaggcaaaatttagttaacctgtctcacgccagtcaccaagttctataaatgctgcctcctatctcttctctgtccctttttctttattacccattctactttagtttatttccctcctcatttcttacccggtatactgcagtagtctcctgtctggtcctcctttgagtcagttttccgcactctagccaatgtgtcctttgttttttttttttttttttttttaatgtgtcctttttaaagtgcaaatctgatcacaccctccctaggctaaaacttttggatgtttattcattattcttaggataatgcacagtgtggtttataaagtcttgtataacctggtttttgcttacttctccagtcttgtctgtccagataattcactttttcttcacattctgtactctagtcatgtgagccaattttactttcctaaatctattaggtgctgttttacctctaggcccttatgcttgctgcttcctctctggaaaaactctttgctcacttttttttgttgttgttgttttttgaaacaaggtctcactttgttacccaggctggagtgcagtggcgcaatctcagcttactacagcctcaacctcctgggttccagcgatcctcctgcctcagcctcccaagtagctgggactataggcgtgtgccaccacacctggctaatttttgtattttgtgtacagacggggttttgccatgttgcccaggctggtcttgaactcctgagctcaagcgatctgcccgcctcagcctcccaaagtgctaggattacaggcatgagccagccaccacgcctggcctttcgctcactctttaccttgccatctgttacttattcttcaggtcttaaatcagacatcacttgttctgggaagtctttctggttaccctttggcaaatctccatttcgtgcctcatctattaatgtgtccccagagcaccatgtactgcctttaactttcctgtcatcctgtttgccatgctgcactgtaattccttacactgtgatccctatgaagactgggacttggtggttttgcttttttgtatcctcagcatccagcacagtaactaactcaaagtggatactcaaatgttgagaatttggtagaaaagatgtttgctttaagaacttaggaaaaagcaaagaaaaccatatggcctattgggggttaatcttaattacatcctcctcctaagatgtcatctcttgttcatgctttaagagtccaattatgcttttgcagctatcgttctaatgggtaatacacatgctgttgtgctatgtagctagaatagagatctttttatttcttatgtacttctatcagtttgacttgaaagaaacaggtatattgggaaggggaagagggagaagagactgtatccgtaagtaatatggtgacattggcagtactgaacgtgcttatacatagatagaagatagaagtaaaagtgatgttgcttataaccacagtaagttttatatcttttattctacagttatttgtttcattacatctgccaagacaggattgtatatctttgtatcactgatgatgtaagtaacttgaagacatattgctatttaactatgtgtactgttaatacagccagttcttaattatctataccaggggtccccaacccccagggctgcagaccggtacaggtctgtggcttgttaggaaccaggccacatagcaggaggtgagtggcctatgagcattaccacctgagttctgcctcctgtcagatcagcagcagcattagattctcatatgagtgtgaaccctgttgtgaactctgcatccgagggatctaaattgcatgctccttaggagaatctaatgcctgatgatctgaggtggaacagtttaatcccgaaaccattcaccctcccccagtccttggaaaaattgtcttctacaaaaccggtccctggtgccaaaaaggttggggactgctgatctgtacctatagtgggcaaacgtgatgcgaactttacatagctggaattgttaatattttgcatttgtcatatagagcagcaaatgttaagaaaacttgatactggggtatgtgcaaatcaactcaattttggtagagttttagcttagcctcttgcaacttctatatttattctattttgtagtgagaattgatgttcataattataattctttgatatcaaaacctctcaaaaattgtttacgtggaatgttaaattagatagcatcatttcttctatcagtagttaatgaatcctttaatgtatgtgaactttggaaaaacaaaattacaatacattatgatcagctatataaacctgtagtttacattggttaggtatgactgtttgtcggctctcagcccaaaattctcagtaacttaatgatgtcattaaggtcctttctcttctctgcttatctccgtgtctccttcttcccagacaggttgccattatggtttcgtagagctacatacttatttattcatgtccggagtagagggactgtgtcttcttgagtgtcttattgtaggaatgaggaagcttttcccagctgcatgccctcccctccccctgctttcaaagtgaacttcctttcatgtcttattggctgcatgctcatttctaaactgcctactggcaaagagacttggaattggcatggttgccatagatcagggttcctaatctttattgtatcacagactcgtcacttgtgggacactcccagaatgtttttgttttctttttttaattttccttttccagaatgcttttaaatgtataaaacacacacaattctaacaaagccaattatattgaaatatatatatatatagtattcaaaatattttaaaaacttgatgtagtaatatatatgcttctttatgaactcattaacaagatctagtcataggtctaataactaatagtcttgatgtgatgggtgttgacagtattttgagatatctgtaactgtgatggtatacaaaaaaagatttctgttggtgacagttacaggtactgtttaatactaccccgattatgaatatacaacctatattcacaattgaaatataagttaacgattgataaaaataatgatgtgattttctttttttctatccaagttcaaaggccccttgaatttggaccattgaccccaatttaagaacccttggcttagactaagcatcttgggtgaaagggaaatgactgtcaaccatagtgatcatcacaatgatttttatctctggcttcacaatattttccaaaagtacgaaaaaatctagctatatgtgaaatgactgatgtgaaacagcttggaatagaaggaaaatactaatgaaatctgggatagttagagtcgagcctcatatttcttgagctataatttgatacacacatatacatgtatacataaacacacatacacacattcatttttttcctctaaggtattcttacagagaacacacatactttttggctggctgggattagacatgagtatgtcacttgatcttttcaaatataccaccactattgaaaaaattcgatttgaagttaatatcagtagtagtatctgtatgtgtgaaagactctatgattattatgggatttattaaacatattcttgtgctgggccttctaatagatcttatgaaatatatggaggaagtaaaattcaattcctgatgtcaagaagttgataacctaggtatcattatcttcagttgtcaatgaccagatatatctggattcattctcagctctttcatttactagttgttggacctttggacaagttagttactttttcagagccttcctttacttatctttaagataggatcaatgctagttcctcctcagataatcattgctcagtaaatgttagctgttttttattgttgttcttaatcactcacatcatctttgtttactttctaaatgtgagttctgtgttgatctcttttcaggattttgaacgttcccgagcctttaattttctgaatgagataaagaagaggttccagactacttacggttcaagagcacagacagcacttccatatgccatgaatagcgagttctcaagtgtcttagctgcacagctggtaagatctttctcaggataaggtattttgatttatatcttcttcattaccttcaaacactatgaatctagggggccctgacctgcaatatagttttctgattgtgttactgtaagccaacataataaaacttccctgattaaaaaaaaaatgtaaaggggccattttagggtagaaaacagtgatagtctttattatctctattaatagtggtcacagtgtctcatgattggaagagcattaaagatcatctagttgaactacccatctgatgcttaaatgtgttcagcatgccaaatgatcttttaaactatacgtaaaccttctacccttccatgagggaaatttaattttctaacaacccaaattaataatttgaaactctcctcatctgtatgaatccctaattgtcagcttagtgaggttttacatgtgaatatacctgtgaaataccactgtacttaagacagcattttaatcaccctaaaagttccctcatatcccttaccagttggtcccctcccctacactttgccccaggcaaccacggatctgttttctatcactataaattagttttgtctttcatagaactttctgtaaatagaatcatacagtatgtaaactttctgtaaatggaatcatacagtatgtacttttttgtgtcttgcttgtttcagtcagtgtaaggctcttgatattcttccatgttgtataaatcagtagtttgttcccctttttgctaagtagtagtatatgcatataccacaatttgtttatccatccacctgttgctggatatttgggttgcttccagttttcagctatcatgaataaagctgctgttaacctccatgtataagtctttgtgtggacatatgtttttatttctctctgataaatacctaggaatggaattgctgggtcatatggtaggtgatgtgtaattgaaaaaaaaaaatcaccacttttttttccaaagtggttgtaccattttatattctcaccagcagttccagtgtctctgcgtccttgccagtacttgatgtggtcttaagttttgccattccagttgatgtgtaatggtatctcattgtggttttaatttatgttttcatgatgtcagacacctttcgaaatgcttcccttttatccatgaaactatttgagtataaagacgtaagctctagctatgattttgttgtgagtttaaaaaaaagctgtattgtaatggaatactttcacttctcctgtggttttaatactctgagtattacatttctaaattttatgcacacacacacacacgcacacacatactcttctggcaataaagtccctttaaattggttacttataaacctttattattcaagcagttggtttgtttcatactccccactaggaaatgttcatctgtgtaaaactgtgtaaaacactacccacaacaaaaataccagtacttagtcaaaagtaaagggtcagctagaaacaaaactttcaaattaaccaatttgtcattagctctagatctgtgtgaccttctgaacaaaatctctacctgttcctttgtctgtaaatagagataatagcatcgtttcatagagttttggggtggattaaataatatcccgtttgaagcacttaacacaatgaaatgactggaacattgtgtattaagcaccccataattgctagctatggataaataatttcaaactatatattatcagtgtcttagattctagatcctgtgagaagccaataaaaatagtttatatgctgtgatcctggcagatacaagaacagattctgagaagctgggccagcccctacctcatcatactcaagaagtggggaacaattttgcagcattctttcccccactgccccaactacagtcttctttttctcctttcttccttgtctgagcacagattatatatcccccccaatctctgccccacaagtcacatgtatatttgatataatgtttatttttattttatttaaaataaggtaatttttagactacatacttatagtttgtatagaagcattttttatgctgcccatattttttcctgggtattgtaacatttttccagtgaagtgacatgtatcttttatatcaatagagacataattttatagcattcctcagtgtaaattgtcattccccttatttttgttttcctattgtaaataatgtctaggtaccataagttaaaacttattttcttatagaagcatcactctgagaataagggcctagacaaagtgatggagactcaagcccaagtggatgaactgaaaggaatcatggtcagaaacataggtatgtttcatggcatagtttcatgcatgtgggcaaaaatgataaagattacttgactggggtcaaattattctagagaagccaaaatagcacttccttattcttaccattggaagttaattgtcagctgagacaactgtgatactgtctgcttgtgcaaatggtttcttctttgtccttgcaactattcttcattctaaatttactagtttgcttaacaagactaatttctaagaaccttatgataattcagcagtttagaataatttggtcagtgtgattgtacagtatttcactgagttaatgtatcacgggttacctaaccttgcctgaattttggacgcataggttctttagcacagtgttagagtgctgttttgcaaccagataaggagcttgctgaagaatgtcaatcaatattgtgcttccttcactgaggccctcttgctatgaaaatgtcaattggactgaacagtatgcttagagacttagtcaaccagttgcaaatactcttaagtaggactgatttagaagtttatcctacagtagtaaccatactgttatatttttgtgcctattatgtttttcttattttcttgagattaattatcaggaatgggattaataatcaaaatgcgcaaacgttttcgtggttcttgatatgtacgtcttggctatttaaagtgatttcctttaattgattttagttttaattatatatctagatagagactagagaatctgttgagacaactactatttatttttattcttttttttgtcaccaaatgtatttattttgcccgaaagtggaggcagacaattgctacaatattatttattgcagatgcataaagtttccagaaaaatcaacgtttttaatcgactccttttaaatgacttatttatttttagagttatagaaacagcaaatttaatccatcttgaattaatttttgtataaggtataaggaagggatccagtttcagctttctacatatggctagccagttttcccagcaccatttattaaatagggaatcctttccccattgcttgtttttcttaggtttgtcaaagatcagatggttgtagatatgtggcgttatttctgagggctctgttctgttccattgatctatatctctgttttggtaccagtaccatgctgttttggttactatagccttgtagtatagtttgaagtcaggtagcatgatgcctccagctttgttcttttggcataggatggacttggtgatgcgggctcttttttggttccatatgaactttaaagtagtttcttccaattctgtgaagaaagtcattggtagcttgatggggatggcattgaatctataaattaccttgggcagtatggccattttcatgatattgattcttcctacccatgaacatggaatgttcttccatttctttgtatcctcttttatttcactgagcagtggtttgtagttctccttgaagtggtccttcacatcccttgtaagttggattcctaggtattttattctctttgaagcaactgtgaatgggagttcactcatgatttgactctctgtccgttattggtgtataagaatgcttgtgatttttgtacattgattttgtatcctgagactttgctgaagttgcttatcagcttaaggggattttgggctgagacaatggggttttctagatatacaatcatgtcatctgcaaatagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttccgtttatatgctggattacatttattgatttgcgtatactgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgattgtagtttgtatttctgtgggatcggtggtgatatcccctttatcatttagacctaaaaccataaaaaccgtagaagaaaacctaggcattaccattcaggacataggcatgggcaaggacttcatgtctaaaacaccaaaagcaatggcaacaaaagccaaaattgacaaatgcgatctaattaaactaaagagcttctgcacagcaaaagaaactactatcagagtgaacagacaacctacaaaataggagaaaattttcacaacctactcatctgacaaagagctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgtgataccatctcacaccagttagaatggcagtcattaaaaagtcaggaaacaacagttactggagaggatgtggagaaataggaacacttttacacagttggtcggactgtaaactagttcaacccttgtggaagtcagtgtggcgattcctcagggatctagaactagaaataccatttgacccagccatcccattactgggtatatacccaaggactataaatcatgccgctataaagacacatgcacacgtatgtttatagcggcagtattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcctcattctcagtaaactatcgcaagaacaaaaaaccaaacaccgcatgttctcactcataggtgagaattgaacaatgagaacacatggacacaggaaggggaacatcacactctggggactgttgtggggtggggggagggggaaggatagctttaggagatatacctaatgctaaatgacgagttaatgggtgcagcacaccagcatggcacatgtatacatatgtaacaaacctgcacattgtgcacatgtaccctaaaacttaaagtataataataataaaataaaataaaaaaagcaaatttaaaatgtgacaagaacattcctagttaattccctttcatttttttaacagcttaattgaaatataattcacatatcatataattcacccatttaaagtatacagtcagtggttactatattcacagaattgtacaaccattgctgcgatcaattttgtaacatttttatcatccctaaatgaagccctgtactcatttgcagttgctcctcaactctcagacctaagcaacaattaattcccttttcttcttcataaatttgcctattctggacatttcgtataaatggaatcttgtaatatgtggccttttgtgtcttcgttcacttagcgtaatgattgtgagattcattcatgtcgtagcataaatcaatacttaattcttttttatgactaataattccaatgcattaatgcattttatgtatctactcattagttcatggtctggttattataaataatgctgctatgaacatttgtgtacaagtttttgtgtgagcatatatatatattatatattatatatatatatatatgtttttggttctcttgcttacatacctaggaatagaattgctggatcacatggcaactttgtaacattttgaagaagggccaaactttcctaaagtgactgcacctttatacattcctaatagcaatgtatgaggattctgattcctccacatccttgccaaaacttatcttttttgattatacccagtctagtgaaatggtactttattgtgattttgatttgcatttccctgatgactaatgatgttgagcattttttcatgtgcttataggccattcgtatattttctttacctttggagaaatgtctatttaaaaatactttattgtttttaagtgggttatttgtctttttatggttgagctataacagtactttatatattctggatactagacccttatcagatacatgattttcaaatattttgctctattctgtgagttgtcttttcattttcttgatggtgttctttgaagcacaacagtttttatgaagtccaatttatttttttctttagtttgtgctttgaataacatatctaagaaactgtcgcctaagccaagatcatgaagatttactactttgttttcttctaagactagttttagctcttacatttctatctatgatctattttgagttaatgtttatgtatggaataaagaagagatccaacttaattctgttgaatatgtatatacagttgttccagaaccatttgctgaaaaggcttttctttccctgttgaatgatcttagcattcttatcaaaaattagttatcaatggatgtatagctttgtttctggaccttcagttctgttcagtttatctttatgccagtaccaggctgtcatgattattatagctttgtagtaggttttaaaatcaggaaatattcatcttccaactttattctttctcaaaattgctttgactattctgggtacctttcattttcatgaactttaggatgagcttgtcaatttcagatagcaaaaaaagctatctgggattttgatagggattgtgttgaatctgtagatcaattagggagccattttaacaatattaaacttctgatccatgaacatgggctttctttctattcatttaggtttctttaattttttccaacaatgttttgtagttttcagtgtgcaagtcttacatgacaaagactctgcttcaccaaattttagacaagctcctctgagcactctgttaaactaggtctcatcctcgggctctgtccttggcctgcctaaggaagtcttagcaaagaatcctgctaataccccacccttgatcaagttccttgtcccctatatttgttatataagtccggccagcttttagcaggaatcctgttaggccagtttagagagaatccccttgcccttgatgcctcctcttagtaattttccatcctctgaccccctcactctgttcattggccacaaatccccactggtcttggttgtgttaggagttgagctcaatctctcccctccattgtgatagccttgacccctattgcagtaatctcaaaatctgccttaccattttttaaccagtgtcagaataatttttctttaacaatatctcttctaacatccttcttgccttgttcctaagtatttttttatgctattgtaaatggaatttttctctttcattttcggattgttcagtactaatgtatagaaattttattgatttttataaattggtgttgtatcatacaaccttgttctcctttattagttctaatagctttttaatagtttccttaggattttctctatatagaatcatgctacttgcaaatagagatagttttaattcttccttttcagtctggatgcttttcatttctttttattgcttatttgccctagctagaacctccagtataatgttgaatagaagtggtaagagtggacatcattgtcttattcctgctcttagggagatcttgaagaatcttccacaattaagtatgaggttagctgtgggtttttcatagatgtcctttatcaggttgaggaagtttctttttcttatttgttgagtggttttatcattaaacagtgttggattttgtcaattttttttacatctattgaaatgatggtttttgttctttattaatatgatgtattataacaattgattttcagatattaaatcaaccttgtgtttctgaaatgaatcccactgcatcatggtgtatagtcctttttgcatattattggattcatcctgccagtagtctgttgaggatttgttaaatgtctgtatttttaagagttgttggtatatcattttcttttatttatttatttattttattatttttttttattgatcattcttgggtgtttctcacagacggggatttggcagggtcatgggacaatagtggagggaagatcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttcttcacagacacagcaaccatccgatttctcaatcttttccccacctttcccccttttctattccacaaaaccgccattgtcatcatggcccgttctcaatgagctattgggtacacctcccagacggggcggctgctgggcggaggggctcctcacttcgcagacggggcggctgccgggtggagggtctcctcacttctcagacagggcggccgggcagcgacgctcctcacctcccagaaggggcggcggggcagaggcgctccccacatctcagacgatgggcggccgggcagagacgctcctcacttcctagatgggatggcggctgggcagagacgctcctcacttcctagatgggatggcggccgggcagagacgctcctcactttccagactgggcagccaggcagaggggctcctcacatcccagacgatgggtgcccaggcagagacgctcctcacttcccagacggggtggcggctgggcagaggctgcaatctcggcactttgggaggccaaggcaggcggctgggaggtggaggttgcagcgagccgagatcgcgccactgcactccagcctgggcaccattgagcactgagtgaacgagactccgtctgcaatcccggcacctcgggaggccgaggctggcggatcactcgcggttagcagctggagaccagcccggccaacacagcgaaaccccgtctccaccaaaaaaatacgaaaaccagtcaggcgtggcagcactcggcaggctgaggcaggagaatcaggcagggaggttgcagtgagccgagatagcagtagtacagtccagcttcggctgggcatcagagggagaccgtggaaagagagggagagggagaccgtggggagagtgagagggggagggggagagggagagggagagccattttcttttcttgtgatgtctttggttttgataccagggtaatgctgggctcatagaatgagtcaagaagtgttccccttttcttctattttggaaagatttgtgaaagttttgtattaattcttgaaatgtttggtagaattcacctttgaagccacctgggcttgggcttttctttgtgtgaagcttttttgtttttgtttttgttttttgagatggggtctgtctgtcacccaggctggagtgcagtgacatgatcctctctaattcctctttcattcccttggtgggagggttacctgcagccttgacctcctgggctcaggtaatcttcccacctcagcctcccaagcagctgggactgcaggcatgtgccaccacacctggctaatttttgttttttggtttttttgtagagacaaggtcttgccatgttgcccaggctagtctcaaactcctgggctcaagcgatccacttgcctcagcctaccaaagtgctaggattacaggcatgagcctccatgcccggcctgaagttttaaaattactgatttagtctctatgcttgctgtagctattcagattttttatttcttcttgagtctgtttagcagtttgtatctttctaggaatttgtgcatttcatctaagttacctaatttatttacacactcctgtttatagaattcccctaagatcctcttcattttgtaagtttggtggtgatgtctcctctttcatttctgattttagtaatgtaagttttttctgttttacttggtcattctacgtaaaggtttgtcaattttattgatctttctaaagaaccaacttctggtttcatagattttttttctatagtttttctgttctctatttaatttgttcaccctaatatttatttccttcccactgctagctttagatttagtttacccttcttttctagatccataaggtagaaagttaagttgttaggttgttaatttgagatcatttgtcttagctcaggctgccataacaaaattccatagacgtagtgacttaaacaacagaaatttattttctcacatttctggaggctagaagtccaagatcacggtgccagtatggtcaggttctggtaagggctctcttcctggcttgcagacagcatcttctctctctgttctcccatcaggcaaggaaaagagagctagctgtctagtgtcttttatttaattgatacataatatttgtacacatttatggggtacgtgtgatattttgttacatgcaaagactgtgtaatgatcaagtcaggatatatggggtgtccatcagctcaagaatttatttctgtgtgatgggaacatttcaaattctctcttctagctattttgaaatatataatacactattgttaactttagtcaccctactctgctatcaaacattagaacttattccttctatccaactgtgtgtttgtacctattaaccatcctctcatattccctgctcggccccacatacccacacccttcctagcctctggtatctattgtgctattgtctacctccatgagatcaactgttttagttcccacatgtgagtaagaacatgtgatatttgtctttccatgcctgccttatatcacttaacataataacctccagttacatccatgttgctgtaaatggcatgacttcattctatttcatggtcaaatagtattccattgtgtttataaaccacattttctttatccattcatccattcatggacacttaggttgactccatatctttgctattgtgaatagggatgcaataaatatgcaagtgcagatatcccgtctatacactgatttcttttcctttgcataaatacccagtagtaggattgctggatcatatggtagtttaatttttagtttttggggaaatctccacactggtttccatagtagctgcactagtttactttcccaccaacagtgtgtaagtgttttttttttttttccttatactagccagcatctgttattttgtatctttttagtaaccattctaactggggtaacatgatatctcattttggcttttatttgcatttctatgatgttgagcattttttcatataccttttggccatttgtatgtcttcttttgagaaatggctattcatgtcctctgcccactttttaaggggattatttgtatatctcctgttgagttcattatatattctggatattattcccttatcaaatgaatagtttgcaactattttctcccattcaactggttgtctcttcactcttgattatttcctttgctgtgcaaaagcttttttgtttaatatagtcctatttgtctatttttcttttcgttacctgtccttttgaggtgttagccataaaatcttttcctagagcagtgttctgaagtgtttcccctatgttttcttctagtaggtttatagttctgggtctgaaatttaagtctttaatctatcttggttgatttttgtatgtgatgagagacagaggtccagtttaattcttccacatatggatatccagttttcccaataccatttattgaagaaagtgtcctttccccagtgtacgtccttggcacctttgttgaaaatcagttgcctatatatgtgtggctgtacatacgtggatcaatgtctggcttttctattctattccatcgaccttgtgtctgtttttataccaaaccatgctgttttggttactgtagccttgtaatatgttttgaagtcaggtagtgtgatgcctccagctttgttcattttgctcaggattgctttggctatttggactcttttttggttcctgaaatactaattttaggattgttttttctgtttctgtgaaaaatgacattggtacttcgatagagattgcattgaatctgtagattgctttgggcttatggtcattttaataatatacattcttatgatccatgaccataagatgtctttctgtatctttgtgtcatcttcagtttttttcatcagtgttttgtagttttacttgtaggagtctttcacctactcgttaaatttattcttcaatattttatatgttcataactattataaatgggattaccttcttgatttcataaagttttatttcaccaagttgattattgatgcatagaaacattacagatatttgtatgttgattctgtatcctgcaactttactgaatatatttatcagatctaggagttttttggtggagtctttgggtcttttagacataagatcatatcatctgcaaagagggataatttgacatcctctttttcaatttggatgccctttatttctttctcttgcctgattgctctggctaggacttccagtattgtgttgaataggagtagtgaaactgggcttccttccagtactatgttgaataggagtggtgagagttttccatttcttagaggaaaggcttttcgtttttcccattccgtatgatgttagctgtgggtttgtcataaatggcctttatcatgttgagggatattccttctatgcctagttttttgagagtttttatcatgaagagatgttgaattttttttgataccttgaactatatatttttatttgaatatataaaagtagaatatcctattttccttttgagctatgtcatcatactgctaaaattatggatgaaaatggaaatatttcaacctgacccattgcaatttctatgttacacatttgctctttttttattattatactttaaattctgggatacatgtgcagaatgtgcagctttgttacataggtatacacatgccatggtggtttgctgcacccattaacccatcatctacattaggtatttctcctaatgctatttctcccctagcccccctacccccaacaggccccagtgtgtgatgttcccctccctgtgtccatgtgttctcattgttcaactcccacttatgagtgagaacacgtggtgtttggttttctgttcctttcttaccttgctgagaatgatggtttccagcttcatccatgtccctgcaaaggacatgaactcctccttttttatggctgcatagtattccatcgtgtatatgtgccacattttctttatccagtctatcattgttgggcatttgggttggttccaagtctttgctattgtgaacagtgctgcaataaacatacgtgtgcatgtgtctttatagtaaaatgatttataatcctttgggtatatacccaataatgggattgctgggtcaaatggtatttctggttctagatccttgaggaatcgccacactgtctttgacaatggttgaactaatttacacttccaccaacagtgtaaaagcattcctattgctccacatcctctccagcatctgttctttcctgacttgttaatgattgccatttaatggtcgccattcttactggtgtgagaggatatctcattatggttttgatttgcatttctctaatgacccgtgatgatgagcttttttttcatatgtttattggccacataaatgtcttcttttgagaagtgtcttttcatatccttcacacactttttgatggggttgtttttttcttgtaaatttgtttaagttccttgtagattccggatattagccctttgtcagatggatagattgcaaaaattttttcccattctgtaggttgcctgttcactctgatgatagtttcttttgctgtgcagaagctctttgctttaattagatcccatttgtcaattttggcttttgttgccattgcttttggtgttttagtcatgaaatctttgcccatacctatgtcctgaatggtattgcccaggttttcttctagggattttatggttttaagtcttatgtttaagtctttaatccatcttgagttaatttttgtataaggtgtaaggaagggggccagtttcagttttctgaatatggctagccagttttcccaacaccatttattaaatagggaatcctttccccattgcttgtttttgtcaggtttgtcaaagatcagatggttgtagatgtgtagcgttatttctgaggcctctgttctgttccattggtctatgtatctgttttggtaccaataccatgctgttttggttactgtagccttgtagtataatttgaagtcaggtagcgtgatgtctccagctttgttcttcttgcttaggattgtcttggctatgtgggctcttttttggttccaaatgaaatttaaagtagtgtttttctaattctgtgaagaaagtcaatggtagctggatggggatagcattgaatctataaattactttgggcagtttggccatattcttcctatccatgagcatggaatgtttttccattcatttgtgtcctctcttatttccttgagcagtggtttgtcattctccttgaagaggtccttcacatcccctgtaagttgtatttctaggtattttattctctttgtagcaattgtgaatgggagttcactcatgatttggctctctgtttgtcttttattggtgtataggaatgcttgtgatttttgcacattgattttgcattctgatactttgctgaagttgcttatcagcttaaggagattttgggctgagacaatggggttttctaaatatacaatcatgtcatctgcaaagagagacaatttgacttcctctcttcctatttgaataccctttatttctttctcttgcctgattgccctggacagaacttccaatactatgttgaataggagtggtgagggagggcatccttgtcttgtgctggttttcaaagggaatacttccagcttttgcccattcagtatgatattggatgtgggtttgtcataaatagttcttattattttgagatgcattccatcaatacctagtttattgagagtttttagcataaagcggtgttgaattttatcgaaggccttttctgcatctattgagataatcatgtggtttttgtcattggttctttttctgtgatggattacgtttattgatttgcgtatgttgaaccagtcttgcatcccagtgatgaagctgacctgatcgtggtggataagctttttgatgtgctgatgggttcgatttgccagtattttattgaggattttcgcatcagtgttcatcagggatattggcctgaaattttcctttttggttgtgtctctgccaggctttggtatcaggatgatgctggcctcataaaatgagttagggaggagtccctcttcttctgttgtttggaatagtttcagaaggaatggtaccagctcctctttatacctctggtggaattcagctgtgaatccttctggtcctggaccttttttgtttggtaggctattaattactgcctcaagttcagaacttgttattgttgtattcagggatttgacttcttcctggttcagtcttgggagggtgtatgtgtccaggaatttatccatttcttccagattttctagtttacttgcatagaggtgtttatagtattctctgatggtagtttgtatttctgtgggatcagtggtgataccccctttatcattttttattgtttctatttgattcttctctcttttctcctttattagtctcgctagcagtctatcaattttgttaatcttttcaaaaaaccagctcctggattcattgattctttttgaagggtttttcatgtctctttctccttcagttctgctctgatcttagttatttcttgtcttctgctacctttgaatttgtttgctcttgcttctctagttcttttaattgtgatgttagggtgttgactttaaatctttcccactttttgctgtgggcatttagtgctataaatttccctctaaatactgctttagctgtgtcccagagattctggtacgttgtgtctttattctcattggtttcaaaaaacttatttatttctgccttaattttgttatttacccagtagtcattcaggaacaggttgttcattttccatgtagttgtgcagttttgagtgagtttcttaatcctgagttctaatttgatggcactgtggtctgagagactgttggttacgatttccattttttgcatttgctgaggagtgttttacttccaattatgtgatcaactttagaataagtgcaatgtggtgctgagaagaatgtatattctgttgatttggcttggagagtactgtagatgtctattaggtcctcttggtccagagctgagttcaagtcctgaatatccttgttaatattctgtctcaatctaatattgacagtgggtgttaaagtctcctactattattgtgtgggagtctgagtctctttgtaggtctgtaagaacttgctttatgaatctgggtgctcctgtattgggtgcatatatatttaggatagttagctcttcttgttgcattgatccctttaccattatgtaatgcccttttttgtcttttttgatctttgttggtttaaagtctgttttatcagagactaggattgcagccactgcttttttttgctttccatttgcttagtaaataatcctctatccctttattttgagcctgtgtgtgtctttgcacatgagatgggtctcctgaatgcagcacatgggtgggtcttgattctttattcaatttgccagtctgtgtcttttatttggggcatttaccccatttacatttaaggttaatattgttatgtgtgaatttgatcctgtgattataatgctagttggttattttgcttgttagtcgatatagtttcttcatagtgttgatggtctttacagtttgatatgtttttgcagtggctggtactggtttttcctttccatatttagtgcttccttcaggacctcttgtaaggcaggcctggtggtgacaaaatctctcagcatttgcatgtctgtaaaggattttatttctccttcacttataaagcttagtttggttggatatgaaattctgggttgaaaattcttttctttaagaatgttgaatattcgcccccagtctcttctggcttgtagggtttctgtcgagagatctgctgttagtctgatgggcttccctttgtgggtagcctgacctttctctctggctgcccttaacattttttcctgcatttcatccttggtgaatctgacgattatgtgtcttggagttgctcttctcgaggagtatctttgtggtgttctctgtatttcccaaatttgaatgttgacctatcttgctaggttggggaagttctcctggttaatatcctaaagaatgttttccaacttggttctgttctccctgtcactttcaagcacaccaatcaaacataggtttggtcttttcatatagtcccatatgtcttggagcctttgttcattccttttcattattttttctctaatcttgtcttcacactttatttcattaagttgatctacaatctctgatatcctttcttccacctgatcagttcggctattgatacttttgtatgcttcacaaagttctcgtgccgtgtttttcagtcccatcaggtcatttatgttcttctctaaactggctattctagttagcaattcctctaaccttttttcaaggtccttagtttccttgcatggggttagaacattctcctttagcttggaggagtttgttattatccaccttctgaagcctgcttctgtcaatttgtcaaactcattctccgtccagtttgttctcttggaattttcagcctttttgcactggtttttcctcatcttcatggatttatctacctttggtctttgatgttggtgacctttggatggggtttctatgtggacatcctttttgttgatgttgatgctattcctttctgtttgttagttttccttctaacaggcctctctgctgcaggtctgctggagtttgttggaggtccactccagacccagtttgcctgggtatcaccagcggaggctgcagaacagcaaagattgctgcctgttccttcctctggaagcttcgtcccagaggggcacctgccagatgccagccagagctctcctgtatgagatgtctgtcgactcctgctgggaggtatcttccagtcaggaggcatggagctcagggacccacttgaggaggcagtctatactttagcagagcttgagcactgtgctgggattgccgctgctctcttccgaactggcaggcaggaacgtttaagtctgctgaaactgagtccacagccaccccttcccccaggtgctcggtcccaaggagatgggagttttatctataagcctctggctggggctgctgcctttctttcagagatgcgctgcccagagaggaggaatctagagaggcagtctggctacagggactttgcggagctgcggtgggctctccccggttcaaacttcctggccactctgtttacacagtgaggggaaaactgcctactcaagcctcagtaatggcagacgcccctccctccaccaagctcgagtgtcccaggtcgacttcagactgttgtgctggcaatgagaatttcaagccagtggatcttagcctgctgggctccgtgggggtggaatatactgagctagaccacttgcctccctggcttcagcccctttccaggcgagtgaacagttatgtctcactggcattccaggcgccactggggtatgaaaaaaaaactcctgcagctagctcggtgtctgcccaaatggccgcccagttttgtgcttgaaacccaggtccctggtggcataggcacccaagggaatctcctggtctgcagattgcgaagactgtgggaaaagcatagtatctgggccagagtgcaccattcctcacggcacggtccctcaaggcttcccttggttaggggagggagttccccgaccccttgtgcttcctggatgaggcaacgccccaccctgcttcggctcaccctccgtgggctgcacccactgtctaaccagtcccaatgagatgagccgggtacctcagttggaaatgcagaaattacccaccttctgcattgatttcactgggagctgcagaccagagctgttcctattcggtcatcttgccaaccaccctgagatgttgaattttatcaaatgctttttttatcagatgctttctctgcatctattaaggtgatcatgtggcttttattctctattctattgatggaatgtttcatgtttattgatttgcatgcattgaatcatcattgcatccctgggataaatcccacttgatcatggtgtattatctttttgatgtgatgtttgatttggtttgctagtatttcgttgaggatttttgcatctgtgatcatcagggttgttggcctgcagttttgtttttttgttgagtccttatcaggttttggtatcagggtaatgctggccttatagaatgagtagggagaattccctcctcttgaattttttggcatagtttgagaagtgatattagttcttctctgtaagtttcatggagttctccagtgaagccagctgattctgggcattgttttggttttgttgggagactttattactgattatactttattactgattcaatcccattactcattactggcttgttcaggttttctatttctttctgattcagtcttggtaggttgcatgtgtcctgggatttatccatttcttctgggttttcaagtttattagcatatagttgttaatagtatttctatggtcacttcttccaatttttagatttgctttaatatgcaaggactttttcttgaggatatatctatggtgttggttgggcagggcacttagactttgattatgggtacattcagtagtgtagtctgtataatttcttcagctataaacagcatcatcaaccatgtctgtatttttcttagtggcttagggtgtagttgttatggaggctgtggtgaagttttgatgggcatggggatttcaggtgggctagtccttgttttcgagtggtgtcaccagtgggtgaagcatgcctgtcctttggccccaggacagtgtattcattaagttatattacttttttaaaaaaagtttattttattctacaatggaaaacttgaccttttctacttttccaatattttcagatctggtagctcagcgaggagaaagattggaattattgattgacaaaacagaaaatcttgtggattctgtaagtatggaatctgataatatggagtctgatgtaaagtggagaaactatggatgatggctaacataattgggaaataccttaaattcaaatatttggtggtttttttttctttctcatttccattatgtgattactttgtaataatgaggataacaatgaggcatagaaaagaaacatcatcccctaatagccattaaggtagctttggtttggaaaacatactcagtatacagaaacaattttctaaagctttggattgaggcctatataatttagcacctcaactgcatgtaacagtctgttccctttacaaatttgtaaaacatgaaacaaatgtgcaagccgtttgtgacccagtatgaatcttgaaaactggacaattcacttttttgcttacactgatagtttcatcttgccttgtatcaatcaagagacatcgattggaaagcgccaataagccttaaaggagacaatgtgtccttgtgagctgcttatactatggttccgtatgtcctcacattttcaatgcagttactgtggatgaaagttttaaggaaagatgacagatatatggtgaacagaaggagggcagagatcagctacaatttgggtctacacaattataaatgtaaatgtacagtgcaggtttacaccttgaaagaaaacagtgattgattatgttcgttgtgactgacagctggattgtagtggttaagaacacaggctctagtatcaggttgcctggatttgaatcccacctctgctacttactagttgtgtgaccttaggcaaatgacttaacctctttgtgcctcagtcatcatcttctgtaaaatgaagatgtacccacttcagagcattttaaggattaaatcagataatgcatgtaaagtgcctaacacagtatttgatacatagtaagagctatttaaatgttcatcattattgttaattttacagggacatctattagcagcaggttttagtatatacagtctactatcaggttttctaggagtttataaacagttttttcatcaaagcatgtggtaggtggaggaaggatgctaccatacaggaagtcaaaacacctgggttctagatctcactttgtgacccattgctggggagcaaagaaaacagagaagtatctgattccagatctgcagaccaatttctttgatacttccaggctgtctcttagttattcttaattcttgaggattaccctgcttagggggaatggtctgtctttgaccaatagtagtatgatctgtactttacaaataaaagtcttaattttgttgacttcatgactgaaaacagaaggtactaatgaactaacaggtatctctctttatggtagaataacatacgtgcagcaaattgtatcaagtgtacaacttttaagtgtatagctcaattattttttatatatatctatacccatgtaaccaccacccagatctagatagaaaacattaccaacaccccagaaggctgcctcataccccttccagttaataatccccaatagacgtaattatgtttctgacttatatcaccacagatagtgttttgcctgttcttaaaatttatttgtgtctggcctctttcactcactgttatgcctgtgaaattcatccacgttttttattatagtaatcacttattcttttttattgttttatattattccattatacaaatctaccacaatttgtttatccgttcttctctgtggggctttatttctggattctctattttgttccattggtcagtttgtctacctttatgccagtaccacactgtgttgattagtataacttaatagaattcttgaaattaagtagtgtaagtcttccaactatattcttgttgtccaatattgtcttcactcttttaggtgctttgcatttccatatatgttttagaataagcttgttttccatctcttgaccccacaacaatgtgtatctttgtgactgcatttaatatataggtcactttaggggacattggtatcttgacagtatagagtttttcggtccatgaacgtgacatatctctgcttttgcttaggatttaaaaatttttctcagcagtattttttagtttttggtgtacaggtcttgcacatatttgttaaatttacccttgagaatatcatgcttttgtattgtgtaacaaatttttaaattttgtttctaattctttattgctagtatatggaaataaagttggttattgtatattgaccttgtttgtattctgcaaccttagaaaaattcatttaccagttctggttactgttttgtacattcctgccttttattttccttcccttattctggctagaaccttctacacaatactgaatacaagtgataacagtgaacatccttgcctattgaccatcttgtggggaaaaattcaatactttttgaaaaaaataaattcagtgttaagtttgtggttaactgtagattttttgtaggtaccctttaataggtggaagaattccctttaattcctcatttgagagttgtattcatgattttatcaaatgctttttctccatttattgagatctttggtttttctcctttattcagttagtatggcaaattacattgatttttcagtgttaaaccaactttgcattcctgcaaggtcatgacttactacccttcttatataacactttattggatttgctattgttttgttcaggaatttggcatctatgtttataagagatagtggtctgtaatttatttttctctttaggttttggtatcaggaatatgctggcctcattaaacaagttgggaaatcttacctctctatcttctgagtttgggtactattggtattatctgtcttagatgtttggaagaatttactagtaaagcagattgggcctcgagttttcttcgttggaaaatttaaaatctgccatcttgctgtttgtttcctatttataccatctagtctttgttccctttttgttctgccttccattggatttagtacatttgttattccattatgtctcctttgtcagtttattagctatagctccattctgtcattttctgattgctttagggtttacagtatgtctttgatttataatctcccttaaagtggcatttttccacttcatgaatagataagaaccttataatagtatacttctagctgtttcttcttggcctttatgctattgttgacatatttttatttacacatgtattaaaaacttcataatacattgttgttgtttttgtttaaagagttgattatcttttaaagagatttaaataataagggaagtcttttctgtttacccatgcagctaccatttcagtgctcttaattcttttgtgtaggccgagtttctatctgatgttattttctttctgcctgtatgctttaatttaacatataatcttccattgtagttcaagtgtgtaggtctactggaaatgaattctttcaggtttggtatgtctgagaagtttttatttcacttcctttttttttttgaaagacattttcactgagtatagaattctaggtcagtgatttttctttcttttaatacttgatgaacggtggttcatcactgtcttttacattgtttctgacaagaattctgctgtcattcttacatacataaagtgtatttttttttcttctggatgctttaaagattttctctttatcattggttttaagaaatttgattataatatatatgccttggtatatatttctttatgtttctttggctttgagtttgttgtagttttcatcaaattatgaaaatgtttagctctttctaggcttccagtgacatctgtattaagccacttgaagctgtcccacaactcactgatgctttgttcatttttaagtcttttttccactatgtttcatttagaatagtttctattgctatgtcttcaagtttacttaccttttcttctgcagttcgcaatctgctgtttctgtcctgtgtatgtttcatctttacaggtttgttttggatcttttttatatcttccatgtgtctccttaacatgtgcatactttcctctaccttgagtatatgaagtatatttataattgaagtgcttattccacttacatgtaatgcaaattttgatagagttaggtgtaggtatcttgctctttgttttttatttgccgcatccctgtcctcttcttttttattttgattactcaagtactttttaaattgttttttaaccatctctatttgttttttaacacttctattgagagataactcacagaccatacaaattgcccatttaaagggtacacttcagtggaatttagtatattacattattaaaattgtggtaaaatatgtatagcataaaattttgccattttaacctttttaaagtgcacaattcagtgatgttaattacatccacaatgttgtgcatccatcactactagctatttccaaaacttttttatcaccccttaacaaaaactctgtaaccattaagtaataataactccccattccccttactctcagcccctggtaactctaatctactttctgtctctgaatttgcctgttctagatatgtcatataagtgggatcatacaaaatttgcccttttgtgtctggcttatttcactaagcataatagtttattgcttaaaaaaaaatgctaacaatcacctgagccttcagtgagccttaatctttttgctggtggagggtctcaccttgatgttgatggctactgactgatcgatcaggctggtggttgctgaaggttgtggtggctgtggcaatttcttaaaataagacaacagtgaagtttaccacattgattgactctttcacaaaagatttctctgtagcatgtgttgctatttgatagcaatttactggcaatagaacttctttcaaaattggagtcaatcctctcaaaccctgctactgctttatcagctgagttgatgtaattttctaaatcttttgttgtcatttcaacagtgttcacagcatcttcaccaggaatagttgccatctcaagaaaccactttccttgcccatgcataagaaacaactcctcattcattaaagttttatcaagaaactgcagcagttcagtcatgtcttcaggctccagttctaattctagttctcttctatttctaccacatctgcagttactcactccactgaagtcttgaacccctcaaagtaatttgtgagggttgtaatcagtttcttccaaacacctgttaatgtttatattttgacttcctcccacgaatcatgaatgttcttaatggcatctagaatggtgaatcctttctagaaggtcttcagtttactttgcccagatccatcagaggaatcattatctatggcagctatactaaatgtttttcttaaataataagacttgaaagttgaaatcactccttgattcatgggcagcagaatggatgttgtattagcaggtgtgaaccccaaaagtctgagacaggtctcagttgatttagaaagtttattttgccaaagttgagagcgcacacccgtgacacagcctcaggaggtcctgacaacatgtgcccaaggtggtcaaagcccagtttggttttatacattctagggagacgtgagacatcagtcaacatatgcaagatgaacattggtttggcctggaaaggcggaacaactcgaagcaaaggcgggaaggctcgaagtggggagggggcctccaggtcttagatagataagagacaaatggttctattcttttgagtttctgatgagcctctccaaaggaggcaatcagatacgcatttatctcagtgagcagaggggtgactttgaatagaatgggaggcaggttggccataagcagttcccagcttgacttttccctttagcttagtgatttggaggccccaagatttattttcctttcacacaggcatgaaaacgacatttatctcctcgtaagtctccatcagagctcttgagtgactaggttcattgtcaatgagcagtaatactttgaaaggaatcttttctttttgagcagcagatctccacagatcttctgtacaccatcctgtaaacagatgtgctatcttccaggtttgttgttccatttcaagagcacaggcagagtatatttagcataattcttacgggccctagattttcagaatggtaaattaccattggcttcagcttaaagtcatcagctgcattggtccctaataaaagtcagcttatcctttgaagctttgaagccagtcattggcttctctctatgaaagtcctagatggcatcttcttccaaaagaagggtgttttgtttacattgaaaaatctgttgtttagtatagccacctttatcaatgatcttagctaggtctcctggataacttactgtggcttctctctcagcacttgctgcttcaccttgtacttttatgttatagagatggcttctttccttaaacctcatgaaccaacttctgctagctttaaacttttcttctgcaccttcctcgcctctctcagccttcatagagttgaagagttagggccttgctctgtattaggctttggcctaaggaaatgttatagctggtttaatcttctatccagacccctaaaacattctccatatcagcagtaagtctgttttgctttcttatatgtgtgttcactggagtagcactcctgatttccttcaagaactgttctttgcattcacaatttggttaactgtttgtcacaggacacctagctttaggcccatctcagctttcgacatgccttactcactaagcttaattatttttatcttttgatttaaagcaagggatgtgtgacttttcctttcacttgaatacatagatgccattgtaaggttattaattggccaaatttcaatattgtgtctcggcaaatagggaggcctgagagggagagagataagagaatagctggtcagtgaacagttagaacacacaacatttatccgttagctccgtcaccttatataggcacagtttatggcacccgaaaacaatcacaatagtaacatcagaggtcacagatcgtcataacagatagaatgaaaataatgaaaagtttgaaatgttataagaattaccaaaacacagacatgaggcgaccacatgctgttagaaaaatggtgctgccgcatgttctcactcctaagtgggagttgaacaatgagaacacatggacacagtgaggggaacatcacacactggggcctgtcggggagtgggggctaggggagggatagcattaggagaaatacctaatgtagataacgggttgatgggtacagcaaaccaccatgtcacgtgtatacctgtgtaagaaacctgcacgttctgcacatgtatcctagaacttaaagtataataataataataaaaagaaacaaaaagtgcaggccaagcaggaaaaaaaaaaaacaaaccagaaaaatggtgctgatagtctcatcatggggtttccacagaccttcgatttgccaaaaaaaaaaaaaaaaaaaaaaaaaaatccatgaagtgcgataatgtgaagtacaataaaaggggatatgcctgtaattctttctgtgtcctttattgttttcctgcagttctgtttcagtgtacgattttgtttgcttcaaactgaagaagttcttttattgtttcttataatgttgatctactgatgagagattctctaagcttttgtctgaaaatctgtttcatcatttttttaaagaatactttctttgcatagagttttttagtttttcacaatggcagtttttttttttttttaaagtgagtgctttaaaaatgccattccatttttctttggctttcatatgttctcaaagagattgtcatttctcttagtcttacttgaaaaataatgattcttaccccacctttggcttttgttgttgttgttgttgttgtttgttttgtttttttaagacagagtctctctctctcacccaggctggagtgcagtggcacgatcacagcttactgttgcctccacctcccaggctcaagtgatcctcctgccttgcctcagcctcccaagtaggaggaccacaggcatgcgccatcacacttagctaattttttaaatttttcttagagacgggtctccctatgttgctctggctggtctcaaatgcccaggctcaagtgatcctcccaccttggcttcccaaagtgctggaaatacaggcatgagccaccacacctggccccctttggctggttttaagagtgtctttttatatttggttttcaactttttatatatggttattagctttctgtggctgctatcacaaattatcacaaacttggtggcttaaaacaacaaaaatttattttctcccactactggatttcagaagttcaaaatcagtttaactgggctgaaattaaggtgttagcaaggctacactccttccagaggctctaggagaggatctgttccatgcctcttccagcttcaggtggctgccagtatttcttggcttgtggctatatcattgtagtctctgcctccatgttcacattaccttctcctttgcatgtgtgtcaagcctccatctactttcctcctatagagacatttgtgatgtcatttagggctcacatggataatccaggatactctcttcatctcaagattcttgacataatcacatctgtaaagaccccttttccagataatatcacatatgtcacattcatagggattaggacacaggcatgtcttagggcaacatttaacaattgttctttataggtgaacttgttttaaacagatggtttgtcagtgttcagatgttgacctgagagtggtggaggaatctccattacaacctgttgaatcacacagctatgttcggatttattagtttcattcctcactgctttttctcatctacatcatctttctctttcttgaattatttattgtgaattagtctttgtttgtagtatatcctcacacattttcttcatatgagtttgtggatgataatcccttcaagaataaaagtgttattttggtctcatatttgaacaattttttgactggtgtagaattctagggttaagatcattttctctcaaaattctctgaatattgctgcatttcagtgcatgaagaatttaggcatctgagaagttcaacaactatacagtttacacgttttttatttgggccaagtttgaggactgcaacccaggagcatagattcaagttgctctgaatatatgttctaattagcagcagttacaagtaggtttttaaaggaaaaaaggagaggcagtatctaatttgtttaccaagaatttacattaaaatagcataagctattgattgctatacattgtcctttgtatcacaaattccaggaacatgaagataatggttgaggcagctagtcagcaacaaattgcctttaaacagttgccccccctgggcattgtgtggggggtgtgactgaagtccccatactcatgtcttctgggcctgataaattttatatacctcacatagctcaggctgctctgagctgtttttcttttctcatttcccccttttgatcaaaatttttctcttctgaaagcattgatgatcagcattttagatataagtttatcccatgtcactggggaggcttattcccagatattcttgtcccgtgttggatggaaagacgtaaaaaaggtaccatggcttaaagaacttagtgaggtctcaaggccaaattgattggcaacacagaggagcagagcaacaggatctcagtcaagccatccactcacgctggagccatggcatgaacaactatacagtttactcaagtccaccctcacttaatggcaccaactgcaagtttggggattccccaaaccaccctcagatttgatagttcattagaaggatttataatactctgtgagcactattatactcacagttatggtttattacaggcaaattatacatagtaagaccagccaagggaaaaagtacatagggtggagtttgggaagataccaaatgtagagcttttgttgtcctcttcccatggagtcaggacacgttgctctcttggcatcagtgtgtgacaaaatgtgcagagcattgcctaacaggaaagcttacccaagccttagtgttcagagtttttattggggtttcattatgtaggcattattgactgactgccctctggcttgatctcagtctccagctccacttggtgtgatccaaagcctcctaaatcacatagtcattttttctggagtgtcttttccccaccctaaatcacattgttactatctagattacagtctattagaaaaataaatcaaggctgtgcatggtagctcatacctataatcctaatacttatactttgggaggccaaagctgaaagatctctaaaatccagaagttcaagaccagcctaggcaacaaagtgagaccttatctctacaaaaccaaacaaaaaaaaaaaaaaaataggtgtgattgggtgcacctgtagtcctagctacttggggggctgaagatggagaattgcttgaacccaggaattcagagctgcagagagctatgatcacaccactgcattccaggctgggttacagaggggtgacctccatctcaaaaaaaaaaaaattttttttcttttaattcttttttattttttattttttttataaatatatatattttttattatactttaagttctagggtacatgtgcacaacgtgcaggtttgttacatatgtaaacatgtgccgtgttggtgtgctgcacccattaactcatcatttacattaggtatatctccaaatgctatcccttccccctcccaccaccccacaacaggccccggtgtgtgatgttccccttcctgtgtccaggtgttctcattgttcagttcccacctatgagtgagaacatgtggtgtttggttttttgtccttgcagtagtttgctgagaatgatggtttccagcttcatccatgtccctgcaaaggacatgaactcatccttttttacggctgcgtagtatttcatagtgtatacgtgccacattttctgaatccagtctatcattgttggacatttgggttggttccaggtctttgctattgtgaatagtgccacgataaacatacgtgtgcatgtgtcttgatagcagcatgatttataatcctttgggtatatacccagtaatgggatggctgggtcaaatggtatttctacttctagatccctgaggaatcgccacactgtctttcacagtggttgaactagtttacagtcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgccatcttttgagaagtgtctgttcatatccttcacccacttgttgatggggttgtttgtttcttttcttataaatttgtttgagttctttgtagaatctggatattagccctttgtcagatgagtagattgcaaaacttttctcccactctgtaggttgcctgttcactctgatggtagtttcttttgctgtgcagaagctccttaattagatcccatttgtcaattttggcttttgtttccattgtttttggtgttttagatatgaagtccatgcccatgcctatgtcctcaatggtattacctaggttttcttctagggtttttatggttttaggtctaacatttaagtctttaatccatcttgaattaattttagtataaggtgtaaggaagggatccagtttcagctttctccatatggctagccagttttcccagcaccatttgttaaatagggaatcctttccccatttcttctttttgtcaggtttgtcaaagatgacatggttgtagatgtgtggtattacttctgagggctctgttctgttccattggtctatatctctgttttggtaccagtaccatgctgttttggttactgtagccttgcagtatagtttgaagtcaggtagcatgatgcctacagttttgttcttttggcttaggattgacttggcaatgcaggctcttttttggctccacatgaactttaaagtagttttttccaattcagtgaagaaagtcattggtagcttgatagggatggcattgaatctataaattaccttgggcagtatggccattttcatgatattgattcttcctatccatgagcatggaatgttcttccatttgtttgtgtcctcttttatttcgctgaacagtagtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacgttgatttcgtatcaagactttgctggagttgcttatcagcttaaggagattttgggctgagataatggggttttctagatatacaatcatgtcatctgcaaacagggacaatttgatttcctcttttcataattgaataccctttatgtctttctcttgcctgattgccctggccagaacttccaacactatgttgaataggagtggtgagagagggcatccctatcttgtgccagttttcaaagggaatgcttccggtttttgcccattcagtatgatattggctgtgggtttgtcatagctcttattattttgaaatacgtcccatcaatacctaatttattgagagtttttagcatgaagggctgttgaattttgtcaaaggccttttctgcatctattgagatgatcgtgtgttttttgtctttggttctgtttatatgctggattacatttattgatttgtatatgttgaaccagccttgcatcccagggatgaagcccacttgatcatggtagataagctttttgatgtgctgctggattcgatttgccagtattttattgaagatttttgcgtcggtgttcattagggatattggtctaaaattctctttttgtgttgtgtctctgccaggcttaggtatcaggatgatgctggcctcataaaatgagttagggaggattccctcattttctattgataggaatagtttcagaaggaatggtgtcagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtcaaggaatttatccatttcttctagattttctagtttatttgtgtagaggtgtttgtagtattctctgatggtagtttgtatttctgtgggatcggtggtgatatccccttttatcattttttattgcgtctatttgattcttctctcttttcttctttattagtcttgctagcagtctatcaattttgttgatcttttcaaaaaaccagctcctggattcattgatttcttgaagggttttttgtgtctctatctcgttcagttctgctctgagttatttcttgccttctgctagcttttgaatgtgtttgctcttgttcctctagttcttttaattgtgatgttagggtgtcaattttatatctttcctgcttccttttgtgggcatttagtgctataaatttccctctacacactgctttaaatgtgtcccagagattctggtatgttgtgtctttgttctcattggtttcaaagaacatgtttatttctgcattcatttcgttatgtacccagtagtcattcaggagcaggttgttcagtctccatgtagctgagcagttttgagtgagtttcttaatcttgagttctaatttgatttcactgtggtctgagagacagtttgttataatttctgttcttttacatttgctgaggagtgctttacttccaactatgtggtcaattttggaataagtgcgatgtggtgctgagaagaatgtatattctgttgatttggggtggagagttctgtagatgtctgttaggtccgcttggtgcagagctgagttcaattcctggatatccttgttaactttctgtctcattgatctgtctaatgttgacagtggggtgttaaagtctccctttattattgtatgggagtctaagtctctttgtaggtctctaaggacttgctttatgaatctgggtcctcctgtattgggtgcataaatatttaggatagttagctcttcttgttgaattgatccctttaccattatgtaatggccttctttgtctcttttgatccttgctagtttaaagtctgttttatcagagactaggattgcaacccctgcctttttttgttttccatttgcttggtagatcttcctgcatccctttattttgagcctatgtgtgtctctgcacatgagatggatttcctgaatacagcacactgatgggtctttactctttatctaatttgccagtctgtgtcttttaattggagcatttagcccatttacatttaaggttgatactgttatgtgtgaatttgatcctgtcattatgatgctagctggttattttgctcgttagttgatgcagtttcttcctagccttgatggtctttacaatttggcatgtttttccagtggctggtatgtgttgttcctttccatgtttagtgcttccttcaggagctcttgtaaggcaggcctggtggtgacaaaatctctcagcatttgcttgtctgtaaaggattttatttttccttcacctatgaagcttagtttggctggatatgaaattctgggttgaaaattcttttctttaagaattttggatattggcccccactctcttctggcttgtagagtttctgccgagagatcagctgttagtctgatgggcttccctttgtgggtaacccgacctttctctctggctgcccttaacattttttccttcatttcaactttggtgatctgacaattatgtgtctcggagttgctcttctcgaggagtatctttgtggcgttctctgtatttcctgaatttgaatgttggcctgccttgctaggttggggaagttctcctggctaatatcctgcagagtgttttccaacttggttccattctccccatcactttcaggtacaccaatcagacgtagatttggtcttttcacatagtcccatatttcttggaggcttttttcgtttctttttattcttttttctctaaacttctcttctcgcttcatttcattcatttggtcttcaatcacggataccctttcttccagttgttcgaatcggctactgaagtttgtgcattcgtcacttagttctcgtgccatggttttcagctccatcaggtcatttaaggacttgtctacattggttattctagttagccattcatctaatctttttttcaaggtttttagcttctttgtgctgggttcaaacttcctcctttagctcagagaagtttgatcatctgaagccttcttttctcaactcgtcaaagtcattctctgtctacctttgttctgttgctggtgaggagctgcgttcctttggaggaggagaggcgctctgatttttagaattttcagtttttctgctgtttttttccctatctttgtggttttatctacctttggtctttgatgatggtgacatacagatggggtttttgtgtggatgtcctttctgtttgttagttttccttctaacagtcaggaccctcagctgcaggtctgttggagtttgtcggagggccactccagaccctgtttgcctgggtatcagcagcggaggctgcagaacagtgaatattgctgaacaccaaatgttgctctctgatcgttcctctggaggttttgtctcagaggggtacccgccgtgtgaggtgtcagtctgcctctactggggggtacctcccagttaggctgcttgggggtcagggacccacttgaggaggcagtctgtctgttctcagatctcaaactctgtcctgggagaaccactactctcttcaaagctgtcagacagggacatttaagtttgcagaggtttctgctgccttttgttcagctatgccctgcccccagaggtggagtctacagaggcaggcaggcctccttgagctgtggtgggctccacccagttcgagcttcccggcagctttgtttacctactcaagcctcagcaatggcgggcgcctctcctccagcctcgctgccaccttgcagttcaatctcagactgctgtgctagcaatgagtgaggctccgtgggtgtgggaccctctgagccaggcgcgggatataatctcctggtgtgctgtttgctaagaccgttggaaaagcgcagtattagggtgggagtgatccgattttccaggtgccatctgtcacagcttcccttggctaggaaagggaattccctgaccccttgtgcttcccgggtgaggcgatgtctcgccctgcttcggctcacgctcggtgggctgcacccactgtccaacaagccccagtgagatgaagccggtatctcagttggaaatgcagaaatcatccgtcttgtgcgttgctcacgctgggggctgtagactggagctgttcctatttggccatcttggaacaggaatcaaaggaaattttttaaaaatcccatttatgatagcatcaaaaagagtacaatagttaggaataaatttaaccaaggatgtaataatgtgcacactgaaaattataaaacattgatgaaagaaattcaagaagacacaaatcaatggaaagataccttatgtttatggattggaagaatcaatattattaaaatgttcatactgcctgaagcaatacacagattcaacacaatccctattgaaattccaatggcatttttcacagaatagaaaaaaaaattctaaaatgtggatgaaactagaagacattatattaagtgaaatatactagacacagatagataaatactgtatgatttcacttatatatggaatctaaaaaaaatgttcagttcataaaagcagagagtaaaacagtggttgacagtgggtgggagacctggagagatgttggtcaaagtgtatgaacttacagttgtaagatgaataagttctggataccggacatacagcatggcaactatagttaataataatgtattgaatatttgaaatatgctataagaatagatcttaagcattctcaccacatacccaaaaaagtaactatgtgaggtgatggatattttacttagcttgattgtggtaataatttcacaatgtgtacatttatcagaatatcacattgtataccttgaatatataccatttttatttgccaattatacttcaaggcagaaaaaaataaaattagagtagaaacaaaagcttggaggtctgaaatgttactaaaagtgtaacattttccttttttcaatattcttgccacatggtgggtaggtccttttagtctgaagattcaagtctgtcttatttgggggatattttcttcaattagtcccttgattattgatccttctcttttggctgtattctctcctgtgactgctaataggtgtgtaaatcagtaccaggcacataataagcacatgttaaatatctgttgatcgtataaattgatcctggatttgcttgatcagttttccgtgtatcttacatcttctttcatgatttacaacctagacattttgctgttttcagaacaaattttttgaattgttactgcagaagctgcttttgctcatttatgttctgcttttaaaaaattatgccattttattaaaatatagtttttggaatgttgtcatgttatctaattttttatgtcctctgatgactttgtttaaaattagttcaattatgtcttgtatctgaggatacttattagaaatttttttattactgttattctatcttgtttcccatattaactttgttccattaaggactgtttgtccccattgctttttttgtctcctcactttaactgctgtttcttctcaaaagttctagtcaatgcatatattctattcaacatatatatttagctctagatgtaatcagttttggtatgtgcctccaggtggcatcctgtgcagtcttcatgaagtgaaacccaaagactggtgcccctgtcagttgttctactgcagagactttgtggagtatgtggttggagatgaatctatggttaagggagtggattttttaaaaccaatatgtgaagtataatatacataaagtgcatcaactgtaagcatacaacttgttgtgttttcacaaagtaaacataccatgtagaaccaacacccagattaagaactagagcacgaacagtaccccagaagctcccttctcccttcttttagtcactactcttctccaaaggtggccactgtcctgatttctccacatagattaataaaacatagcaggggccgagagtggtggcacacacctatagtcccagctactcaggaggctgaggtgggaggatcgtttgagcccaggaggtcaaagctgcagtgagtcgtaattgtgccactgcactccagcttgggcgacagagcaagaccctgtctcaagataaataataaaatatagcaggtattctgtttatgtcaagtttctattgctcaaaatgatgtttgtgagattcatctgtggtaaattgtataaatgtagtagtagattgtgaattgtcattactgtattgtattccatgttatgactctcctgtaatttatgcattgcacagttgatgggcatttgggtggtttccagtttaaggtatgaaaagtagtgctgtccaaaacatttttttatatgtcttttggtgaatttgcatacatctgtgggaccataccagagtggattgctggattattagggagttttgttggttggttgtttgccattttgttttaaactccttgtgtcctggtgggaattgttcagtagatactgagaaattgatgatgcaaaagaaaatggatagcagaaggaatgaagttctatgggttttggccctcacaaaagtaaatacatatcttcctacagaaatcaaacaggtttttatggctcaaagccccggaattatacggggcagaataggcgaatgtgcttgcagtcagctggctttaaaagagcctttcttattggaagtatagagaggaaaattcttttccactagcgggaagaaccacttctggtgctcaacatcatgtgcattgctgcagtggagaagaaaaaagagggaagcgttttcattgggctcatactgcttatgataggcctggcagagtcttgcttttggcaactattgagtatgaatggccagtctctacttgtaaagagaggtcattggacttaaatggaattaatggaagtaaaatgttctcaggttgttactgcaaatcattcatgtagtcagtgccaggggttaaacaattctcgcctcttttctagtctgtcaccttcaaaactaccagcagaaatcttgctcgagccatgtgtatgaagaacctcaagctcactattatcatcatcatcgtatcaattgtaagtttttgtccttttagtgtatggctttatttttcaatctctaagaaattaggtactagaattatttctcaatgattaacactctgaaatgagctacatatgtcttttaatagtgaaacacatgaccaggcagtggctttcctatgaagtcactatgaaatatctctacttaaacccctccttcctattgagaattattatatattctcaataggaagagatctataaaactgacctcacagaaatgtagttattttaaataaagacatttctggtttatatgtaatgggtttattgtttttatttttaaattaattatgtatttttaaagttttaatttctaatatggcaaatgctgataattataatcccccttaaacaagaactctttggagtcctcagtaatttttgagtgtgtaaagaggtcctaaaccacaactttaaaaactattgctaacaggtggggggtgctttaccctgttcatggtcagataaagttgcctttcctccccatcctccagtcatgtccagaagcccaaagttacctccaagcagataactctgaccctgcttctcctctaccacagcttgagggtcctctgccttagacagctggatttatctaaaagagaagagcagtcatagatctgtagattttatactggaagtaattgtcatggccttgaatggttccttgctcaggtttctctttctaatatcacattttaggctcctgagcttagcttcttacttattatttggtctgggagtttaggttgatttgtgcagctgaattgttaaattcagaatatatttactgattacttattacatgcagagcacagctctaaatgcaatatcaatctttgcgaaaaggtgttgtcacctaacgagatgtacttcagcttgaaaaatccttatattacagctgtgacaaatagtcaactttacatcaagttggtaaactttacatttgtggcatgtgtatgtgtgagtatgtgtgtgtatgtgtgaatatgatgtcagaagttcaacctattcattaataaacagaatttgctgtaatctgccccccaaccctggcaatatttatagttccctacaaggcaaaatgctttgctcacttttggagcaaagggcatgcaattcatcaatgcatccttttccaagcttgcaaataatgaaatcagtcacttaaagatctcaaaaagttgtaatttaaagcaaaataaagccaggcataggggcttatgcctgtaatcccagcactttgggaagctgaggcaggaggattgcttgaggccaagagtttgaagccagcctggtcaacatagtgacaccctatctctacaaaaataaaaaataaaaaataaataaaataaagtgactaatgcagtgaacctaatgtttaaaatctattttttgtgatataataatgtgaacaagtagtgacttttataatataatttaaaattataatctagaattaaaaagcaaacacatctgtaatagcaccagtatttttgcagtgttacttacatcatctgcttttcattgttttggtcatcgtaattattgtgtcattatccactgaacagttcgtagcagtgttcttgctcataagtgatatagatgaaagccttctactcaggcttttaaaatatattcttatattaatcaaaaataaaattcatgtgcaaaacctaaaaatataattaatgaaaccatacttcaggagaattatggttatttgtgatttttttatgacttgttaatgacacatcagtatgagttgctcatttagccttgattctgccgagttaccagtgaagagcaacaaccccactgctttctctcccactgaaggaaacgctagagttcaagtgggtgtgagttataccaaaaacgacaatgttaactacacttctgtcttggaaaatacttgtttagtgtgttccattactacataactgctactctaatggaatcagaagtatttcttaataaggctctactttcctatatatattatttagaataatatgattgattcaagaaaataaaattgctctcctcgtccctccaggtgttcatctatatcattgtttcacctctctgtggtggatttacatggccaagctgtgtgaa

SEQ ID NO: 4108 - DNA, 62477 bp, human
cccactcccaagaggccacgcgtagacggggcgcttcatgcggaagtcagcggcgtccggtcccagcctcctctgggagcgggcagttggcgaccctgcactgacccgcgtccctccgtcccgagcccgcgcgccctcagagggtgcccggacaggtaaatggagtggggtgcgcctgcgggaggcggggagagaactgcggagggagggcggaggtgtcgatggaaaggtgctggggtggagcgaggaggcagtgcaggggtgacttgggcttctctggtgtcgacagttccagttgtcgggcaggaccagttttggcgaggtgcgtcttatgccactggaaaggcctcgagttaaagagtgtcagaatgcgtcacttaagctgtcattacaggagggaaaaaatgttaactttctctcagtttgtattctacaagacctttctgtagcatttaaatctcttgagatcgccagagtcttctaaaaactctctacgtccttgttcgatgacgtcactttctgcttcaccttctacttctggctgtttatgctccttcgtgggttcctagccccttattcgcccttcctccactgctcagtattgacagtccccttcttcctctgttcagggactgtatttctgcctagacccgtttcctcagcttcagacctgtttggtgtttttattaatggccaatgtttatcaaattctgactgcgtactttggtaaatgctttacatctccgtctcccataactctcacaaccaaccaactgtcttcatttggcctcattaattgctttcaactacctgtatctccattatccctcccttgatcccagaggatacagtcatgtttaggatattaattccctttgaatacctgtggctgagagcagatccattcatacatttaacaaatatttattgaacggctggtatatgcttgacactcttttaagtgcaggggatacagctgtaaacaagacttaggaggttgctactctcaggaacttacatgtttgtgtctagaggggaaaacaggaataatcaggattatgttatatattggttaatgcaaaataaaacaggtggttgacttgaaaggatgggatcctatcctaagaaagtcagaggtcagggcatcgtccagaaagaatagttgtaataccaacaggaataatcttgatctgtaacatgacttttcgtaaacacctcttcttttcccctgtctaagcagtgtttattcttcattcttctatctcctccaaggttattgcatcagaattcatggtttatctgtagttggtttattccttctaagacccagagagaagagtgggggattggattactattagctcaactgctttatcttacttagaaagatagtttggttgtgaaaatattattcttaccaggtccttctgaatataaagttatctaccatttatagtatattttaaaaccaaaatatgctcaatgttcactcatttattcaacagatatttgagggaatattagatggtaggcactgtgctgagcactgggaaaatagggtaaaatagacactttgacctctcttccaaggagaaataatcctaacagtatactgaggaaatttctaaggcataggctgacacctgcattcctgttcttcatccgaggtgagatcatcacaaaacattaagacatttcctgagcaattgcggacattcttagattattcacttattatactttattgcatttatttatatctgtcttccccattgttctatggctccctcaagtataggagtcccttcttccttaactttatacctctagtgtctactttgactgtcatatagtaacccaccagtatatacgtgttgaactgaaatagactccctatttgatcaaatttaaatgacatgatttatacaaggccttctttatgtaaggccatcagccgtattcctcaaccttctcattcaccaaaggtggaccattccatcttatcaggctagcttatgtaccttctttaccttgctctcagtgccttctcttcttccatccatccctcctaaaaggatctcccatctcttcccaagcaccttgtgtacctccctccattaatttggtgggccagttaatttaataatctgctcatgatacaggggtggaaaaaaattaatttcctttttatatttcctatgaaacattctgccaatgaactcttgcaagaattaatgtaatagatcctactgcaataatataatgatacagaatactttttaaagattttgcattgactatcaccatgtgctatgtaatgagttaattctactactttatttgaacagttgtataacctctgttcacacagcatgttttggtatcatttggtttctacttggtagaaacacatctttttttttttttttttttttgagacggagtctcactccgttgcctgggctggagtgcagcggcgcgatctcggctcactgcaacctccgcctcccaggttcaagcaattctcctgcctcagccccctgagtagctgggattacaggtgcacaccaccacgcctgactaatttttttttgtatttttagtagagacgggatttcaccatttttggtcaggctggtctcgaactcctgacctcaggtgatccacctcggcctcccaaagtgctgggattacaggcatgagccaccatgcccggccaagaaacacatctttgagtattactttctcagcctgaggtaatttaagtggtaatgttattctgccacattgtcattttcaggatgtcagataaaagcctcaagtattaaaattaaacttttttttttcttttgagacagagttttgctcttgttacccaggctggagtgcaatggcatgatcttggctcacctcagcctccacttcccgggttcaagcgattctcctgcctcagcctcccaagtagctggaattacaggcgtgcgccaccacgcctggctaattttgtatttttagtagaaacggggtttctccatgttggtcaggctggtctcgaactcctgaccttgggtgatccgcccgcctcagcctcccaaagtgctgggattacaggcatgaaccactgcgcccagccaaaattaaagtcttattccatgcaggtatctttcaattgtaaatcattactgcaaaagacaaattttgtctttataactgattaaaaacaacagcagtacaagagtgcttgagtcatgactgtcgtgaatttaggatgtgccaacctaagatcagccagatacttctaagatgtaaacattaagcattgttattttaggtgatttattgacacctatttctttatagacaggaatgcaagtgcagcactgaattgtgtgccattgctcgtttataagatacacatgtagatgatccagaatattcttatacatttttcagtgttatcaaaatacaaatgcagaattaaaagatttctcaaaacacatggacttggcctttccccttactcagttacctgaaactgtcttcagcctctacttgaagatgcttctgctgaggaggagcattttcatcattgctgttctatgttattaccaaattttttaatacaggcaatttcttacttacaaatggatatattctaaaagtactgttgtaagcttattgtttggaacgctggatgcatttccttctataaataatgctatccatgacatttacactgttatgccaaccagtatcattttattaacttttaatttagtggactcgaagaccttccccacaatttacaataattcctctattaaaaaactgcatttataattctcatttgaattcccttatagcatatctttttttagaaacccaacaactagaacaaaaatatcctttctttagtcccttaacatagtaaaaacaggcttttctaactccaaactgttgtgggtgacccttctagcccttagctctaaggacagtcctccaatatgagcaaggaaaacgaagggacagaggttttagagagggaggcaagttgggtgatatgagtatctggaaagggaagggtaggatttatttgggatgaacagtgagtttctaaaatggaagtttgcattgcttgtcagccttttggctaagatcaggtgtagtatcagtttaaaatgggggtttgttgtgggttgaattgtgtcctccagaaagctgtgttgaagtcctaacccgtggtacctgtgaatgggatcttatttagaaataggatctttgcagatgtaattaagatgtaattgaaaatggggtcatactggagtagagtgggccctttatccaatatgactggcatccatataaaagaagagagacagagagaatgcagtgtgaagacacagatacagagaacaccatgtgactacagaggtaaagattgaagtgctgcacctccaagccaaggaacaccaaggattgccaccaaactatcagaagctagaaagagataaggaaagattctcttctacaggtttcagagggagcataaccctgccaacatcttgattttggacttttaaccctcagaactggtaggcgatacatttctgttgttttaagcaaccaagtttttggtactttattactgcagctacaagaaactaatacaggattcttagcaggaataaagtagaattgggatggtggctgtgggaccaagtggggagtgaataggagaacaaagaggaacagtgttgatatggggctttcctttatgttgcattatctttttttcttcccttctctctctggcttatcttttcattctttttcttcttggatcttatctttatatagcactttatggtttattaggcatttacatactgctaataattagcagagccaggttttctaacttcaagtgcagtgttcattgtgccacaattgtttctgttatcccaatactcatcaagacgttatggattctattacaagacacttacaatgggggcaggtaagacttcataggtgggatttttagcagtatagcagagaggaaggaattcctattagtgacatctggaaggaaagtaaagtttctgttgctatgtacccactgtttaacagtcatttttaagttggggactgcttttattggaagaaacactacttgcgtataacttatattcattgttcctagttatattctgaataatgtgctccctgttccaggtgactgtactttatataaactcaaaaactattgtcatgttccctctaagtcctctctttctcatgttacatatctctagttcctccagccagtcttcagatgacacaatctccatgtctctcacccatattgtattgcctcccttttgtctagtcgttaaatattctacccagaattgaattcagtattttacatatgttctaaccagcacagagtgtaatgggactagtacttaaacaggtcaagacaccctatttcttaatgtactttgagattatgtaagcatttttaagcaatatcgcataccgttggttcataatgaacttacagtccactgaaacactagatctttttgtattaattgttgccaaggtcaagtttccttctgaacctgcacagggactgaggctgctgctactttttcatctctctgttccagggaccatatgatttcttatctctgtttctctttgtgtttttgttcctctctactgtgtctctttgaccctaagcaatgacctccttccttgttataaaatttcactgattgttttacagtcttcattctctttctttcctttcggcttctgggccaccacacttttggctttcccatttggtcctcctcagtctttgtgagtctctatttatctacctttccctcaactgttggttgtgctttgggttttatctttggcactattttttttttctgtatgcaatatatcttcagcaaataaatcatgtttaaaatggcagatctaactgagctcatctgggaataaaagggcacagaatcagtcccggaggaaagtcgacatttagaggtcaggtagaggaggaagagtcagcaagaagacaaaaagagcagccagagatgtaggagcatttcaagaaggagggtcggtcagcagtgttgactgtgcctaagaggtcaagtaaggtaagaatagagaagcaaccactgtattttgcaatatagaggctgttggtgaccttaggaagcatggttttctggagttttaagggcaaaagctggattatagtaagtagaagagttgaaaggaggcagaggagcagagataatgcgtaacgatgctttgaagaaacagaacagggccaggtacggtggctcatgcctgtaatcccagcactttgggaggccaaggcaggtggatcacttgagcccgggagttcaagaccagcctgggtgacatggtgaaaccctgtctgtacaaaaaaaaatacaaaaatagccggacatggtggcacacacctgtagtcccagatactccagaggctgaggtaggaggatcacttgagcctgataagtggaggctgtagtgagccaagattgtgccactgcactctagcctggagcttgggtgacagagcaagaccctgtctcaaaaaaaaaaaaaaaagaaaagaaacagaacagtaggatccacagttagggaggctttaggatcaagggagataaagtataagacagcaatttggaaactataacttactgcatatgtgtaaggagaattctagaaagaagatggttgagatcacaaccctggggaacaacttcagttagagagtaggaatgaaaaagagatccccaaaaggcattcagcccaagagacagatgagcaccttctgctctgtgtgctgtccttccatgctgggattgcaataaggaatctgcacattccttgatctcaaacagtttatagtttgctgttgtgtttcacaaagtatgtttgtgtgaatcacctgcatccagacagacttgtattaaatacagattccagggccctacctcaggcctacggaatcagaatttcaggaagtgatgccaagagtttgaatttttagcaaatgactcatactctgccacacaagatgattcgtattcccactacagtttgagaaccactggtatgttgggtactgagcatgttaacaaataagagtaggtttaacagttaatcgaagactagacaaggatttgttcatctctttttatgtttatgccattaaataagagaagctgggcttgttaggtgggaaataatagcacatattcataggcagacataaggaaaataatcttaaactcatgccatatggttttagtaatgttttgtttatgaagggtcttaccattcctttcttgtggaagctttgagttattttcactttgtttctgttatggataatgcctttatactggcagtgtacagtaaaaggctaagattatgagctctagaaccatactgcctaggtttaaattgcagctccacacttactagctctgtaatttgggggaaattatttaagtcatctgtgcttcagttttctcatctataatagaagtatcataatagtgtataatctcattgagttgtgaggattaaatggattaataattataaagtatttaaaatggtacctggcacatagtaaacaataaatataggctatttttattgttaatagttatctttgtgaatctagagtcttaacttctgttgaactatttctctaggataaattttcaggatggaatttctacattaaagaatgaagacatctttatgtccctttgctatctatagtcattgcttttcaaaagggtgatatctgtttgtgctataataatttgtaaatgcaagctatcaatggtgtgtgtgtgtgtgtatgtgttttgtatgtctctttatatgaatgcatacaagcatggcttaggttgtaagtttgtagaaaactttgaccttctttttaagcctgctcttaagtctgttgttaagtttcatgttatagtgcctcgttagatactatctccaggtagtatgttgataaatgatagtaagttacctttgaaagattatgtcaaagaaatattctaaatctgtgtctttttccttttgatagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaagtgagttctgttctgcatgtggtaagggatgaaagaagggaattctgttactctaatcagaacggtagaaaagtagaaaacaagcttctaggtacataatttgaataagctgacagaatagtaaccttcaccaacttagaaaatatatctggttttgttacttataaatttaacttgtaattattttattctattattgaagtgatattttattttgaagaaagatgaaatgttaaatgtaaaaatgactttgctctagagctgtgtgatatgtgaaaataattcagataagatagataatgttcctttgttcattctttcagtaaatatttactgagcacttaactattgccaggcactttgcttggtgctggggatataacaagatatgtggtatttgccctcataagggttatagtttaatgagggagaaagtcaaatccacgatgtcaagggttggggggatgggaagtagtagataggagaatggtattccaagtagaaggaacagcaggtagagaagtatggaggcatgagatcatagggcgggcatatttagggaactgcagactgttctctgtgactggtgcccaggatggtgaaaataaagctagagagatgggtagaagaaaagtcatgtagggccttgtaggccatattaagagcttggactttaccttgtgggcagtggaaaggcattgaaggttttcagccagggtgtgacagagtcaggtttgttttatttatttatttatttatttatttagaaacagagtctcactctgtcacccaggctggagtgcagtggtgcgatcttggctcactgcaacctccatctcccaggttcagatgattctcgtgccttagcctcctgagtagctgggattacaggcgtgcaccaccatgcccagctaatttttgtatttttagtagagttggggtttcaccatgttggccaggcttgtctcaagctcctgacctcaggtgattcgcctgccttggcctcccaaagcgttgggattacaggcgtgagccactgcccctggcccttcagtcagtttttgctttagaaagatcactctggtggcttattagagtggccatagttgggaaatcttagtaattagttttaaaaagtgcctcaaccttccccgttggcacttaaaaatcttttcttacttaacccagccttacttccttagttcttatctcagaatgaggtccttattactttctatggctaaccccttatacagtttaaggtgtactctaagctactatgagagagacccccaagatacagtattaattttaatgagatagtccagagatgagtggtttgggatgttggggtggctctgccatttccaattccctaattcccaaagcaattagtgctttccacttctggccaaggcagctcctttggtgcttgttatatcccagtgcttgcccagtaattttaaaggcagggcccagaagtggcctgatattgttgagaagcttccacttacatcttactgttcactacacagtcatgtagctagcatagctagaagggaggccaggaattgtcatctctggctatgtagtcgtaggctcaactaaaactctgttactctggaggaagttataggatatcaggggatgacttgcagtcttccagtctactctcctggccacccagatatttcagtgaacctttcttcccaaacatagaatacgcctcttctctgagagaggtagctccaaagacctatctagtcactgtgtttggctccaagtccagcatgtctaggtggtacacagtcctatccatcaggccctggtgtggctcctgtggtccactgaccataaagtaaaagataagtcatatgttttccctgctttcccagcctaacccagtagacaatggtgaaataagaaaaggatcatcacagtgagagttacaaactcccatttggaaaagggaagaatgagaaacatgtagaagtcattgctttccagtaatgatcaaataattgcctcacacaatttcaaagactccctattctgaccaggaagtggttagtggttctgctttcttggaggaactccctcaccctttttccctgactcctggctttgttctccaggaagtttttcctttctggccacatccaaaatggtagttagagagtatatcatctttgggaattgtacccattttgtagtcctcttgctgccagcgtaggtttgtgggcctagaggttaggggttaaataatcttagcttcttatgattttggctttatactttctctaaaaatgtattagacttacagtctttgtgtttctaggcagttcctgggaaaatgtccagggaaagcacatgtagtcgtccttttagaggcaagactgggaaatagggcatatatcttccactcatgtattatgagccagaatttagtcacagccatatgtagctttaagagagtatagaatatgtaatccaattaaaatgcagttatagtagaaggagatgttatctgtctgccatgcctctctgcctgtgtctctgatctagctgtgttatttcgagctttggtacctttttttcatgcttttgttatcttctaggaatgctgttctccccctaagcctccttgtaaacttttgctcactttacaggtcccaagcgaaatactttcttaatttgtactttaatgcttctaaaagggcagttctgatcatattccttccttcaacagatactgtctgccctcaaggtaaaattccttaacgggacttggaatattcttcaagatctgccactttttccttctgtgggctcatcttttactactttagtcctcagttttgctttccagccatacttcatacttagccatttacaattcaatgctaggttctttctctcttcctagcctttgcaatagctgttaccttttactggaatatatttatctacttaattttttaaaaatctcactttgtgtgcctgagcttagatgtttccttttccagaaacccctgaacattaacactgagtcaggcaccgcaatcagacactctttttatgtgtctacatagcatctagtttgttcatattgtaacacttttcacactgtattattattattattattattattattgagacgaagtttcgcttttgttgcccaggctggagtgcaatggcgcaatctcagctcaccgcaacctccacttcctgggttcaagtgattatcctgcctcagcctcccgagtaactgggatgacaggcgtgtgccaccacgcctggctaatttttgtatttttagtagagatggggtttcaccatgttggccaggcaggtctcgaactcctgacctcaggcaatccgcccgcctcggcctcccaaagtgctgggattacaggcatgagccaccgtgcctggcctcagactgtattataattgaaatgattgtttatttctgtaccctgactgtaggcttcttgatggcagggatcataccttgttaccttttgtggcctgtgcaccaagtgacttacaagtctggtttaggagaaacaaattttatggggaaagtgatgactttcattctgggcatgtcatgtttaagctgtctatggtatgtccagttggatatgtctagtagacagtagtgtaggtagtcctggagctcaggagataggtcagatggagatttgggaatcattggcataattgtggtagctgaaaacaaactacaacaaaacatgagagtgcatgctgccctccagggagtaagtaagtgtgaaaaaagcaggaggctaaggaagctagaaaacgttagtgtagagggaaagggactatgatataaaccaggtatattagcctgcttgggctgctataacaaaataccatagactgagtggcttgaacaacagatacttgtttctcacagttctggagactgcgtgaggtgcccgctaattcagttcttgatgagggccttcttcctggctggcagatggccaccttcttgctgtgttctcaggtggtggaaagagagtgatctttttcttcctcttttttaaagccactaatcccatcacgaggaccccaccctcatgacctcatctaatcttaagtgcctcccaaaggccttgtctccaaatatagtcacactgtaacatatgaattttgaaaggacacagttcagtctatagcaccaggcaagcctgatgtcaagaaatctagtgaagataaaacactttccaaaaggaagtggtcaacactatcatatgtttcagagagagccactggatatggcaatgtggaagtcattggtggaaatggtgcaaatagttttagagtattggaggaaaagattttgcctgagttcctgtatctccttgtaattcatgtcagtcctctgtgaacattaatataattcaacaggtacccctatctatccacttgcccaaggtacaaatgtgggaggcaaaatttagttaacctgtctcacgccagtcaccaagttctataaatgctgcctcctatctcttctctgtccctttttctttattacccattctactttagtttatttccctcctcatttcttacccggtatactgcagtagtctcctgtctggtcctcctttgagtcagttttccgcactctagccaatgtgtcctttgttttttttttttttttttttttaatgtgtcctttttaaagtgcaaatctgatcacaccctccctaggctaaaacttttggatgtttattcattattcttaggataatgcacagtgtggtttataaagtcttgtataacctggtttttgcttacttctccagtcttgtctgtccagataattcactttttcttcacattctgtactctagtcatgtgagccaattttactttcctaaatctattaggtgctgttttacctctaggcccttatgcttgctgcttcctctctggaaaaactctttgctcacttttttttgttgttgttgttttttgaaacaaggtctcactttgttacccaggctggagtgcagtggcgcaatctcagcttactacagcctcaacctcctgggttccagcgatcctcctgcctcagcctcccaagtagctgggactataggcgtgtgccaccacacctggctaatttttgtattttgtgtacagacggggttttgccatgttgcccaggctggtcttgaactcctgagctcaagcgatctgcccgcctcagcctcccaaagtgctaggattacaggcatgagccagccaccacgcctggcctttcgctcactctttaccttgccatctgttacttattcttcaggtcttaaatcagacatcacttgttctgggaagtctttctggttaccctttggcaaatctccatttcgtgcctcatctattaatgtgtccccagagcaccatgtactgcctttaactttcctgtcatcctgtttgccatgctgcactgtaattccttacactgtgatccctatgaagactgggacttggtggttttgcttttttgtatcctcagcatccagcacagtaactaactcaaagtggatactcaaatgttgagaatttggtagaaaagatgtttgctttaagaacttaggaaaaagcaaagaaaaccatatggcctattgggggttaatcttaattacatcctcctcctaagatgtcatctcttgttcatgctttaagagtccaattatgcttttgcagctatcgttctaatgggtaatacacatgctgttgtgctatgtagctagaatagagatctttttatttcttatgtacttctatcagtttgacttgaaagaaacaggtatattgggaaggggaagagggagaagagactgtatccgtaagtaatatggtgacattggcagtactgaacgtgcttatacatagatagaagatagaagtaaaagtgatgttgcttataaccacagtaagttttatatcttttattctacagttatttgtttcattacatctgccaagacaggattgtatatctttgtatcactgatgatgtaagtaacttgaagacatattgctatttaactatgtgtactgttaatacagccagttcttaattatctataccaggggtccccaacccccagggctgcagaccggtacaggtctgtggcttgttaggaaccaggccacatagcaggaggtgagtggcctatgagcattaccacctgagttctgcctcctgtcagatcagcagcagcattagattctcatatgagtgtgaaccctgttgtgaactctgcatccgagggatctaaattgcatgctccttaggagaatctaatgcctgatgatctgaggtggaacagtttaatcccgaaaccattcaccctcccccagtccttggaaaaattgtcttctacaaaaccggtccctggtgccaaaaaggttggggactgctgatctgtacctatagtgggcaaacgtgatgcgaactttacatagctggaattgttaatattttgcatttgtcatatagagcagcaaatgttaagaaaacttgatactggggtatgtgcaaatcaactcaattttggtagagttttagcttagcctcttgcaacttctatatttattctattttgtagtgagaattgatgttcataattataattctttgatatcaaaacctctcaaaaattgtttacgtggaatgttaaattagatagcatcatttcttctatcagtagttaatgaatcctttaatgtatgtgaactttggaaaaacaaaattacaatacattatgatcagctatataaacctgtagtttacattggttaggtatgactgtttgtcggctctcagcccaaaattctcagtaacttaatgatgtcattaaggtcctttctcttctctgcttatctccgtgtctccttcttcccagacaggttgccattatggtttcgtagagctacatacttatttattcatgtccggagtagagggactgtgtcttcttgagtgtcttattgtaggaatgaggaagcttttcccagctgcatgccctcccctccccctgctttcaaagtgaacttcctttcatgtcttattggctgcatgctcatttctaaactgcctactggcaaagagacttggaattggcatggttgccatagatcagggttcctaatctttattgtatcacagactcgtcacttgtgggacactcccagaatgtttttgttttctttttttaattttccttttccagaatgcttttaaatgtataaaacacacacaattctaacaaagccaattatattgaaatatatatatatatagtattcaaaatattttaaaaacttgatgtagtaatatatatgcttctttatgaactcattaacaagatctagtcataggtctaataactaatagtcttgatgtgatgggtgttgacagtattttgagatatctgtaactgtgatggtatacaaaaaaagatttctgttggtgacagttacaggtactgtttaatactaccccgattatgaatatacaacctatattcacaattgaaatataagttaacgattgataaaaataatgatgtgattttctttttttctatccaagttcaaaggccccttgaatttggaccattgaccccaatttaagaacccttggcttagactaagcatcttgggtgaaagggaaatgactgtcaaccatagtgatcatcacaatgatttttatctctggcttcacaatattttccaaaagtacgaaaaaatctagctatatgtgaaatgactgatgtgaaacagcttggaatagaaggaaaatactaatgaaatctgggatagttagagtcgagcctcatatttcttgagctataatttgatacacacatatacatgtatacataaacacacatacacacattcatttttttcctctaaggtattcttacagagaacacacatactttttggctggctgggattagacatgagtatgtcacttgatcttttcaaatataccaccactattgaaaaaattcgatttgaagttaatatcagtagtagtatctgtatgtgtgaaagactctatgattattatgggatttattaaacatattcttgtgctgggccttctaatagatcttatgaaatatatggaggaagtaaaattcaattcctgatgtcaagaagttgataacctaggtatcattatcttcagttgtcaatgaccagatatatctggattcattctcagctctttcatttactagttgttggacctttggacaagttagttactttttcagagccttcctttacttatctttaagataggatcaatgctagttcctcctcagataatcattgctcagtaaatgttagctgttttttattgttgttcttaatcactcacatcatctttgtttactttctaaatgtgagttctgtgttgatctcttttcaggattttgaacgttcccgagcctttaattttctgaatgagataaagaagaggttccagactacttacggttcaagagcacagacagcacttccatatgccatgaatagcgagttctcaagtgtcttagctgcacagctggtaagatctttctcaggataaggtattttgatttatatcttcttcattaccttcaaacactatgaatctagggggccctgacctgcaatatagttttctgattgtgttactgtaagccaacataataaaacttccctgattaaaaaaaaaatgtaaaggggccattttagggtagaaaacagtgatagtctttattatctctattaatagtggtcacagtgtctcatgattggaagagcattaaagatcatctagttgaactacccatctgatgcttaaatgtgttcagcatgccaaatgatcttttaaactatacgtaaaccttctacccttccatgagggaaatttaattttctaacaacccaaattaataatttgaaactctcctcatctgtatgaatccctaattgtcagcttagtgaggttttacatgtgaatatacctgtgaaataccactgtacttaagacagcattttaatcaccctaaaagttccctcatatcccttaccagttggtcccctcccctacactttgccccaggcaaccacggatctgttttctatcactataaattagttttgtctttcatagaactttctgtaaatagaatcatacagtatgtaaactttctgtaaatggaatcatacagtatgtacttttttgtgtcttgcttgtttcagtcagtgtaaggctcttgatattcttccatgttgtataaatcagtagtttgttcccctttttgctaagtagtagtatatgcatataccacaatttgtttatccatccacctgttgctggatatttgggttgcttccagttttcagctatcatgaataaagctgctgttaacctccatgtataagtctttgtgtggacatatgtttttatttctctctgataaatacctaggaatggaattgctgggtcatatggtaggtgatgtgtaattgaaaaaaaaaaatcaccacttttttttccaaagtggttgtaccattttatattctcaccagcagttccagtgtctctgcgtccttgccagtacttgatgtggtcttaagttttgccattccagttgatgtgtaatggtatctcattgtggttttaatttatgttttcatgatgtcagacacctttcgaaatgcttcccttttatccatgaaactatttgagtataaagacgtaagctctagctatgattttgttgtgagtttaaaaaaaagctgtattgtaatggaatactttcacttctcctgtggttttaatactctgagtattacatttctaaattttatgcacacacacacacacgcacacacatactcttctggcaataaagtccctttaaattggttacttataaacctttattattcaagcagttggtttgtttcatactccccactaggaaatgttcatctgtgtaaaactgtgtaaaacactacccacaacaaaaataccagtacttagtcaaaagtaaagggtcagctagaaacaaaactttcaaattaaccaatttgtcattagctctagatctgtgtgaccttctgaacaaaatctctacctgttcctttgtctgtaaatagagataatagcatcgtttcatagagttttggggtggattaaataatatcccgtttgaagcacttaacacaatgaaatgactggaacattgtgtattaagcaccccataattgctagctatggataaataatttcaaactatatattatcagtgtcttagattctagatcctgtgagaagccaataaaaatagtttatatgctgtgatcctggcagatacaagaacagattctgagaagctgggccagcccctacctcatcatactcaagaagtggggaacaattttgcagcattctttcccccactgccccaactacagtcttctttttctcctttcttccttgtctgagcacagattatatatcccccccaatctctgccccacaagtcacatgtatatttgatataatgtttatttttattttatttaaaataaggtaatttttagactacatacttatagtttgtatagaagcattttttatgctgcccatattttttcctgggtattgtaacatttttccagtgaagtgacatgtatcttttatatcaatagagacataattttatagcattcctcagtgtaaattgtcattccccttatttttgttttcctattgtaaataatgtctaggtaccataagttaaaacttattttcttatagaagcatcactctgagaataagggcctagacaaagtgatggagactcaagcccaagtggatgaactgaaaggaatcatggtcagaaacataggtatgtttcatggcatagtttcatgcatgtgggcaaaaatgataaagattacttgactggggtcaaattattctagagaagccaaaatagcacttccttattcttaccattggaagttaattgtcagctgagacaactgtgatactgtctgcttgtgcaaatggtttcttctttgtccttgcaactattcttcattctaaatttactagtttgcttaacaagactaatttctaagaaccttatgataattcagcagtttagaataatttggtcagtgtgattgtacagtatttcactgagttaatgtatcacgggttacctaaccttgcctgaattttggacgcataggttctttagcacagtgttagagtgctgttttgcaaccagataaggagcttgctgaagaatgtcaatcaatattgtgcttccttcactgaggccctcttgctatgaaaatgtcaattggactgaacagtatgcttagagacttagtcaaccagttgcaaatactcttaagtaggactgatttagaagtttatcctacagtagtaaccatactgttatatttttgtgcctattatgtttttcttattttcttgagattaattatcaggaatgggattaataatcaaaatgcgcaaacgttttcgtggttcttgatatgtacgtcttggctatttaaagtgatttcctttaattgattttagttttaattatatatctagatagagactagagaatctgttgagacaactactatttatttttattcttttttttgtcaccaaatgtatttattttgcccgaaagtggaggcagacaattgctacaatattatttattgcagatgcataaagtttccagaaaaatcaacgtttttaatcgactccttttaaatgacttatttatttttagagttatagaaacagcaaatttaatccatcttgaattaatttttgtataaggtataaggaagggatccagtttcagctttctacatatggctagccagttttcccagcaccatttattaaatagggaatcctttccccattgcttgtttttcttaggtttgtcaaagatcagatggttgtagatatgtggcgttatttctgagggctctgttctgttccattgatctatatctctgttttggtaccagtaccatgctgttttggttactatagccttgtagtatagtttgaagtcaggtagcatgatgcctccagctttgttcttttggcataggatggacttggtgatgcgggctcttttttggttccatatgaactttaaagtagtttcttccaattctgtgaagaaagtcattggtagcttgatggggatggcattgaatctataaattaccttgggcagtatggccattttcatgatattgattcttcctacccatgaacatggaatgttcttccatttctttgtatcctcttttatttcactgagcagtggtttgtagttctccttgaagtggtccttcacatcccttgtaagttggattcctaggtattttattctctttgaagcaactgtgaatgggagttcactcatgatttgactctctgtccgttattggtgtataagaatgcttgtgatttttgtacattgattttgtatcctgagactttgctgaagttgcttatcagcttaaggggattttgggctgagacaatggggttttctagatatacaatcatgtcatctgcaaatagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttccgtttatatgctggattacatttattgatttgcgtatactgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgattgtagtttgtatttctgtgggatcggtggtgatatcccctttatcatttagacctaaaaccataaaaaccgtagaagaaaacctaggcattaccattcaggacataggcatgggcaaggacttcatgtctaaaacaccaaaagcaatggcaacaaaagccaaaattgacaaatgcgatctaattaaactaaagagcttctgcacagcaaaagaaactactatcagagtgaacagacaacctacaaaataggagaaaattttcacaacctactcatctgacaaagagctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgtgataccatctcacaccagttagaatggcagtcattaaaaagtcaggaaacaacagttactggagaggatgtggagaaataggaacacttttacacagttggtcggactgtaaactagttcaacccttgtggaagtcagtgtggcgattcctcagggatctagaactagaaataccatttgacccagccatcccattactgggtatatacccaaggactataaatcatgccgctataaagacacatgcacacgtatgtttatagcggcagtattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcctcattctcagtaaactatcgcaagaacaaaaaaccaaacaccgcatgttctcactcataggtgagaattgaacaatgagaacacatggacacaggaaggggaacatcacactctggggactgttgtggggtggggggagggggaaggatagctttaggagatatacctaatgctaaatgacgagttaatgggtgcagcacaccagcatggcacatgtatacatatgtaacaaacctgcacattgtgcacatgtaccctaaaacttaaagtataataataataaaataaaataaaaaaagcaaatttaaaatgtgacaagaacattcctagttaattccctttcatttttttaacagcttaattgaaatataattcacatatcatataattcacccatttaaagtatacagtcagtggttactatattcacagaattgtacaaccattgctgcgatcaattttgtaacatttttatcatccctaaatgaagccctgtactcatttgcagttgctcctcaactctcagacctaagcaacaattaattcccttttcttcttcataaatttgcctattctggacatttcgtataaatggaatcttgtaatatgtggccttttgtgtcttcgttcacttagcgtaatgattgtgagattcattcatgtcgtagcataaatcaatacttaattcttttttatgactaataattccaatgcattaatgcattttatgtatctactcattagttcatggtctggttattataaataatgctgctatgaacatttgtgtacaagtttttgtgtgagcatatatatatattatatattatatatatatatatatgtttttggttctcttgcttacatacctaggaatagaattgctggatcacatggcaactttgtaacattttgaagaagggccaaactttcctaaagtgactgcacctttatacattcctaatagcaatgtatgaggattctgattcctccacatccttgccaaaacttatcttttttgattatacccagtctagtgaaatggtactttattgtgattttgatttgcatttccctgatgactaatgatgttgagcattttttcatgtgcttataggccattcgtatattttctttacctttggagaaatgtctatttaaaaatactttattgtttttaagtgggttatttgtctttttatggttgagctataacagtactttatatattctggatactagacccttatcagatacatgattttcaaatattttgctctattctgtgagttgtcttttcattttcttgatggtgttctttgaagcacaacagtttttatgaagtccaatttatttttttctttagtttgtgctttgaataacatatctaagaaactgtcgcctaagccaagatcatgaagatttactactttgttttcttctaagactagttttagctcttacatttctatctatgatctattttgagttaatgtttatgtatggaataaagaagagatccaacttaattctgttgaatatgtatatacagttgttccagaaccatttgctgaaaaggcttttctttccctgttgaatgatcttagcattcttatcaaaaattagttatcaatggatgtatagctttgtttctggaccttcagttctgttcagtttatctttatgccagtaccaggctgtcatgattattatagctttgtagtaggttttaaaatcaggaaatattcatcttccaactttattctttctcaaaattgctttgactattctgggtacctttcattttcatgaactttaggatgagcttgtcaatttcagatagcaaaaaaagctatctgggattttgatagggattgtgttgaatctgtagatcaattagggagccattttaacaatattaaacttctgatccatgaacatgggctttctttctattcatttaggtttctttaattttttccaacaatgttttgtagttttcagtgtgcaagtcttacatgacaaagactctgcttcaccaaattttagacaagctcctctgagcactctgttaaactaggtctcatcctcgggctctgtccttggcctgcctaaggaagtcttagcaaagaatcctgctaataccccacccttgatcaagttccttgtcccctatatttgttatataagtccggccagcttttagcaggaatcctgttaggccagtttagagagaatccccttgcccttgatgcctcctcttagtaattttccatcctctgaccccctcactctgttcattggccacaaatccccactggtcttggttgtgttaggagttgagctcaatctctcccctccattgtgatagccttgacccctattgcagtaatctcaaaatctgccttaccattttttaaccagtgtcagaataatttttctttaacaatatctcttctaacatccttcttgccttgttcctaagtatttttttatgctattgtaaatggaatttttctctttcattttcggattgttcagtactaatgtatagaaattttattgatttttataaattggtgttgtatcatacaaccttgttctcctttattagttctaatagctttttaatagtttccttaggattttctctatatagaatcatgctacttgcaaatagagatagttttaattcttccttttcagtctggatgcttttcatttctttttattgcttatttgccctagctagaacctccagtataatgttgaatagaagtggtaagagtggacatcattgtcttattcctgctcttagggagatcttgaagaatcttccacaattaagtatgaggttagctgtgggtttttcatagatgtcctttatcaggttgaggaagtttctttttcttatttgttgagtggttttatcattaaacagtgttggattttgtcaattttttttacatctattgaaatgatggtttttgttctttattaatatgatgtattataacaattgattttcagatattaaatcaaccttgtgtttctgaaatgaatcccactgcatcatggtgtatagtcctttttgcatattattggattcatcctgccagtagtctgttgaggatttgttaaatgtctgtatttttaagagttgttggtatatcattttcttttatttatttatttattttattatttttttttattgatcattcttgggtgtttctcacagacggggatttggcagggtcatgggacaatagtggagggaagatcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttcttcacagacacagcaaccatccgatttctcaatcttttccccacctttcccccttttctattccacaaaaccgccattgtcatcatggcccgttctcaatgagctattgggtacacctcccagacggggcggctgctgggcggaggggctcctcacttcgcagacggggcggctgccgggtggagggtctcctcacttctcagacagggcggccgggcagcgacgctcctcacctcccagaaggggcggcggggcagaggcgctccccacatctcagacgatgggcggccgggcagagacgctcctcacttcctagatgggatggcggctgggcagagacgctcctcacttcctagatgggatggcggccgggcagagacgctcctcactttccagactgggcagccaggcagaggggctcctcacatcccagacgatgggtgcccaggcagagacgctcctcacttcccagacggggtggcggctgggcagaggctgcaatctcggcactttgggaggccaaggcaggcggctgggaggtggaggttgcagcgagccgagatcgcgccactgcactccagcctgggcaccattgagcactgagtgaacgagactccgtctgcaatcccggcacctcgggaggccgaggctggcggatcactcgcggttagcagctggagaccagcccggccaacacagcgaaaccccgtctccaccaaaaaaatacgaaaaccagtcaggcgtggcagcactcggcaggctgaggcaggagaatcaggcagggaggttgcagtgagccgagatagcagtagtacagtccagcttcggctgggcatcagagggagaccgtggaaagagagggagagggagaccgtggggagagtgagagggggagggggagagggagagggagagccattttcttttcttgtgatgtctttggttttgataccagggtaatgctgggctcatagaatgagtcaagaagtgttccccttttcttctattttggaaagatttgtgaaagttttgtattaattcttgaaatgtttggtagaattcacctttgaagccacctgggcttgggcttttctttgtgtgaagcttttttgtttttgtttttgttttttgagatggggtctgtctgtcacccaggctggagtgcagtgacatgatcctctctaattcctctttcattcccttggtgggagggttacctgcagccttgacctcctgggctcaggtaatcttcccacctcagcctcccaagcagctgggactgcaggcatgtgccaccacacctggctaatttttgttttttggtttttttgtagagacaaggtcttgccatgttgcccaggctagtctcaaactcctgggctcaagcgatccacttgcctcagcctaccaaagtgctaggattacaggcatgagcctccatgcccggcctgaagttttaaaattactgatttagtctctatgcttgctgtagctattcagattttttatttcttcttgagtctgtttagcagtttgtatctttctaggaatttgtgcatttcatctaagttacctaatttatttacacactcctgtttatagaattcccctaagatcctcttcattttgtaagtttggtggtgatgtctcctctttcatttctgattttagtaatgtaagttttttctgttttacttggtcattctacgtaaaggtttgtcaattttattgatctttctaaagaaccaacttctggtttcatagattttttttctatagtttttctgttctctatttaatttgttcaccctaatatttatttccttcccactgctagctttagatttagtttacccttcttttctagatccataaggtagaaagttaagttgttaggttgttaatttgagatcatttgtcttagctcaggctgccataacaaaattccatagacgtagtgacttaaacaacagaaatttattttctcacatttctggaggctagaagtccaagatcacggtgccagtatggtcaggttctggtaagggctctcttcctggcttgcagacagcatcttctctctctgttctcccatcaggcaaggaaaagagagctagctgtctagtgtcttttatttaattgatacataatatttgtacacatttatggggtacgtgtgatattttgttacatgcaaagactgtgtaatgatcaagtcaggatatatggggtgtccatcagctcaagaatttatttctgtgtgatgggaacatttcaaattctctcttctagctattttgaaatatataatacactattgttaactttagtcaccctactctgctatcaaacattagaacttattccttctatccaactgtgtgtttgtacctattaaccatcctctcatattccctgctcggccccacatacccacacccttcctagcctctggtatctattgtgctattgtctacctccatgagatcaactgttttagttcccacatgtgagtaagaacatgtgatatttgtctttccatgcctgccttatatcacttaacataataacctccagttacatccatgttgctgtaaatggcatgacttcattctatttcatggtcaaatagtattccattgtgtttataaaccacattttctttatccattcatccattcatggacacttaggttgactccatatctttgctattgtgaatagggatgcaataaatatgcaagtgcagatatcccgtctatacactgatttcttttcctttgcataaatacccagtagtaggattgctggatcatatggtagtttaatttttagtttttggggaaatctccacactggtttccatagtagctgcactagtttactttcccaccaacagtgtgtaagtgttttttttttttttccttatactagccagcatctgttattttgtatctttttagtaaccattctaactggggtaacatgatatctcattttggcttttatttgcatttctatgatgttgagcattttttcatataccttttggccatttgtatgtcttcttttgagaaatggctattcatgtcctctgcccactttttaaggggattatttgtatatctcctgttgagttcattatatattctggatattattcccttatcaaatgaatagtttgcaactattttctcccattcaactggttgtctcttcactcttgattatttcctttgctgtgcaaaagcttttttgtttaatatagtcctatttgtctatttttcttttcgttacctgtccttttgaggtgttagccataaaatcttttcctagagcagtgttctgaagtgtttcccctatgttttcttctagtaggtttatagttctgggtctgaaatttaagtctttaatctatcttggttgatttttgtatgtgatgagagacagaggtccagtttaattcttccacatatggatatccagttttcccaataccatttattgaagaaagtgtcctttccccagtgtacgtccttggcacctttgttgaaaatcagttgcctatatatgtgtggctgtacatacgtggatcaatgtctggcttttctattctattccatcgaccttgtgtctgtttttataccaaaccatgctgttttggttactgtagccttgtaatatgttttgaagtcaggtagtgtgatgcctccagctttgttcattttgctcaggattgctttggctatttggactcttttttggttcctgaaatactaattttaggattgttttttctgtttctgtgaaaaatgacattggtacttcgatagagattgcattgaatctgtagattgctttgggcttatggtcattttaataatatacattcttatgatccatgaccataagatgtctttctgtatctttgtgtcatcttcagtttttttcatcagtgttttgtagttttacttgtaggagtctttcacctactcgttaaatttattcttcaatattttatatgttcataactattataaatgggattaccttcttgatttcataaagttttatttcaccaagttgattattgatgcatagaaacattacagatatttgtatgttgattctgtatcctgcaactttactgaatatatttatcagatctaggagttttttggtggagtctttgggtcttttagacataagatcatatcatctgcaaagagggataatttgacatcctctttttcaatttggatgccctttatttctttctcttgcctgattgctctggctaggacttccagtattgtgttgaataggagtagtgaaactgggcttccttccagtactatgttgaataggagtggtgagagttttccatttcttagaggaaaggcttttcgtttttcccattccgtatgatgttagctgtgggtttgtcataaatggcctttatcatgttgagggatattccttctatgcctagttttttgagagtttttatcatgaagagatgttgaattttttttgataccttgaactatatatttttatttgaatatataaaagtagaatatcctattttccttttgagctatgtcatcatactgctaaaattatggatgaaaatggaaatatttcaacctgacccattgcaatttctatgttacacatttgctctttttttattattatactttaaattctgggatacatgtgcagaatgtgcagctttgttacataggtatacacatgccatggtggtttgctgcacccattaacccatcatctacattaggtatttctcctaatgctatttctcccctagcccccctacccccaacaggccccagtgtgtgatgttcccctccctgtgtccatgtgttctcattgttcaactcccacttatgagtgagaacacgtggtgtttggttttctgttcctttcttaccttgctgagaatgatggtttccagcttcatccatgtccctgcaaaggacatgaactcctccttttttatggctgcatagtattccatcgtgtatatgtgccacattttctttatccagtctatcattgttgggcatttgggttggttccaagtctttgctattgtgaacagtgctgcaataaacatacgtgtgcatgtgtctttatagtaaaatgatttataatcctttgggtatatacccaataatgggattgctgggtcaaatggtatttctggttctagatccttgaggaatcgccacactgtctttgacaatggttgaactaatttacacttccaccaacagtgtaaaagcattcctattgctccacatcctctccagcatctgttctttcctgacttgttaatgattgccatttaatggtcgccattcttactggtgtgagaggatatctcattatggttttgatttgcatttctctaatgacccgtgatgatgagcttttttttcatatgtttattggccacataaatgtcttcttttgagaagtgtcttttcatatccttcacacactttttgatggggttgtttttttcttgtaaatttgtttaagttccttgtagattccggatattagccctttgtcagatggatagattgcaaaaattttttcccattctgtaggttgcctgttcactctgatgatagtttcttttgctgtgcagaagctctttgctttaattagatcccatttgtcaattttggcttttgttgccattgcttttggtgttttagtcatgaaatctttgcccatacctatgtcctgaatggtattgcccaggttttcttctagggattttatggttttaagtcttatgtttaagtctttaatccatcttgagttaatttttgtataaggtgtaaggaagggggccagtttcagttttctgaatatggctagccagttttcccaacaccatttattaaatagggaatcctttccccattgcttgtttttgtcaggtttgtcaaagatcagatggttgtagatgtgtagcgttatttctgaggcctctgttctgttccattggtctatgtatctgttttggtaccaataccatgctgttttggttactgtagccttgtagtataatttgaagtcaggtagcgtgatgtctccagctttgttcttcttgcttaggattgtcttggctatgtgggctcttttttggttccaaatgaaatttaaagtagtgtttttctaattctgtgaagaaagtcaatggtagctggatggggatagcattgaatctataaattactttgggcagtttggccatattcttcctatccatgagcatggaatgtttttccattcatttgtgtcctctcttatttccttgagcagtggtttgtcattctccttgaagaggtccttcacatcccctgtaagttgtatttctaggtattttattctctttgtagcaattgtgaatgggagttcactcatgatttggctctctgtttgtcttttattggtgtataggaatgcttgtgatttttgcacattgattttgcattctgatactttgctgaagttgcttatcagcttaaggagattttgggctgagacaatggggttttctaaatatacaatcatgtcatctgcaaagagagacaatttgacttcctctcttcctatttgaataccctttatttctttctcttgcctgattgccctggacagaacttccaatactatgttgaataggagtggtgagggagggcatccttgtcttgtgctggttttcaaagggaatacttccagcttttgcccattcagtatgatattggatgtgggtttgtcataaatagttcttattattttgagatgcattccatcaatacctagtttattgagagtttttagcataaagcggtgttgaattttatcgaaggccttttctgcatctattgagataatcatgtggtttttgtcattggttctttttctgtgatggattacgtttattgatttgcgtatgttgaaccagtcttgcatcccagtgatgaagctgacctgatcgtggtggataagctttttgatgtgctgatgggttcgatttgccagtattttattgaggattttcgcatcagtgttcatcagggatattggcctgaaattttcctttttggttgtgtctctgccaggctttggtatcaggatgatgctggcctcataaaatgagttagggaggagtccctcttcttctgttgtttggaatagtttcagaaggaatggtaccagctcctctttatacctctggtggaattcagctgtgaatccttctggtcctggaccttttttgtttggtaggctattaattactgcctcaagttcagaacttgttattgttgtattcagggatttgacttcttcctggttcagtcttgggagggtgtatgtgtccaggaatttatccatttcttccagattttctagtttacttgcatagaggtgtttatagtattctctgatggtagtttgtatttctgtgggatcagtggtgataccccctttatcattttttattgtttctatttgattcttctctcttttctcctttattagtctcgctagcagtctatcaattttgttaatcttttcaaaaaaccagctcctggattcattgattctttttgaagggtttttcatgtctctttctccttcagttctgctctgatcttagttatttcttgtcttctgctacctttgaatttgtttgctcttgcttctctagttcttttaattgtgatgttagggtgttgactttaaatctttcccactttttgctgtgggcatttagtgctataaatttccctctaaatactgctttagctgtgtcccagagattctggtacgttgtgtctttattctcattggtttcaaaaaacttatttatttctgccttaattttgttatttacccagtagtcattcaggaacaggttgttcattttccatgtagttgtgcagttttgagtgagtttcttaatcctgagttctaatttgatggcactgtggtctgagagactgttggttacgatttccattttttgcatttgctgaggagtgttttacttccaattatgtgatcaactttagaataagtgcaatgtggtgctgagaagaatgtatattctgttgatttggcttggagagtactgtagatgtctattaggtcctcttggtccagagctgagttcaagtcctgaatatccttgttaatattctgtctcaatctaatattgacagtgggtgttaaagtctcctactattattgtgtgggagtctgagtctctttgtaggtctgtaagaacttgctttatgaatctgggtgctcctgtattgggtgcatatatatttaggatagttagctcttcttgttgcattgatccctttaccattatgtaatgcccttttttgtcttttttgatctttgttggtttaaagtctgttttatcagagactaggattgcagccactgcttttttttgctttccatttgcttagtaaataatcctctatccctttattttgagcctgtgtgtgtctttgcacatgagatgggtctcctgaatgcagcacatgggtgggtcttgattctttattcaatttgccagtctgtgtcttttatttggggcatttaccccatttacatttaaggttaatattgttatgtgtgaatttgatcctgtgattataatgctagttggttattttgcttgttagtcgatatagtttcttcatagtgttgatggtctttacagtttgatatgtttttgcagtggctggtactggtttttcctttccatatttagtgcttccttcaggacctcttgtaaggcaggcctggtggtgacaaaatctctcagcatttgcatgtctgtaaaggattttatttctccttcacttataaagcttagtttggttggatatgaaattctgggttgaaaattcttttctttaagaatgttgaatattcgcccccagtctcttctggcttgtagggtttctgtcgagagatctgctgttagtctgatgggcttccctttgtgggtagcctgacctttctctctggctgcccttaacattttttcctgcatttcatccttggtgaatctgacgattatgtgtcttggagttgctcttctcgaggagtatctttgtggtgttctctgtatttcccaaatttgaatgttgacctatcttgctaggttggggaagttctcctggttaatatcctaaagaatgttttccaacttggttctgttctccctgtcactttcaagcacaccaatcaaacataggtttggtcttttcatatagtcccatatgtcttggagcctttgttcattccttttcattattttttctctaatcttgtcttcacactttatttcattaagttgatctacaatctctgatatcctttcttccacctgatcagttcggctattgatacttttgtatgcttcacaaagttctcgtgccgtgtttttcagtcccatcaggtcatttatgttcttctctaaactggctattctagttagcaattcctctaaccttttttcaaggtccttagtttccttgcatggggttagaacattctcctttagcttggaggagtttgttattatccaccttctgaagcctgcttctgtcaatttgtcaaactcattctccgtccagtttgttctcttggaattttcagcctttttgcactggtttttcctcatcttcatggatttatctacctttggtctttgatgttggtgacctttggatggggtttctatgtggacatcctttttgttgatgttgatgctattcctttctgtttgttagttttccttctaacaggcctctctgctgcaggtctgctggagtttgttggaggtccactccagacccagtttgcctgggtatcaccagcggaggctgcagaacagcaaagattgctgcctgttccttcctctggaagcttcgtcccagaggggcacctgccagatgccagccagagctctcctgtatgagatgtctgtcgactcctgctgggaggtatcttccagtcaggaggcatggagctcagggacccacttgaggaggcagtctatactttagcagagcttgagcactgtgctgggattgccgctgctctcttccgaactggcaggcaggaacgtttaagtctgctgaaactgagtccacagccaccccttcccccaggtgctcggtcccaaggagatgggagttttatctataagcctctggctggggctgctgcctttctttcagagatgcgctgcccagagaggaggaatctagagaggcagtctggctacagggactttgcggagctgcggtgggctctccccggttcaaacttcctggccactctgtttacacagtgaggggaaaactgcctactcaagcctcagtaatggcagacgcccctccctccaccaagctcgagtgtcccaggtcgacttcagactgttgtgctggcaatgagaatttcaagccagtggatcttagcctgctgggctccgtgggggtggaatatactgagctagaccacttgcctccctggcttcagcccctttccaggcgagtgaacagttatgtctcactggcattccaggcgccactggggtatgaaaaaaaaactcctgcagctagctcggtgtctgcccaaatggccgcccagttttgtgcttgaaacccaggtccctggtggcataggcacccaagggaatctcctggtctgcagattgcgaagactgtgggaaaagcatagtatctgggccagagtgcaccattcctcacggcacggtccctcaaggcttcccttggttaggggagggagttccccgaccccttgtgcttcctggatgaggcaacgccccaccctgcttcggctcaccctccgtgggctgcacccactgtctaaccagtcccaatgagatgagccgggtacctcagttggaaatgcagaaattacccaccttctgcattgatttcactgggagctgcagaccagagctgttcctattcggtcatcttgccaaccaccctgagatgttgaattttatcaaatgctttttttatcagatgctttctctgcatctattaaggtgatcatgtggcttttattctctattctattgatggaatgtttcatgtttattgatttgcatgcattgaatcatcattgcatccctgggataaatcccacttgatcatggtgtattatctttttgatgtgatgtttgatttggtttgctagtatttcgttgaggatttttgcatctgtgatcatcagggttgttggcctgcagttttgtttttttgttgagtccttatcaggttttggtatcagggtaatgctggccttatagaatgagtagggagaattccctcctcttgaattttttggcatagtttgagaagtgatattagttcttctctgtaagtttcatggagttctccagtgaagccagctgattctgggcattgttttggttttgttgggagactttattactgattatactttattactgattcaatcccattactcattactggcttgttcaggttttctatttctttctgattcagtcttggtaggttgcatgtgtcctgggatttatccatttcttctgggttttcaagtttattagcatatagttgttaatagtatttctatggtcacttcttccaatttttagatttgctttaatatgcaaggactttttcttgaggatatatctatggtgttggttgggcagggcacttagactttgattatgggtacattcagtagtgtagtctgtataatttcttcagctataaacagcatcatcaaccatgtctgtatttttcttagtggcttagggtgtagttgttatggaggctgtggtgaagttttgatgggcatggggatttcaggtgggctagtccttgttttcgagtggtgtcaccagtgggtgaagcatgcctgtcctttggccccaggacagtgtattcattaagttatattacttttttaaaaaaagtttattttattctacaatggaaaacttgaccttttctacttttccaatattttcagatctggtagctcagcgaggagaaagattggaattattgattgacaaaacagaaaatcttgtggattctgtaagtatggaatctgataatatggagtctgatgtaaagtggagaaactatggatgatggctaacataattgggaaataccttaaattcaaatatttggtggtttttttttctttctcatttccattatgtgattactttgtaataatgaggataacaatgaggcatagaaaagaaacatcatcccctaatagccattaaggtagctttggtttggaaaacatactcagtatacagaaacaattttctaaagctttggattgaggcctatataatttagcacctcaactgcatgtaacagtctgttccctttacaaatttgtaaaacatgaaacaaatgtgcaagccgtttgtgacccagtatgaatcttgaaaactggacaattcacttttttgcttacactgatagtttcatcttgccttgtatcaatcaagagacatcgattggaaagcgccaataagccttaaaggagacaatgtgtccttgtgagctgcttatactatggttccgtatgtcctcacattttcaatgcagttactgtggatgaaagttttaaggaaagatgacagatatatggtgaacagaaggagggcagagatcagctacaatttgggtctacacaattataaatgtaaatgtacagtgcaggtttacaccttgaaagaaaacagtgattgattatgttcgttgtgactgacagctggattgtagtggttaagaacacaggctctagtatcaggttgcctggatttgaatcccacctctgctacttactagttgtgtgaccttaggcaaatgacttaacctctttgtgcctcagtcatcatcttctgtaaaatgaagatgtacccacttcagagcattttaaggattaaatcagataatgcatgtaaagtgcctaacacagtatttgatacatagtaagagctatttaaatgttcatcattattgttaattttacagggacatctattagcagcaggttttagtatatacagtctactatcaggttttctaggagtttataaacagttttttcatcaaagcatgtggtaggtggaggaaggatgctaccatacaggaagtcaaaacacctgggttctagatctcactttgtgacccattgctggggagcaaagaaaacagagaagtatctgattccagatctgcagaccaatttctttgatacttccaggctgtctcttagttattcttaattcttgaggattaccctgcttagggggaatggtctgtctttgaccaatagtagtatgatctgtactttacaaataaaagtcttaattttgttgacttcatgactgaaaacagaaggtactaatgaactaacaggtatctctctttatggtagaataacatacgtgcagcaaattgtatcaagtgtacaacttttaagtgtatagctcaattattttttatatatatctatacccatgtaaccaccacccagatctagatagaaaacattaccaacaccccagaaggctgcctcataccccttccagttaataatccccaatagacgtaattatgtttctgacttatatcaccacagatagtgttttgcctgttcttaaaatttatttgtgtctggcctctttcactcactgttatgcctgtgaaattcatccacgttttttattatagtaatcacttattcttttttattgttttatattattccattatacaaatctaccacaatttgtttatccgttcttctctgtggggctttatttctggattctctattttgttccattggtcagtttgtctacctttatgccagtaccacactgtgttgattagtataacttaatagaattcttgaaattaagtagtgtaagtcttccaactatattcttgttgtccaatattgtcttcactcttttaggtgctttgcatttccatatatgttttagaataagcttgttttccatctcttgaccccacaacaatgtgtatctttgtgactgcatttaatatataggtcactttaggggacattggtatcttgacagtatagagtttttcggtccatgaacgtgacatatctctgcttttgcttaggatttaaaaatttttctcagcagtattttttagtttttggtgtacaggtcttgcacatatttgttaaatttacccttgagaatatcatgcttttgtattgtgtaacaaatttttaaattttgtttctaattctttattgctagtatatggaaataaagttggttattgtatattgaccttgtttgtattctgcaaccttagaaaaattcatttaccagttctggttactgttttgtacattcctgccttttattttccttcccttattctggctagaaccttctacacaatactgaatacaagtgataacagtgaacatccttgcctattgaccatcttgtggggaaaaattcaatactttttgaaaaaaataaattcagtgttaagtttgtggttaactgtagattttttgtaggtaccctttaataggtggaagaattccctttaattcctcatttgagagttgtattcatgattttatcaaatgctttttctccatttattgagatctttggtttttctcctttattcagttagtatggcaaattacattgatttttcagtgttaaaccaactttgcattcctgcaaggtcatgacttactacccttcttatataacactttattggatttgctattgttttgttcaggaatttggcatctatgtttataagagatagtggtctgtaatttatttttctctttaggttttggtatcaggaatatgctggcctcattaaacaagttgggaaatcttacctctctatcttctgagtttgggtactattggtattatctgtcttagatgtttggaagaatttactagtaaagcagattgggcctcgagttttcttcgttggaaaatttaaaatctgccatcttgctgtttgtttcctatttataccatctagtctttgttccctttttgttctgccttccattggatttagtacatttgttattccattatgtctcctttgtcagtttattagctatagctccattctgtcattttctgattgctttagggtttacagtatgtctttgatttataatctcccttaaagtggcatttttccacttcatgaatagataagaaccttataatagtatacttctagctgtttcttcttggcctttatgctattgttgacatatttttatttacacatgtattaaaaacttcataatacattgttgttgtttttgtttaaagagttgattatcttttaaagagatttaaataataagggaagtcttttctgtttacccatgcagctaccatttcagtgctcttaattcttttgtgtaggccgagtttctatctgatgttattttctttctgcctgtatgctttaatttaacatataatcttccattgtagttcaagtgtgtaggtctactggaaatgaattctttcaggtttggtatgtctgagaagtttttatttcacttcctttttttttttgaaagacattttcactgagtatagaattctaggtcagtgatttttctttcttttaatacttgatgaacggtggttcatcactgtcttttacattgtttctgacaagaattctgctgtcattcttacatacataaagtgtatttttttttcttctggatgctttaaagattttctctttatcattggttttaagaaatttgattataatatatatgccttggtatatatttctttatgtttctttggctttgagtttgttgtagttttcatcaaattatgaaaatgtttagctctttctaggcttccagtgacatctgtattaagccacttgaagctgtcccacaactcactgatgctttgttcatttttaagtcttttttccactatgtttcatttagaatagtttctattgctatgtcttcaagtttacttaccttttcttctgcagttcgcaatctgctgtttctgtcctgtgtatgtttcatctttacaggtttgttttggatcttttttatatcttccatgtgtctccttaacatgtgcatactttcctctaccttgagtatatgaagtatatttataattgaagtgcttattccacttacatgtaatgcaaattttgatagagttaggtgtaggtatcttgctctttgttttttatttgccgcatccctgtcctcttcttttttattttgattactcaagtactttttaaattgttttttaaccatctctatttgttttttaacacttctattgagagataactcacagaccatacaaattgcccatttaaagggtacacttcagtggaatttagtatattacattattaaaattgtggtaaaatatgtatagcataaaattttgccattttaacctttttaaagtgcacaattcagtgatgttaattacatccacaatgttgtgcatccatcactactagctatttccaaaacttttttatcaccccttaacaaaaactctgtaaccattaagtaataataactccccattccccttactctcagcccctggtaactctaatctactttctgtctctgaatttgcctgttctagatatgtcatataagtgggatcatacaaaatttgcccttttgtgtctggcttatttcactaagcataatagtttattgcttaaaaaaaaatgctaacaatcacctgagccttcagtgagccttaatctttttgctggtggagggtctcaccttgatgttgatggctactgactgatcgatcaggctggtggttgctgaaggttgtggtggctgtggcaatttcttaaaataagacaacagtgaagtttaccacattgattgactctttcacaaaagatttctctgtagcatgtgttgctatttgatagcaatttactggcaatagaacttctttcaaaattggagtcaatcctctcaaaccctgctactgctttatcagctgagttgatgtaattttctaaatcttttgttgtcatttcaacagtgttcacagcatcttcaccaggaatagttgccatctcaagaaaccactttccttgcccatgcataagaaacaactcctcattcattaaagttttatcaagaaactgcagcagttcagtcatgtcttcaggctccagttctaattctagttctcttctatttctaccacatctgcagttactcactccactgaagtcttgaacccctcaaagtaatttgtgagggttgtaatcagtttcttccaaacacctgttaatgtttatattttgacttcctcccacgaatcatgaatgttcttaatggcatctagaatggtgaatcctttctagaaggtcttcagtttactttgcccagatccatcagaggaatcattatctatggcagctatactaaatgtttttcttaaataataagacttgaaagttgaaatcactccttgattcatgggcagcagaatggatgttgtattagcaggtgtgaaccccaaaagtctgagacaggtctcagttgatttagaaagtttattttgccaaagttgagagcgcacacccgtgacacagcctcaggaggtcctgacaacatgtgcccaaggtggtcaaagcccagtttggttttatacattctagggagacgtgagacatcagtcaacatatgcaagatgaacattggtttggcctggaaaggcggaacaactcgaagcaaaggcgggaaggctcgaagtggggagggggcctccaggtcttagatagataagagacaaatggttctattcttttgagtttctgatgagcctctccaaaggaggcaatcagatacgcatttatctcagtgagcagaggggtgactttgaatagaatgggaggcaggttggccataagcagttcccagcttgacttttccctttagcttagtgatttggaggccccaagatttattttcctttcacacaggcatgaaaacgacatttatctcctcgtaagtctccatcagagctcttgagtgactaggttcattgtcaatgagcagtaatactttgaaaggaatcttttctttttgagcagcagatctccacagatcttctgtacaccatcctgtaaacagatgtgctatcttccaggtttgttgttccatttcaagagcacaggcagagtatatttagcataattcttacgggccctagattttcagaatggtaaattaccattggcttcagcttaaagtcatcagctgcattggtccctaataaaagtcagcttatcctttgaagctttgaagccagtcattggcttctctctatgaaagtcctagatggcatcttcttccaaaagaagggtgttttgtttacattgaaaaatctgttgtttagtatagccacctttatcaatgatcttagctaggtctcctggataacttactgtggcttctctctcagcacttgctgcttcaccttgtacttttatgttatagagatggcttctttccttaaacctcatgaaccaacttctgctagctttaaacttttcttctgcaccttcctcgcctctctcagccttcatagagttgaagagttagggccttgctctgtattaggctttggcctaaggaaatgttatagctggtttaatcttctatccagacccctaaaacattctccatatcagcagtaagtctgttttgctttcttatatgtgtgttcactggagtagcactcctgatttccttcaagaactgttctttgcattcacaatttggttaactgtttgtcacaggacacctagctttaggcccatctcagctttcgacatgccttactcactaagcttaattatttttatcttttgatttaaagcaagggatgtgtgacttttcctttcacttgaatacatagatgccattgtaaggttattaattggccaaatttcaatattgtgtctcggcaaatagggaggcctgagagggagagagataagagaatagctggtcagtgaacagttagaacacacaacatttatccgttagctccgtcaccttatataggcacagtttatggcacccgaaaacaatcacaatagtaacatcagaggtcacagatcgtcataacagatagaatgaaaataatgaaaagtttgaaatgttataagaattaccaaaacacagacatgaggcgaccacatgctgttagaaaaatggtgctgccgcatgttctcactcctaagtgggagttgaacaatgagaacacatggacacagtgaggggaacatcacacactggggcctgtcggggagtgggggctaggggagggatagcattaggagaaatacctaatgtagataacgggttgatgggtacagcaaaccaccatgtcacgtgtatacctgtgtaagaaacctgcacgttctgcacatgtatcctagaacttaaagtataataataataataaaaagaaacaaaaagtgcaggccaagcaggaaaaaaaaaaaacaaaccagaaaaatggtgctgatagtctcatcatggggtttccacagaccttcgatttgccaaaaaaaaaaaaaaaaaaaaaaaaaaatccatgaagtgcgataatgtgaagtacaataaaaggggatatgcctgtaattctttctgtgtcctttattgttttcctgcagttctgtttcagtgtacgattttgtttgcttcaaactgaagaagttcttttattgtttcttataatgttgatctactgatgagagattctctaagcttttgtctgaaaatctgtttcatcatttttttaaagaatactttctttgcatagagttttttagtttttcacaatggcagtttttttttttttttaaagtgagtgctttaaaaatgccattccatttttctttggctttcatatgttctcaaagagattgtcatttctcttagtcttacttgaaaaataatgattcttaccccacctttggcttttgttgttgttgttgttgttgtttgttttgtttttttaagacagagtctctctctctcacccaggctggagtgcagtggcacgatcacagcttactgttgcctccacctcccaggctcaagtgatcctcctgccttgcctcagcctcccaagtaggaggaccacaggcatgcgccatcacacttagctaattttttaaatttttcttagagacgggtctccctatgttgctctggctggtctcaaatgcccaggctcaagtgatcctcccaccttggcttcccaaagtgctggaaatacaggcatgagccaccacacctggccccctttggctggttttaagagtgtctttttatatttggttttcaactttttatatatggttattagctttctgtggctgctatcacaaattatcacaaacttggtggcttaaaacaacaaaaatttattttctcccactactggatttcagaagttcaaaatcagtttaactgggctgaaattaaggtgttagcaaggctacactccttccagaggctctaggagaggatctgttccatgcctcttccagcttcaggtggctgccagtatttcttggcttgtggctatatcattgtagtctctgcctccatgttcacattaccttctcctttgcatgtgtgtcaagcctccatctactttcctcctatagagacatttgtgatgtcatttagggctcacatggataatccaggatactctcttcatctcaagattcttgacataatcacatctgtaaagaccccttttccagataatatcacatatgtcacattcatagggattaggacacaggcatgtcttagggcaacatttaacaattgttctttataggtgaacttgttttaaacagatggtttgtcagtgttcagatgttgacctgagagtggtggaggaatctccattacaacctgttgaatcacacagctatgttcggatttattagtttcattcctcactgctttttctcatctacatcatctttctctttcttgaattatttattgtgaattagtctttgtttgtagtatatcctcacacattttcttcatatgagtttgtggatgataatcccttcaagaataaaagtgttattttggtctcatatttgaacaattttttgactggtgtagaattctagggttaagatcattttctctcaaaattctctgaatattgctgcatttcagtgcatgaagaatttaggcatctgagaagttcaacaactatacagtttacacgttttttatttgggccaagtttgaggactgcaacccaggagcatagattcaagttgctctgaatatatgttctaattagcagcagttacaagtaggtttttaaaggaaaaaaggagaggcagtatctaatttgtttaccaagaatttacattaaaatagcataagctattgattgctatacattgtcctttgtatcacaaattccaggaacatgaagataatggttgaggcagctagtcagcaacaaattgcctttaaacagttgccccccctgggcattgtgtggggggtgtgactgaagtccccatactcatgtcttctgggcctgataaattttatatacctcacatagctcaggctgctctgagctgtttttcttttctcatttcccccttttgatcaaaatttttctcttctgaaagcattgatgatcagcattttagatataagtttatcccatgtcactggggaggcttattcccagatattcttgtcccgtgttggatggaaagacgtaaaaaaggtaccatggcttaaagaacttagtgaggtctcaaggccaaattgattggcaacacagaggagcagagcaacaggatctcagtcaagccatccactcacgctggagccatggcatgaacaactatacagtttactcaagtccaccctcacttaatggcaccaactgcaagtttggggattccccaaaccaccctcagatttgatagttcattagaaggatttataatactctgtgagcactattatactcacagttatggtttattacaggcaaattatacatagtaagaccagccaagggaaaaagtacatagggtggagtttgggaagataccaaatgtagagcttttgttgtcctcttcccatggagtcaggacacgttgctctcttggcatcagtgtgtgacaaaatgtgcagagcattgcctaacaggaaagcttacccaagccttagtgttcagagtttttattggggtttcattatgtaggcattattgactgactgccctctggcttgatctcagtctccagctccacttggtgtgatccaaagcctcctaaatcacatagtcattttttctggagtgtcttttccccaccctaaatcacattgttactatctagattacagtctattagaaaaataaatcaaggctgtgcatggtagctcatacctataatcctaatacttatactttgggaggccaaagctgaaagatctctaaaatccagaagttcaagaccagcctaggcaacaaagtgagaccttatctctacaaaaccaaacaaaaaaaaaaaaaaaataggtgtgattgggtgcacctgtagtcctagctacttggggggctgaagatggagaattgcttgaacccaggaattcagagctgcagagagctatgatcacaccactgcattccaggctgggttacagaggggtgacctccatctcaaaaaaaaaaaaattttttttcttttaattcttttttattttttattttttttataaatatatatattttttattatactttaagttctagggtacatgtgcacaacgtgcaggtttgttacatatgtaaacatgtgccgtgttggtgtgctgcacccattaactcatcatttacattaggtatatctccaaatgctatcccttccccctcccaccaccccacaacaggccccggtgtgtgatgttccccttcctgtgtccaggtgttctcattgttcagttcccacctatgagtgagaacatgtggtgtttggttttttgtccttgcagtagtttgctgagaatgatggtttccagcttcatccatgtccctgcaaaggacatgaactcatccttttttacggctgcgtagtatttcatagtgtatacgtgccacattttctgaatccagtctatcattgttggacatttgggttggttccaggtctttgctattgtgaatagtgccacgataaacatacgtgtgcatgtgtcttgatagcagcatgatttataatcctttgggtatatacccagtaatgggatggctgggtcaaatggtatttctacttctagatccctgaggaatcgccacactgtctttcacagtggttgaactagtttacagtcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgccatcttttgagaagtgtctgttcatatccttcacccacttgttgatggggttgtttgtttcttttcttataaatttgtttgagttctttgtagaatctggatattagccctttgtcagatgagtagattgcaaaacttttctcccactctgtaggttgcctgttcactctgatggtagtttcttttgctgtgcagaagctccttaattagatcccatttgtcaattttggcttttgtttccattgtttttggtgttttagatatgaagtccatgcccatgcctatgtcctcaatggtattacctaggttttcttctagggtttttatggttttaggtctaacatttaagtctttaatccatcttgaattaattttagtataaggtgtaaggaagggatccagtttcagctttctccatatggctagccagttttcccagcaccatttgttaaatagggaatcctttccccatttcttctttttgtcaggtttgtcaaagatgacatggttgtagatgtgtggtattacttctgagggctctgttctgttccattggtctatatctctgttttggtaccagtaccatgctgttttggttactgtagccttgcagtatagtttgaagtcaggtagcatgatgcctacagttttgttcttttggcttaggattgacttggcaatgcaggctcttttttggctccacatgaactttaaagtagttttttccaattcagtgaagaaagtcattggtagcttgatagggatggcattgaatctataaattaccttgggcagtatggccattttcatgatattgattcttcctatccatgagcatggaatgttcttccatttgtttgtgtcctcttttatttcgctgaacagtagtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacgttgatttcgtatcaagactttgctggagttgcttatcagcttaaggagattttgggctgagataatggggttttctagatatacaatcatgtcatctgcaaacagggacaatttgatttcctcttttcataattgaataccctttatgtctttctcttgcctgattgccctggccagaacttccaacactatgttgaataggagtggtgagagagggcatccctatcttgtgccagttttcaaagggaatgcttccggtttttgcccattcagtatgatattggctgtgggtttgtcatagctcttattattttgaaatacgtcccatcaatacctaatttattgagagtttttagcatgaagggctgttgaattttgtcaaaggccttttctgcatctattgagatgatcgtgtgttttttgtctttggttctgtttatatgctggattacatttattgatttgtatatgttgaaccagccttgcatcccagggatgaagcccacttgatcatggtagataagctttttgatgtgctgctggattcgatttgccagtattttattgaagatttttgcgtcggtgttcattagggatattggtctaaaattctctttttgtgttgtgtctctgccaggcttaggtatcaggatgatgctggcctcataaaatgagttagggaggattccctcattttctattgataggaatagtttcagaaggaatggtgtcagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtcaaggaatttatccatttcttctagattttctagtttatttgtgtagaggtgtttgtagtattctctgatggtagtttgtatttctgtgggatcggtggtgatatccccttttatcattttttattgcgtctatttgattcttctctcttttcttctttattagtcttgctagcagtctatcaattttgttgatcttttcaaaaaaccagctcctggattcattgatttcttgaagggttttttgtgtctctatctcgttcagttctgctctgagttatttcttgccttctgctagcttttgaatgtgtttgctcttgttcctctagttcttttaattgtgatgttagggtgtcaattttatatctttcctgcttccttttgtgggcatttagtgctataaatttccctctacacactgctttaaatgtgtcccagagattctggtatgttgtgtctttgttctcattggtttcaaagaacatgtttatttctgcattcatttcgttatgtacccagtagtcattcaggagcaggttgttcagtctccatgtagctgagcagttttgagtgagtttcttaatcttgagttctaatttgatttcactgtggtctgagagacagtttgttataatttctgttcttttacatttgctgaggagtgctttacttccaactatgtggtcaattttggaataagtgcgatgtggtgctgagaagaatgtatattctgttgatttggggtggagagttctgtagatgtctgttaggtccgcttggtgcagagctgagttcaattcctggatatccttgttaactttctgtctcattgatctgtctaatgttgacagtggggtgttaaagtctccctttattattgtatgggagtctaagtctctttgtaggtctctaaggacttgctttatgaatctgggtcctcctgtattgggtgcataaatatttaggatagttagctcttcttgttgaattgatccctttaccattatgtaatggccttctttgtctcttttgatccttgctagtttaaagtctgttttatcagagactaggattgcaacccctgcctttttttgttttccatttgcttggtagatcttcctgcatccctttattttgagcctatgtgtgtctctgcacatgagatggatttcctgaatacagcacactgatgggtctttactctttatctaatttgccagtctgtgtcttttaattggagcatttagcccatttacatttaaggttgatactgttatgtgtgaatttgatcctgtcattatgatgctagctggttattttgctcgttagttgatgcagtttcttcctagccttgatggtctttacaatttggcatgtttttccagtggctggtatgtgttgttcctttccatgtttagtgcttccttcaggagctcttgtaaggcaggcctggtggtgacaaaatctctcagcatttgcttgtctgtaaaggattttatttttccttcacctatgaagcttagtttggctggatatgaaattctgggttgaaaattcttttctttaagaattttggatattggcccccactctcttctggcttgtagagtttctgccgagagatcagctgttagtctgatgggcttccctttgtgggtaacccgacctttctctctggctgcccttaacattttttccttcatttcaactttggtgatctgacaattatgtgtctcggagttgctcttctcgaggagtatctttgtggcgttctctgtatttcctgaatttgaatgttggcctgccttgctaggttggggaagttctcctggctaatatcctgcagagtgttttccaacttggttccattctccccatcactttcaggtacaccaatcagacgtagatttggtcttttcacatagtcccatatttcttggaggcttttttcgtttctttttattcttttttctctaaacttctcttctcgcttcatttcattcatttggtcttcaatcacggataccctttcttccagttgttcgaatcggctactgaagtttgtgcattcgtcacttagttctcgtgccatggttttcagctccatcaggtcatttaaggacttgtctacattggttattctagttagccattcatctaatctttttttcaaggtttttagcttctttgtgctgggttcaaacttcctcctttagctcagagaagtttgatcatctgaagccttcttttctcaactcgtcaaagtcattctctgtctacctttgttctgttgctggtgaggagctgcgttcctttggaggaggagaggcgctctgatttttagaattttcagtttttctgctgtttttttccctatctttgtggttttatctacctttggtctttgatgatggtgacatacagatggggtttttgtgtggatgtcctttctgtttgttagttttccttctaacagtcaggaccctcagctgcaggtctgttggagtttgtcggagggccactccagaccctgtttgcctgggtatcagcagcggaggctgcagaacagtgaatattgctgaacaccaaatgttgctctctgatcgttcctctggaggttttgtctcagaggggtacccgccgtgtgaggtgtcagtctgcctctactggggggtacctcccagttaggctgcttgggggtcagggacccacttgaggaggcagtctgtctgttctcagatctcaaactctgtcctgggagaaccactactctcttcaaagctgtcagacagggacatttaagtttgcagaggtttctgctgccttttgttcagctatgccctgcccccagaggtggagtctacagaggcaggcaggcctccttgagctgtggtgggctccacccagttcgagcttcccggcagctttgtttacctactcaagcctcagcaatggcgggcgcctctcctccagcctcgctgccaccttgcagttcaatctcagactgctgtgctagcaatgagtgaggctccgtgggtgtgggaccctctgagccaggcgcgggatataatctcctggtgtgctgtttgctaagaccgttggaaaagcgcagtattagggtgggagtgatccgattttccaggtgccatctgtcacagcttcccttggctaggaaagggaattccctgaccccttgtgcttcccgggtgaggcgatgtctcgccctgcttcggctcacgctcggtgggctgcacccactgtccaacaagccccagtgagatgaagccggtatctcagttggaaatgcagaaatcatccgtcttgtgcgttgctcacgctgggggctgtagactggagctgttcctatttggccatcttggaacaggaatcaaaggaaattttttaaaaatcccatttatgatagcatcaaaaagagtacaatagttaggaataaatttaaccaaggatgtaataatgtgcacactgaaaattataaaacattgatgaaagaaattcaagaagacacaaatcaatggaaagataccttatgtttatggattggaagaatcaatattattaaaatgttcatactgcctgaagcaatacacagattcaacacaatccctattgaaattccaatggcatttttcacagaatagaaaaaaaaattctaaaatgtggatgaaactagaagacattatattaagtgaaatatactagacacagatagataaatactgtatgatttcacttatatatggaatctaaaaaaaatgttcagttcataaaagcagagagtaaaacagtggttgacagtgggtgggagacctggagagatgttggtcaaagtgtatgaacttacagttgtaagatgaataagttctggataccggacatacagcatggcaactatagttaataataatgtattgaatatttgaaatatgctataagaatagatcttaagcattctcaccacatacccaaaaaagtaactatgtgaggtgatggatattttacttagcttgattgtggtaataatttcacaatgtgtacatttatcagaatatcacattgtataccttgaatatataccatttttatttgccaattatacttcaaggcagaaaaaaataaaattagagtagaaacaaaagcttggaggtctgaaatgttactaaaagtgtaacattttccttttttcaatattcttgccacatggtgggtaggtccttttagtctgaagattcaagtctgtcttatttgggggatattttcttcaattagtcccttgattattgatccttctcttttggctgtattctctcctgtgactgctaataggtgtgtaaatcagtaccaggcacataataagcacatgttaaatatctgttgatcgtataaattgatcctggatttgcttgatcagttttccgtgtatcttacatcttctttcatgatttacaacctagacattttgctgttttcagaacaaattttttgaattgttactgcagaagctgcttttgctcatttatgttctgcttttaaaaaattatgccattttattaaaatatagtttttggaatgttgtcatgttatctaattttttatgtcctctgatgactttgtttaaaattagttcaattatgtcttgtatctgaggatacttattagaaatttttttattactgttattctatcttgtttcccatattaactttgttccattaaggactgtttgtccccattgctttttttgtctcctcactttaactgctgtttcttctcaaaagttctagtcaatgcatatattctattcaacatatatatttagctctagatgtaatcagttttggtatgtgcctccaggtggcatcctgtgcagtcttcatgaagtgaaacccaaagactggtgcccctgtcagttgttctactgcagagactttgtggagtatgtggttggagatgaatctatggttaagggagtggattttttaaaaccaatatgtgaagtataatatacataaagtgcatcaactgtaagcatacaacttgttgtgttttcacaaagtaaacataccatgtagaaccaacacccagattaagaactagagcacgaacagtaccccagaagctcccttctcccttcttttagtcactactcttctccaaaggtggccactgtcctgatttctccacatagattaataaaacatagcaggggccgagagtggtggcacacacctatagtcccagctactcaggaggctgaggtgggaggatcgtttgagcccaggaggtcaaagctgcagtgagtcgtaattgtgccactgcactccagcttgggcgacagagcaagaccctgtctcaagataaataataaaatatagcaggtattctgtttatgtcaagtttctattgctcaaaatgatgtttgtgagattcatctgtggtaaattgtataaatgtagtagtagattgtgaattgtcattactgtattgtattccatgttatgactctcctgtaatttatgcattgcacagttgatgggcatttgggtggtttccagtttaaggtatgaaaagtagtgctgtccaaaacatttttttatatgtcttttggtgaatttgcatacatctgtgggaccataccagagtggattgctggattattagggagttttgttggttggttgtttgccattttgttttaaactccttgtgtcctggtgggaattgttcagtagatactgagaaattgatgatgcaaaagaaaatggatagcagaaggaatgaagttctatgggttttggccctcacaaaagtaaatacatatcttcctacagaaatcaaacaggtttttatggctcaaagccccggaattatacggggcagaataggcgaatgtgcttgcagtcagctggctttaaaagagcctttcttattggaagtatagagaggaaaattcttttccactagcgggaagaaccacttctggtgctcaacatcatgtgcattgctgcagtggagaagaaaaaagagggaagcgttttcattgggctcatactgcttatgataggcctggcagagtcttgcttttggcaactattgagtatgaatggccagtctctacttgtaaagagaggtcattggacttaaatggaattaatggaagtaaaatgttctcaggttgttactgcaaatcattcatgtagtcagtgccaggggttaaacaattctcgcctcttttctagtctgtcaccttcaaaactaccagcagaaatcttgctcgagccatgtgtatgaagaacctcaagctcactattatcatcatcatcgtatcaattgtaagtttttgtccttttagtgtatggctttatttttcaatctctaagaaattaggtactagaattatttctcaatgattaacactctgaaatgagctacatatgtcttttaatagtgaaacacatgaccaggcagtggctttcctatgaagtcactatgaaatatctctacttaaacccctccttcctattgagaattattatatattctcaataggaagagatctataaaactgacctcacagaaatgtagttattttaaataaagacatttctggtttatatgtaatgggtttattgtttttatttttaaattaattatgtatttttaaagttttaatttctaatatggcaaatgctgataattataatcccccttaaacaagaactctttggagtcctcagtaatttttgagtgtgtaaagaggtcctaaaccacaactttaaaaactattgctaacaggtggggggtgctttaccctgttcatggtcagataaagttgcctttcctccccatcctccagtcatgtccagaagcccaaagttacctccaagcagataactctgaccctgcttctcctctaccacagcttgagggtcctctgccttagacagctggatttatctaaaagagaagagcagtcatagatctgtagattttatactggaagtaattgtcatggccttgaatggttccttgctcaggtttctctttctaatatcacattttaggctcctgagcttagcttcttacttattatttggtctgggagtttaggttgatttgtgcagctgaattgttaaattcagaatatatttactgattacttattacatgcagagcacagctctaaatgcaatatcaatctttgcgaaaaggtgttgtcacctaacgagatgtacttcagcttgaaaaatccttatattacagctgtgacaaatagtcaactttacatcaagttggtaaactttacatttgtggcatgtgtatgtgtgagtatgtgtgtgtatgtgtgaatatgatgtcagaagttcaacctattcattaataaacagaatttgctgtaatctgccccccaaccctggcaatatttatagttccctacaaggcaaaatgctttgctcacttttggagcaaagggcatgcaattcatcaatgcatccttttccaagcttgcaaataatgaaatcagtcacttaaagatctcaaaaagttgtaatttaaagcaaaataaagccaggcataggggcttatgcctgtaatcccagcactttgggaagctgaggcaggaggattgcttgaggccaagagtttgaagccagcctggtcaacatagtgacaccctatctctacaaaaataaaaaataaaaaataaataaaataaagtgactaatgcagtgaacctaatgtttaaaatctattttttgtgatataataatgtgaacaagtagtgacttttataatataatttaaaattataatctagaattaaaaagcaaacacatctgtaatagcaccagtatttttgcagtgttacttacatcatctgcttttcattgttttggtcatcgtaattattgtgtcattatccactgaacagttcgtagcagtgttcttgctcataagtgatatagatgaaagccttctactcaggcttttaaaatatattcttatattaatcaaaaataaaattcatgtgcaaaacctaaaaatataattaatgaaaccatacttcaggagaattatggttatttgtgatttttttatgacttgttaatgacacatcagtatgagttgctcatttagccttgattctgccgagttaccagtgaagagcaacaaccccactgctttctctcccactgaaggaaacgctagagttcaagtgggtgtgagttataccaaaaacgacaatgttaactacacttctgtcttggaaaatacttgtttagtgtgttccattactacataactgctactctaatggaatcagaagtatttcttaataaggctctactttcctatatatattatttagaataatatgattgattcaagaaaataaaattgctctcctcgtccctccaggtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatga

SEQ ID NO: 4109 - DNA, 60612 bp, human
gttggcgaccctgcactgacccgcgtccctccgtcccgagcccgcgcgccctcagagggtgcccggacaggtaaatggagtggggtgcgcctgcgggaggcggggagagaactgcggagggagggcggaggtgtcgatggaaaggtgctggggtggagcgaggaggcagtgcaggggtgacttgggcttctctggtgtcgacagttccagttgtcgggcaggaccagttttggcgaggtgcgtcttatgccactggaaaggcctcgagttaaagagtgtcagaatgcgtcacttaagctgtcattacaggagggaaaaaatgttaactttctctcagtttgtattctacaagacctttctgtagcatttaaatctcttgagatcgccagagtcttctaaaaactctctacgtccttgttcgatgacgtcactttctgcttcaccttctacttctggctgtttatgctccttcgtgggttcctagccccttattcgcccttcctccactgctcagtattgacagtccccttcttcctctgttcagggactgtatttctgcctagacccgtttcctcagcttcagacctgtttggtgtttttattaatggccaatgtttatcaaattctgactgcgtactttggtaaatgctttacatctccgtctcccataactctcacaaccaaccaactgtcttcatttggcctcattaattgctttcaactacctgtatctccattatccctcccttgatcccagaggatacagtcatgtttaggatattaattccctttgaatacctgtggctgagagcagatccattcatacatttaacaaatatttattgaacggctggtatatgcttgacactcttttaagtgcaggggatacagctgtaaacaagacttaggaggttgctactctcaggaacttacatgtttgtgtctagaggggaaaacaggaataatcaggattatgttatatattggttaatgcaaaataaaacaggtggttgacttgaaaggatgggatcctatcctaagaaagtcagaggtcagggcatcgtccagaaagaatagttgtaataccaacaggaataatcttgatctgtaacatgacttttcgtaaacacctcttcttttcccctgtctaagcagtgtttattcttcattcttctatctcctccaaggttattgcatcagaattcatggtttatctgtagttggtttattccttctaagacccagagagaagagtgggggattggattactattagctcaactgctttatcttacttagaaagatagtttggttgtgaaaatattattcttaccaggtccttctgaatataaagttatctaccatttatagtatattttaaaaccaaaatatgctcaatgttcactcatttattcaacagatatttgagggaatattagatggtaggcactgtgctgagcactgggaaaatagggtaaaatagacactttgacctctcttccaaggagaaataatcctaacagtatactgaggaaatttctaaggcataggctgacacctgcattcctgttcttcatccgaggtgagatcatcacaaaacattaagacatttcctgagcaattgcggacattcttagattattcacttattatactttattgcatttatttatatctgtcttccccattgttctatggctccctcaagtataggagtcccttcttccttaactttatacctctagtgtctactttgactgtcatatagtaacccaccagtatatacgtgttgaactgaaatagactccctatttgatcaaatttaaatgacatgatttatacaaggccttctttatgtaaggccatcagccgtattcctcaaccttctcattcaccaaaggtggaccattccatcttatcaggctagcttatgtaccttctttaccttgctctcagtgccttctcttcttccatccatccctcctaaaaggatctcccatctcttcccaagcaccttgtgtacctccctccattaatttggtgggccagttaatttaataatctgctcatgatacaggggtggaaaaaaattaatttcctttttatatttcctatgaaacattctgccaatgaactcttgcaagaattaatgtaatagatcctactgcaataatataatgatacagaatactttttaaagattttgcattgactatcaccatgtgctatgtaatgagttaattctactactttatttgaacagttgtataacctctgttcacacagcatgttttggtatcatttggtttctacttggtagaaacacatctttttttttttttttttttttgagacggagtctcactccgttgcctgggctggagtgcagcggcgcgatctcggctcactgcaacctccgcctcccaggttcaagcaattctcctgcctcagccccctgagtagctgggattacaggtgcacaccaccacgcctgactaatttttttttgtatttttagtagagacgggatttcaccatttttggtcaggctggtctcgaactcctgacctcaggtgatccacctcggcctcccaaagtgctgggattacaggcatgagccaccatgcccggccaagaaacacatctttgagtattactttctcagcctgaggtaatttaagtggtaatgttattctgccacattgtcattttcaggatgtcagataaaagcctcaagtattaaaattaaacttttttttttcttttgagacagagttttgctcttgttacccaggctggagtgcaatggcatgatcttggctcacctcagcctccacttcccgggttcaagcgattctcctgcctcagcctcccaagtagctggaattacaggcgtgcgccaccacgcctggctaattttgtatttttagtagaaacggggtttctccatgttggtcaggctggtctcgaactcctgaccttgggtgatccgcccgcctcagcctcccaaagtgctgggattacaggcatgaaccactgcgcccagccaaaattaaagtcttattccatgcaggtatctttcaattgtaaatcattactgcaaaagacaaattttgtctttataactgattaaaaacaacagcagtacaagagtgcttgagtcatgactgtcgtgaatttaggatgtgccaacctaagatcagccagatacttctaagatgtaaacattaagcattgttattttaggtgatttattgacacctatttctttatagacaggaatgcaagtgcagcactgaattgtgtgccattgctcgtttataagatacacatgtagatgatccagaatattcttatacatttttcagtgttatcaaaatacaaatgcagaattaaaagatttctcaaaacacatggacttggcctttccccttactcagttacctgaaactgtcttcagcctctacttgaagatgcttctgctgaggaggagcattttcatcattgctgttctatgttattaccaaattttttaatacaggcaatttcttacttacaaatggatatattctaaaagtactgttgtaagcttattgtttggaacgctggatgcatttccttctataaataatgctatccatgacatttacactgttatgccaaccagtatcattttattaacttttaatttagtggactcgaagaccttccccacaatttacaataattcctctattaaaaaactgcatttataattctcatttgaattcccttatagcatatctttttttagaaacccaacaactagaacaaaaatatcctttctttagtcccttaacatagtaaaaacaggcttttctaactccaaactgttgtgggtgacccttctagcccttagctctaaggacagtcctccaatatgagcaaggaaaacgaagggacagaggttttagagagggaggcaagttgggtgatatgagtatctggaaagggaagggtaggatttatttgggatgaacagtgagtttctaaaatggaagtttgcattgcttgtcagccttttggctaagatcaggtgtagtatcagtttaaaatgggggtttgttgtgggttgaattgtgtcctccagaaagctgtgttgaagtcctaacccgtggtacctgtgaatgggatcttatttagaaataggatctttgcagatgtaattaagatgtaattgaaaatggggtcatactggagtagagtgggccctttatccaatatgactggcatccatataaaagaagagagacagagagaatgcagtgtgaagacacagatacagagaacaccatgtgactacagaggtaaagattgaagtgctgcacctccaagccaaggaacaccaaggattgccaccaaactatcagaagctagaaagagataaggaaagattctcttctacaggtttcagagggagcataaccctgccaacatcttgattttggacttttaaccctcagaactggtaggcgatacatttctgttgttttaagcaaccaagtttttggtactttattactgcagctacaagaaactaatacaggattcttagcaggaataaagtagaattgggatggtggctgtgggaccaagtggggagtgaataggagaacaaagaggaacagtgttgatatggggctttcctttatgttgcattatctttttttcttcccttctctctctggcttatcttttcattctttttcttcttggatcttatctttatatagcactttatggtttattaggcatttacatactgctaataattagcagagccaggttttctaacttcaagtgcagtgttcattgtgccacaattgtttctgttatcccaatactcatcaagacgttatggattctattacaagacacttacaatgggggcaggtaagacttcataggtgggatttttagcagtatagcagagaggaaggaattcctattagtgacatctggaaggaaagtaaagtttctgttgctatgtacccactgtttaacagtcatttttaagttggggactgcttttattggaagaaacactacttgcgtataacttatattcattgttcctagttatattctgaataatgtgctccctgttccaggtgactgtactttatataaactcaaaaactattgtcatgttccctctaagtcctctctttctcatgttacatatctctagttcctccagccagtcttcagatgacacaatctccatgtctctcacccatattgtattgcctcccttttgtctagtcgttaaatattctacccagaattgaattcagtattttacatatgttctaaccagcacagagtgtaatgggactagtacttaaacaggtcaagacaccctatttcttaatgtactttgagattatgtaagcatttttaagcaatatcgcataccgttggttcataatgaacttacagtccactgaaacactagatctttttgtattaattgttgccaaggtcaagtttccttctgaacctgcacagggactgaggctgctgctactttttcatctctctgttccagggaccatatgatttcttatctctgtttctctttgtgtttttgttcctctctactgtgtctctttgaccctaagcaatgacctccttccttgttataaaatttcactgattgttttacagtcttcattctctttctttcctttcggcttctgggccaccacacttttggctttcccatttggtcctcctcagtctttgtgagtctctatttatctacctttccctcaactgttggttgtgctttgggttttatctttggcactattttttttttctgtatgcaatatatcttcagcaaataaatcatgtttaaaatggcagatctaactgagctcatctgggaataaaagggcacagaatcagtcccggaggaaagtcgacatttagaggtcaggtagaggaggaagagtcagcaagaagacaaaaagagcagccagagatgtaggagcatttcaagaaggagggtcggtcagcagtgttgactgtgcctaagaggtcaagtaaggtaagaatagagaagcaaccactgtattttgcaatatagaggctgttggtgaccttaggaagcatggttttctggagttttaagggcaaaagctggattatagtaagtagaagagttgaaaggaggcagaggagcagagataatgcgtaacgatgctttgaagaaacagaacagggccaggtacggtggctcatgcctgtaatcccagcactttgggaggccaaggcaggtggatcacttgagcccgggagttcaagaccagcctgggtgacatggtgaaaccctgtctgtacaaaaaaaaatacaaaaatagccggacatggtggcacacacctgtagtcccagatactccagaggctgaggtaggaggatcacttgagcctgataagtggaggctgtagtgagccaagattgtgccactgcactctagcctggagcttgggtgacagagcaagaccctgtctcaaaaaaaaaaaaaaaagaaaagaaacagaacagtaggatccacagttagggaggctttaggatcaagggagataaagtataagacagcaatttggaaactataacttactgcatatgtgtaaggagaattctagaaagaagatggttgagatcacaaccctggggaacaacttcagttagagagtaggaatgaaaaagagatccccaaaaggcattcagcccaagagacagatgagcaccttctgctctgtgtgctgtccttccatgctgggattgcaataaggaatctgcacattccttgatctcaaacagtttatagtttgctgttgtgtttcacaaagtatgtttgtgtgaatcacctgcatccagacagacttgtattaaatacagattccagggccctacctcaggcctacggaatcagaatttcaggaagtgatgccaagagtttgaatttttagcaaatgactcatactctgccacacaagatgattcgtattcccactacagtttgagaaccactggtatgttgggtactgagcatgttaacaaataagagtaggtttaacagttaatcgaagactagacaaggatttgttcatctctttttatgtttatgccattaaataagagaagctgggcttgttaggtgggaaataatagcacatattcataggcagacataaggaaaataatcttaaactcatgccatatggttttagtaatgttttgtttatgaagggtcttaccattcctttcttgtggaagctttgagttattttcactttgtttctgttatggataatgcctttatactggcagtgtacagtaaaaggctaagattatgagctctagaaccatactgcctaggtttaaattgcagctccacacttactagctctgtaatttgggggaaattatttaagtcatctgtgcttcagttttctcatctataatagaagtatcataatagtgtataatctcattgagttgtgaggattaaatggattaataattataaagtatttaaaatggtacctggcacatagtaaacaataaatataggctatttttattgttaatagttatctttgtgaatctagagtcttaacttctgttgaactatttctctaggataaattttcaggatggaatttctacattaaagaatgaagacatctttatgtccctttgctatctatagtcattgcttttcaaaagggtgatatctgtttgtgctataataatttgtaaatgcaagctatcaatggtgtgtgtgtgtgtgtatgtgttttgtatgtctctttatatgaatgcatacaagcatggcttaggttgtaagtttgtagaaaactttgaccttctttttaagcctgctcttaagtctgttgttaagtttcatgttatagtgcctcgttagatactatctccaggtagtatgttgataaatgatagtaagttacctttgaaagattatgtcaaagaaatattctaaatctgtgtctttttccttttgatagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaagtgagttctgttctgcatgtggtaagggatgaaagaagggaattctgttactctaatcagaacggtagaaaagtagaaaacaagcttctaggtacataatttgaataagctgacagaatagtaaccttcaccaacttagaaaatatatctggttttgttacttataaatttaacttgtaattattttattctattattgaagtgatattttattttgaagaaagatgaaatgttaaatgtaaaaatgactttgctctagagctgtgtgatatgtgaaaataattcagataagatagataatgttcctttgttcattctttcagtaaatatttactgagcacttaactattgccaggcactttgcttggtgctggggatataacaagatatgtggtatttgccctcataagggttatagtttaatgagggagaaagtcaaatccacgatgtcaagggttggggggatgggaagtagtagataggagaatggtattccaagtagaaggaacagcaggtagagaagtatggaggcatgagatcatagggcgggcatatttagggaactgcagactgttctctgtgactggtgcccaggatggtgaaaataaagctagagagatgggtagaagaaaagtcatgtagggccttgtaggccatattaagagcttggactttaccttgtgggcagtggaaaggcattgaaggttttcagccagggtgtgacagagtcaggtttgttttatttatttatttatttatttatttagaaacagagtctcactctgtcacccaggctggagtgcagtggtgcgatcttggctcactgcaacctccatctcccaggttcagatgattctcgtgccttagcctcctgagtagctgggattacaggcgtgcaccaccatgcccagctaatttttgtatttttagtagagttggggtttcaccatgttggccaggcttgtctcaagctcctgacctcaggtgattcgcctgccttggcctcccaaagcgttgggattacaggcgtgagccactgcccctggcccttcagtcagtttttgctttagaaagatcactctggtggcttattagagtggccatagttgggaaatcttagtaattagttttaaaaagtgcctcaaccttccccgttggcacttaaaaatcttttcttacttaacccagccttacttccttagttcttatctcagaatgaggtccttattactttctatggctaaccccttatacagtttaaggtgtactctaagctactatgagagagacccccaagatacagtattaattttaatgagatagtccagagatgagtggtttgggatgttggggtggctctgccatttccaattccctaattcccaaagcaattagtgctttccacttctggccaaggcagctcctttggtgcttgttatatcccagtgcttgcccagtaattttaaaggcagggcccagaagtggcctgatattgttgagaagcttccacttacatcttactgttcactacacagtcatgtagctagcatagctagaagggaggccaggaattgtcatctctggctatgtagtcgtaggctcaactaaaactctgttactctggaggaagttataggatatcaggggatgacttgcagtcttccagtctactctcctggccacccagatatttcagtgaacctttcttcccaaacatagaatacgcctcttctctgagagaggtagctccaaagacctatctagtcactgtgtttggctccaagtccagcatgtctaggtggtacacagtcctatccatcaggccctggtgtggctcctgtggtccactgaccataaagtaaaagataagtcatatgttttccctgctttcccagcctaacccagtagacaatggtgaaataagaaaaggatcatcacagtgagagttacaaactcccatttggaaaagggaagaatgagaaacatgtagaagtcattgctttccagtaatgatcaaataattgcctcacacaatttcaaagactccctattctgaccaggaagtggttagtggttctgctttcttggaggaactccctcaccctttttccctgactcctggctttgttctccaggaagtttttcctttctggccacatccaaaatggtagttagagagtatatcatctttgggaattgtacccattttgtagtcctcttgctgccagcgtaggtttgtgggcctagaggttaggggttaaataatcttagcttcttatgattttggctttatactttctctaaaaatgtattagacttacagtctttgtgtttctaggcagttcctgggaaaatgtccagggaaagcacatgtagtcgtccttttagaggcaagactgggaaatagggcatatatcttccactcatgtattatgagccagaatttagtcacagccatatgtagctttaagagagtatagaatatgtaatccaattaaaatgcagttatagtagaaggagatgttatctgtctgccatgcctctctgcctgtgtctctgatctagctgtgttatttcgagctttggtacctttttttcatgcttttgttatcttctaggaatgctgttctccccctaagcctccttgtaaacttttgctcactttacaggtcccaagcgaaatactttcttaatttgtactttaatgcttctaaaagggcagttctgatcatattccttccttcaacagatactgtctgccctcaaggtaaaattccttaacgggacttggaatattcttcaagatctgccactttttccttctgtgggctcatcttttactactttagtcctcagttttgctttccagccatacttcatacttagccatttacaattcaatgctaggttctttctctcttcctagcctttgcaatagctgttaccttttactggaatatatttatctacttaattttttaaaaatctcactttgtgtgcctgagcttagatgtttccttttccagaaacccctgaacattaacactgagtcaggcaccgcaatcagacactctttttatgtgtctacatagcatctagtttgttcatattgtaacacttttcacactgtattattattattattattattattattgagacgaagtttcgcttttgttgcccaggctggagtgcaatggcgcaatctcagctcaccgcaacctccacttcctgggttcaagtgattatcctgcctcagcctcccgagtaactgggatgacaggcgtgtgccaccacgcctggctaatttttgtatttttagtagagatggggtttcaccatgttggccaggcaggtctcgaactcctgacctcaggcaatccgcccgcctcggcctcccaaagtgctgggattacaggcatgagccaccgtgcctggcctcagactgtattataattgaaatgattgtttatttctgtaccctgactgtaggcttcttgatggcagggatcataccttgttaccttttgtggcctgtgcaccaagtgacttacaagtctggtttaggagaaacaaattttatggggaaagtgatgactttcattctgggcatgtcatgtttaagctgtctatggtatgtccagttggatatgtctagtagacagtagtgtaggtagtcctggagctcaggagataggtcagatggagatttgggaatcattggcataattgtggtagctgaaaacaaactacaacaaaacatgagagtgcatgctgccctccagggagtaagtaagtgtgaaaaaagcaggaggctaaggaagctagaaaacgttagtgtagagggaaagggactatgatataaaccaggtatattagcctgcttgggctgctataacaaaataccatagactgagtggcttgaacaacagatacttgtttctcacagttctggagactgcgtgaggtgcccgctaattcagttcttgatgagggccttcttcctggctggcagatggccaccttcttgctgtgttctcaggtggtggaaagagagtgatctttttcttcctcttttttaaagccactaatcccatcacgaggaccccaccctcatgacctcatctaatcttaagtgcctcccaaaggccttgtctccaaatatagtcacactgtaacatatgaattttgaaaggacacagttcagtctatagcaccaggcaagcctgatgtcaagaaatctagtgaagataaaacactttccaaaaggaagtggtcaacactatcatatgtttcagagagagccactggatatggcaatgtggaagtcattggtggaaatggtgcaaatagttttagagtattggaggaaaagattttgcctgagttcctgtatctccttgtaattcatgtcagtcctctgtgaacattaatataattcaacaggtacccctatctatccacttgcccaaggtacaaatgtgggaggcaaaatttagttaacctgtctcacgccagtcaccaagttctataaatgctgcctcctatctcttctctgtccctttttctttattacccattctactttagtttatttccctcctcatttcttacccggtatactgcagtagtctcctgtctggtcctcctttgagtcagttttccgcactctagccaatgtgtcctttgttttttttttttttttttttttaatgtgtcctttttaaagtgcaaatctgatcacaccctccctaggctaaaacttttggatgtttattcattattcttaggataatgcacagtgtggtttataaagtcttgtataacctggtttttgcttacttctccagtcttgtctgtccagataattcactttttcttcacattctgtactctagtcatgtgagccaattttactttcctaaatctattaggtgctgttttacctctaggcccttatgcttgctgcttcctctctggaaaaactctttgctcacttttttttgttgttgttgttttttgaaacaaggtctcactttgttacccaggctggagtgcagtggcgcaatctcagcttactacagcctcaacctcctgggttccagcgatcctcctgcctcagcctcccaagtagctgggactataggcgtgtgccaccacacctggctaatttttgtattttgtgtacagacggggttttgccatgttgcccaggctggtcttgaactcctgagctcaagcgatctgcccgcctcagcctcccaaagtgctaggattacaggcatgagccagccaccacgcctggcctttcgctcactctttaccttgccatctgttacttattcttcaggtcttaaatcagacatcacttgttctgggaagtctttctggttaccctttggcaaatctccatttcgtgcctcatctattaatgtgtccccagagcaccatgtactgcctttaactttcctgtcatcctgtttgccatgctgcactgtaattccttacactgtgatccctatgaagactgggacttggtggttttgcttttttgtatcctcagcatccagcacagtaactaactcaaagtggatactcaaatgttgagaatttggtagaaaagatgtttgctttaagaacttaggaaaaagcaaagaaaaccatatggcctattgggggttaatcttaattacatcctcctcctaagatgtcatctcttgttcatgctttaagagtccaattatgcttttgcagctatcgttctaatgggtaatacacatgctgttgtgctatgtagctagaatagagatctttttatttcttatgtacttctatcagtttgacttgaaagaaacaggtatattgggaaggggaagagggagaagagactgtatccgtaagtaatatggtgacattggcagtactgaacgtgcttatacatagatagaagatagaagtaaaagtgatgttgcttataaccacagtaagttttatatcttttattctacagttatttgtttcattacatctgccaagacaggattgtatatctttgtatcactgatgatgtaagtaacttgaagacatattgctatttaactatgtgtactgttaatacagccagttcttaattatctataccaggggtccccaacccccagggctgcagaccggtacaggtctgtggcttgttaggaaccaggccacatagcaggaggtgagtggcctatgagcattaccacctgagttctgcctcctgtcagatcagcagcagcattagattctcatatgagtgtgaaccctgttgtgaactctgcatccgagggatctaaattgcatgctccttaggagaatctaatgcctgatgatctgaggtggaacagtttaatcccgaaaccattcaccctcccccagtccttggaaaaattgtcttctacaaaaccggtccctggtgccaaaaaggttggggactgctgatctgtacctatagtgggcaaacgtgatgcgaactttacatagctggaattgttaatattttgcatttgtcatatagagcagcaaatgttaagaaaacttgatactggggtatgtgcaaatcaactcaattttggtagagttttagcttagcctcttgcaacttctatatttattctattttgtagtgagaattgatgttcataattataattctttgatatcaaaacctctcaaaaattgtttacgtggaatgttaaattagatagcatcatttcttctatcagtagttaatgaatcctttaatgtatgtgaactttggaaaaacaaaattacaatacattatgatcagctatataaacctgtagtttacattggttaggtatgactgtttgtcggctctcagcccaaaattctcagtaacttaatgatgtcattaaggtcctttctcttctctgcttatctccgtgtctccttcttcccagacaggttgccattatggtttcgtagagctacatacttatttattcatgtccggagtagagggactgtgtcttcttgagtgtcttattgtaggaatgaggaagcttttcccagctgcatgccctcccctccccctgctttcaaagtgaacttcctttcatgtcttattggctgcatgctcatttctaaactgcctactggcaaagagacttggaattggcatggttgccatagatcagggttcctaatctttattgtatcacagactcgtcacttgtgggacactcccagaatgtttttgttttctttttttaattttccttttccagaatgcttttaaatgtataaaacacacacaattctaacaaagccaattatattgaaatatatatatatatagtattcaaaatattttaaaaacttgatgtagtaatatatatgcttctttatgaactcattaacaagatctagtcataggtctaataactaatagtcttgatgtgatgggtgttgacagtattttgagatatctgtaactgtgatggtatacaaaaaaagatttctgttggtgacagttacaggtactgtttaatactaccccgattatgaatatacaacctatattcacaattgaaatataagttaacgattgataaaaataatgatgtgattttctttttttctatccaagttcaaaggccccttgaatttggaccattgaccccaatttaagaacccttggcttagactaagcatcttgggtgaaagggaaatgactgtcaaccatagtgatcatcacaatgatttttatctctggcttcacaatattttccaaaagtacgaaaaaatctagctatatgtgaaatgactgatgtgaaacagcttggaatagaaggaaaatactaatgaaatctgggatagttagagtcgagcctcatatttcttgagctataatttgatacacacatatacatgtatacataaacacacatacacacattcatttttttcctctaaggtattcttacagagaacacacatactttttggctggctgggattagacatgagtatgtcacttgatcttttcaaatataccaccactattgaaaaaattcgatttgaagttaatatcagtagtagtatctgtatgtgtgaaagactctatgattattatgggatttattaaacatattcttgtgctgggccttctaatagatcttatgaaatatatggaggaagtaaaattcaattcctgatgtcaagaagttgataacctaggtatcattatcttcagttgtcaatgaccagatatatctggattcattctcagctctttcatttactagttgttggacctttggacaagttagttactttttcagagccttcctttacttatctttaagataggatcaatgctagttcctcctcagataatcattgctcagtaaatgttagctgttttttattgttgttcttaatcactcacatcatctttgtttactttctaaatgtgagttctgtgttgatctcttttcaggattttgaacgttcccgagcctttaattttctgaatgagataaagaagaggttccagactacttacggttcaagagcacagacagcacttccatatgccatgaatagcgagttctcaagtgtcttagctgcacagctggtaagatctttctcaggataaggtattttgatttatatcttcttcattaccttcaaacactatgaatctagggggccctgacctgcaatatagttttctgattgtgttactgtaagccaacataataaaacttccctgattaaaaaaaaaatgtaaaggggccattttagggtagaaaacagtgatagtctttattatctctattaatagtggtcacagtgtctcatgattggaagagcattaaagatcatctagttgaactacccatctgatgcttaaatgtgttcagcatgccaaatgatcttttaaactatacgtaaaccttctacccttccatgagggaaatttaattttctaacaacccaaattaataatttgaaactctcctcatctgtatgaatccctaattgtcagcttagtgaggttttacatgtgaatatacctgtgaaataccactgtacttaagacagcattttaatcaccctaaaagttccctcatatcccttaccagttggtcccctcccctacactttgccccaggcaaccacggatctgttttctatcactataaattagttttgtctttcatagaactttctgtaaatagaatcatacagtatgtaaactttctgtaaatggaatcatacagtatgtacttttttgtgtcttgcttgtttcagtcagtgtaaggctcttgatattcttccatgttgtataaatcagtagtttgttcccctttttgctaagtagtagtatatgcatataccacaatttgtttatccatccacctgttgctggatatttgggttgcttccagttttcagctatcatgaataaagctgctgttaacctccatgtataagtctttgtgtggacatatgtttttatttctctctgataaatacctaggaatggaattgctgggtcatatggtaggtgatgtgtaattgaaaaaaaaaaatcaccacttttttttccaaagtggttgtaccattttatattctcaccagcagttccagtgtctctgcgtccttgccagtacttgatgtggtcttaagttttgccattccagttgatgtgtaatggtatctcattgtggttttaatttatgttttcatgatgtcagacacctttcgaaatgcttcccttttatccatgaaactatttgagtataaagacgtaagctctagctatgattttgttgtgagtttaaaaaaaagctgtattgtaatggaatactttcacttctcctgtggttttaatactctgagtattacatttctaaattttatgcacacacacacacacgcacacacatactcttctggcaataaagtccctttaaattggttacttataaacctttattattcaagcagttggtttgtttcatactccccactaggaaatgttcatctgtgtaaaactgtgtaaaacactacccacaacaaaaataccagtacttagtcaaaagtaaagggtcagctagaaacaaaactttcaaattaaccaatttgtcattagctctagatctgtgtgaccttctgaacaaaatctctacctgttcctttgtctgtaaatagagataatagcatcgtttcatagagttttggggtggattaaataatatcccgtttgaagcacttaacacaatgaaatgactggaacattgtgtattaagcaccccataattgctagctatggataaataatttcaaactatatattatcagtgtcttagattctagatcctgtgagaagccaataaaaatagtttatatgctgtgatcctggcagatacaagaacagattctgagaagctgggccagcccctacctcatcatactcaagaagtggggaacaattttgcagcattctttcccccactgccccaactacagtcttctttttctcctttcttccttgtctgagcacagattatatatcccccccaatctctgccccacaagtcacatgtatatttgatataatgtttatttttattttatttaaaataaggtaatttttagactacatacttatagtttgtatagaagcattttttatgctgcccatattttttcctgggtattgtaacatttttccagtgaagtgacatgtatcttttatatcaatagagacataattttatagcattcctcagtgtaaattgtcattccccttatttttgttttcctattgtaaataatgtctaggtaccataagttaaaacttattttcttatagaagcatcactctgagaataagggcctagacaaagtgatggagactcaagcccaagtggatgaactgaaaggaatcatggtcagaaacataggtatgtttcatggcatagtttcatgcatgtgggcaaaaatgataaagattacttgactggggtcaaattattctagagaagccaaaatagcacttccttattcttaccattggaagttaattgtcagctgagacaactgtgatactgtctgcttgtgcaaatggtttcttctttgtccttgcaactattcttcattctaaatttactagtttgcttaacaagactaatttctaagaaccttatgataattcagcagtttagaataatttggtcagtgtgattgtacagtatttcactgagttaatgtatcacgggttacctaaccttgcctgaattttggacgcataggttctttagcacagtgttagagtgctgttttgcaaccagataaggagcttgctgaagaatgtcaatcaatattgtgcttccttcactgaggccctcttgctatgaaaatgtcaattggactgaacagtatgcttagagacttagtcaaccagttgcaaatactcttaagtaggactgatttagaagtttatcctacagtagtaaccatactgttatatttttgtgcctattatgtttttcttattttcttgagattaattatcaggaatgggattaataatcaaaatgcgcaaacgttttcgtggttcttgatatgtacgtcttggctatttaaagtgatttcctttaattgattttagttttaattatatatctagatagagactagagaatctgttgagacaactactatttatttttattcttttttttgtcaccaaatgtatttattttgcccgaaagtggaggcagacaattgctacaatattatttattgcagatgcataaagtttccagaaaaatcaacgtttttaatcgactccttttaaatgacttatttatttttagagttatagaaacagcaaatttaatccatcttgaattaatttttgtataaggtataaggaagggatccagtttcagctttctacatatggctagccagttttcccagcaccatttattaaatagggaatcctttccccattgcttgtttttcttaggtttgtcaaagatcagatggttgtagatatgtggcgttatttctgagggctctgttctgttccattgatctatatctctgttttggtaccagtaccatgctgttttggttactatagccttgtagtatagtttgaagtcaggtagcatgatgcctccagctttgttcttttggcataggatggacttggtgatgcgggctcttttttggttccatatgaactttaaagtagtttcttccaattctgtgaagaaagtcattggtagcttgatggggatggcattgaatctataaattaccttgggcagtatggccattttcatgatattgattcttcctacccatgaacatggaatgttcttccatttctttgtatcctcttttatttcactgagcagtggtttgtagttctccttgaagtggtccttcacatcccttgtaagttggattcctaggtattttattctctttgaagcaactgtgaatgggagttcactcatgatttgactctctgtccgttattggtgtataagaatgcttgtgatttttgtacattgattttgtatcctgagactttgctgaagttgcttatcagcttaaggggattttgggctgagacaatggggttttctagatatacaatcatgtcatctgcaaatagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttccgtttatatgctggattacatttattgatttgcgtatactgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgattgtagtttgtatttctgtgggatcggtggtgatatcccctttatcatttagacctaaaaccataaaaaccgtagaagaaaacctaggcattaccattcaggacataggcatgggcaaggacttcatgtctaaaacaccaaaagcaatggcaacaaaagccaaaattgacaaatgcgatctaattaaactaaagagcttctgcacagcaaaagaaactactatcagagtgaacagacaacctacaaaataggagaaaattttcacaacctactcatctgacaaagagctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgtgataccatctcacaccagttagaatggcagtcattaaaaagtcaggaaacaacagttactggagaggatgtggagaaataggaacacttttacacagttggtcggactgtaaactagttcaacccttgtggaagtcagtgtggcgattcctcagggatctagaactagaaataccatttgacccagccatcccattactgggtatatacccaaggactataaatcatgccgctataaagacacatgcacacgtatgtttatagcggcagtattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcctcattctcagtaaactatcgcaagaacaaaaaaccaaacaccgcatgttctcactcataggtgagaattgaacaatgagaacacatggacacaggaaggggaacatcacactctggggactgttgtggggtggggggagggggaaggatagctttaggagatatacctaatgctaaatgacgagttaatgggtgcagcacaccagcatggcacatgtatacatatgtaacaaacctgcacattgtgcacatgtaccctaaaacttaaagtataataataataaaataaaataaaaaaagcaaatttaaaatgtgacaagaacattcctagttaattccctttcatttttttaacagcttaattgaaatataattcacatatcatataattcacccatttaaagtatacagtcagtggttactatattcacagaattgtacaaccattgctgcgatcaattttgtaacatttttatcatccctaaatgaagccctgtactcatttgcagttgctcctcaactctcagacctaagcaacaattaattcccttttcttcttcataaatttgcctattctggacatttcgtataaatggaatcttgtaatatgtggccttttgtgtcttcgttcacttagcgtaatgattgtgagattcattcatgtcgtagcataaatcaatacttaattcttttttatgactaataattccaatgcattaatgcattttatgtatctactcattagttcatggtctggttattataaataatgctgctatgaacatttgtgtacaagtttttgtgtgagcatatatatatattatatattatatatatatatatatgtttttggttctcttgcttacatacctaggaatagaattgctggatcacatggcaactttgtaacattttgaagaagggccaaactttcctaaagtgactgcacctttatacattcctaatagcaatgtatgaggattctgattcctccacatccttgccaaaacttatcttttttgattatacccagtctagtgaaatggtactttattgtgattttgatttgcatttccctgatgactaatgatgttgagcattttttcatgtgcttataggccattcgtatattttctttacctttggagaaatgtctatttaaaaatactttattgtttttaagtgggttatttgtctttttatggttgagctataacagtactttatatattctggatactagacccttatcagatacatgattttcaaatattttgctctattctgtgagttgtcttttcattttcttgatggtgttctttgaagcacaacagtttttatgaagtccaatttatttttttctttagtttgtgctttgaataacatatctaagaaactgtcgcctaagccaagatcatgaagatttactactttgttttcttctaagactagttttagctcttacatttctatctatgatctattttgagttaatgtttatgtatggaataaagaagagatccaacttaattctgttgaatatgtatatacagttgttccagaaccatttgctgaaaaggcttttctttccctgttgaatgatcttagcattcttatcaaaaattagttatcaatggatgtatagctttgtttctggaccttcagttctgttcagtttatctttatgccagtaccaggctgtcatgattattatagctttgtagtaggttttaaaatcaggaaatattcatcttccaactttattctttctcaaaattgctttgactattctgggtacctttcattttcatgaactttaggatgagcttgtcaatttcagatagcaaaaaaagctatctgggattttgatagggattgtgttgaatctgtagatcaattagggagccattttaacaatattaaacttctgatccatgaacatgggctttctttctattcatttaggtttctttaattttttccaacaatgttttgtagttttcagtgtgcaagtcttacatgacaaagactctgcttcaccaaattttagacaagctcctctgagcactctgttaaactaggtctcatcctcgggctctgtccttggcctgcctaaggaagtcttagcaaagaatcctgctaataccccacccttgatcaagttccttgtcccctatatttgttatataagtccggccagcttttagcaggaatcctgttaggccagtttagagagaatccccttgcccttgatgcctcctcttagtaattttccatcctctgaccccctcactctgttcattggccacaaatccccactggtcttggttgtgttaggagttgagctcaatctctcccctccattgtgatagccttgacccctattgcagtaatctcaaaatctgccttaccattttttaaccagtgtcagaataatttttctttaacaatatctcttctaacatccttcttgccttgttcctaagtatttttttatgctattgtaaatggaatttttctctttcattttcggattgttcagtactaatgtatagaaattttattgatttttataaattggtgttgtatcatacaaccttgttctcctttattagttctaatagctttttaatagtttccttaggattttctctatatagaatcatgctacttgcaaatagagatagttttaattcttccttttcagtctggatgcttttcatttctttttattgcttatttgccctagctagaacctccagtataatgttgaatagaagtggtaagagtggacatcattgtcttattcctgctcttagggagatcttgaagaatcttccacaattaagtatgaggttagctgtgggtttttcatagatgtcctttatcaggttgaggaagtttctttttcttatttgttgagtggttttatcattaaacagtgttggattttgtcaattttttttacatctattgaaatgatggtttttgttctttattaatatgatgtattataacaattgattttcagatattaaatcaaccttgtgtttctgaaatgaatcccactgcatcatggtgtatagtcctttttgcatattattggattcatcctgccagtagtctgttgaggatttgttaaatgtctgtatttttaagagttgttggtatatcattttcttttatttatttatttattttattatttttttttattgatcattcttgggtgtttctcacagacggggatttggcagggtcatgggacaatagtggagggaagatcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttcttcacagacacagcaaccatccgatttctcaatcttttccccacctttcccccttttctattccacaaaaccgccattgtcatcatggcccgttctcaatgagctattgggtacacctcccagacggggcggctgctgggcggaggggctcctcacttcgcagacggggcggctgccgggtggagggtctcctcacttctcagacagggcggccgggcagcgacgctcctcacctcccagaaggggcggcggggcagaggcgctccccacatctcagacgatgggcggccgggcagagacgctcctcacttcctagatgggatggcggctgggcagagacgctcctcacttcctagatgggatggcggccgggcagagacgctcctcactttccagactgggcagccaggcagaggggctcctcacatcccagacgatgggtgcccaggcagagacgctcctcacttcccagacggggtggcggctgggcagaggctgcaatctcggcactttgggaggccaaggcaggcggctgggaggtggaggttgcagcgagccgagatcgcgccactgcactccagcctgggcaccattgagcactgagtgaacgagactccgtctgcaatcccggcacctcgggaggccgaggctggcggatcactcgcggttagcagctggagaccagcccggccaacacagcgaaaccccgtctccaccaaaaaaatacgaaaaccagtcaggcgtggcagcactcggcaggctgaggcaggagaatcaggcagggaggttgcagtgagccgagatagcagtagtacagtccagcttcggctgggcatcagagggagaccgtggaaagagagggagagggagaccgtggggagagtgagagggggagggggagagggagagggagagccattttcttttcttgtgatgtctttggttttgataccagggtaatgctgggctcatagaatgagtcaagaagtgttccccttttcttctattttggaaagatttgtgaaagttttgtattaattcttgaaatgtttggtagaattcacctttgaagccacctgggcttgggcttttctttgtgtgaagcttttttgtttttgtttttgttttttgagatggggtctgtctgtcacccaggctggagtgcagtgacatgatcctctctaattcctctttcattcccttggtgggagggttacctgcagccttgacctcctgggctcaggtaatcttcccacctcagcctcccaagcagctgggactgcaggcatgtgccaccacacctggctaatttttgttttttggtttttttgtagagacaaggtcttgccatgttgcccaggctagtctcaaactcctgggctcaagcgatccacttgcctcagcctaccaaagtgctaggattacaggcatgagcctccatgcccggcctgaagttttaaaattactgatttagtctctatgcttgctgtagctattcagattttttatttcttcttgagtctgtttagcagtttgtatctttctaggaatttgtgcatttcatctaagttacctaatttatttacacactcctgtttatagaattcccctaagatcctcttcattttgtaagtttggtggtgatgtctcctctttcatttctgattttagtaatgtaagttttttctgttttacttggtcattctacgtaaaggtttgtcaattttattgatctttctaaagaaccaacttctggtttcatagattttttttctatagtttttctgttctctatttaatttgttcaccctaatatttatttccttcccactgctagctttagatttagtttacccttcttttctagatccataaggtagaaagttaagttgttaggttgttaatttgagatcatttgtcttagctcaggctgccataacaaaattccatagacgtagtgacttaaacaacagaaatttattttctcacatttctggaggctagaagtccaagatcacggtgccagtatggtcaggttctggtaagggctctcttcctggcttgcagacagcatcttctctctctgttctcccatcaggcaaggaaaagagagctagctgtctagtgtcttttatttaattgatacataatatttgtacacatttatggggtacgtgtgatattttgttacatgcaaagactgtgtaatgatcaagtcaggatatatggggtgtccatcagctcaagaatttatttctgtgtgatgggaacatttcaaattctctcttctagctattttgaaatatataatacactattgttaactttagtcaccctactctgctatcaaacattagaacttattccttctatccaactgtgtgtttgtacctattaaccatcctctcatattccctgctcggccccacatacccacacccttcctagcctctggtatctattgtgctattgtctacctccatgagatcaactgttttagttcccacatgtgagtaagaacatgtgatatttgtctttccatgcctgccttatatcacttaacataataacctccagttacatccatgttgctgtaaatggcatgacttcattctatttcatggtcaaatagtattccattgtgtttataaaccacattttctttatccattcatccattcatggacacttaggttgactccatatctttgctattgtgaatagggatgcaataaatatgcaagtgcagatatcccgtctatacactgatttcttttcctttgcataaatacccagtagtaggattgctggatcatatggtagtttaatttttagtttttggggaaatctccacactggtttccatagtagctgcactagtttactttcccaccaacagtgtgtaagtgttttttttttttttccttatactagccagcatctgttattttgtatctttttagtaaccattctaactggggtaacatgatatctcattttggcttttatttgcatttctatgatgttgagcattttttcatataccttttggccatttgtatgtcttcttttgagaaatggctattcatgtcctctgcccactttttaaggggattatttgtatatctcctgttgagttcattatatattctggatattattcccttatcaaatgaatagtttgcaactattttctcccattcaactggttgtctcttcactcttgattatttcctttgctgtgcaaaagcttttttgtttaatatagtcctatttgtctatttttcttttcgttacctgtccttttgaggtgttagccataaaatcttttcctagagcagtgttctgaagtgtttcccctatgttttcttctagtaggtttatagttctgggtctgaaatttaagtctttaatctatcttggttgatttttgtatgtgatgagagacagaggtccagtttaattcttccacatatggatatccagttttcccaataccatttattgaagaaagtgtcctttccccagtgtacgtccttggcacctttgttgaaaatcagttgcctatatatgtgtggctgtacatacgtggatcaatgtctggcttttctattctattccatcgaccttgtgtctgtttttataccaaaccatgctgttttggttactgtagccttgtaatatgttttgaagtcaggtagtgtgatgcctccagctttgttcattttgctcaggattgctttggctatttggactcttttttggttcctgaaatactaattttaggattgttttttctgtttctgtgaaaaatgacattggtacttcgatagagattgcattgaatctgtagattgctttgggcttatggtcattttaataatatacattcttatgatccatgaccataagatgtctttctgtatctttgtgtcatcttcagtttttttcatcagtgttttgtagttttacttgtaggagtctttcacctactcgttaaatttattcttcaatattttatatgttcataactattataaatgggattaccttcttgatttcataaagttttatttcaccaagttgattattgatgcatagaaacattacagatatttgtatgttgattctgtatcctgcaactttactgaatatatttatcagatctaggagttttttggtggagtctttgggtcttttagacataagatcatatcatctgcaaagagggataatttgacatcctctttttcaatttggatgccctttatttctttctcttgcctgattgctctggctaggacttccagtattgtgttgaataggagtagtgaaactgggcttccttccagtactatgttgaataggagtggtgagagttttccatttcttagaggaaaggcttttcgtttttcccattccgtatgatgttagctgtgggtttgtcataaatggcctttatcatgttgagggatattccttctatgcctagttttttgagagtttttatcatgaagagatgttgaattttttttgataccttgaactatatatttttatttgaatatataaaagtagaatatcctattttccttttgagctatgtcatcatactgctaaaattatggatgaaaatggaaatatttcaacctgacccattgcaatttctatgttacacatttgctctttttttattattatactttaaattctgggatacatgtgcagaatgtgcagctttgttacataggtatacacatgccatggtggtttgctgcacccattaacccatcatctacattaggtatttctcctaatgctatttctcccctagcccccctacccccaacaggccccagtgtgtgatgttcccctccctgtgtccatgtgttctcattgttcaactcccacttatgagtgagaacacgtggtgtttggttttctgttcctttcttaccttgctgagaatgatggtttccagcttcatccatgtccctgcaaaggacatgaactcctccttttttatggctgcatagtattccatcgtgtatatgtgccacattttctttatccagtctatcattgttgggcatttgggttggttccaagtctttgctattgtgaacagtgctgcaataaacatacgtgtgcatgtgtctttatagtaaaatgatttataatcctttgggtatatacccaataatgggattgctgggtcaaatggtatttctggttctagatccttgaggaatcgccacactgtctttgacaatggttgaactaatttacacttccaccaacagtgtaaaagcattcctattgctccacatcctctccagcatctgttctttcctgacttgttaatgattgccatttaatggtcgccattcttactggtgtgagaggatatctcattatggttttgatttgcatttctctaatgacccgtgatgatgagcttttttttcatatgtttattggccacataaatgtcttcttttgagaagtgtcttttcatatccttcacacactttttgatggggttgtttttttcttgtaaatttgtttaagttccttgtagattccggatattagccctttgtcagatggatagattgcaaaaattttttcccattctgtaggttgcctgttcactctgatgatagtttcttttgctgtgcagaagctctttgctttaattagatcccatttgtcaattttggcttttgttgccattgcttttggtgttttagtcatgaaatctttgcccatacctatgtcctgaatggtattgcccaggttttcttctagggattttatggttttaagtcttatgtttaagtctttaatccatcttgagttaatttttgtataaggtgtaaggaagggggccagtttcagttttctgaatatggctagccagttttcccaacaccatttattaaatagggaatcctttccccattgcttgtttttgtcaggtttgtcaaagatcagatggttgtagatgtgtagcgttatttctgaggcctctgttctgttccattggtctatgtatctgttttggtaccaataccatgctgttttggttactgtagccttgtagtataatttgaagtcaggtagcgtgatgtctccagctttgttcttcttgcttaggattgtcttggctatgtgggctcttttttggttccaaatgaaatttaaagtagtgtttttctaattctgtgaagaaagtcaatggtagctggatggggatagcattgaatctataaattactttgggcagtttggccatattcttcctatccatgagcatggaatgtttttccattcatttgtgtcctctcttatttccttgagcagtggtttgtcattctccttgaagaggtccttcacatcccctgtaagttgtatttctaggtattttattctctttgtagcaattgtgaatgggagttcactcatgatttggctctctgtttgtcttttattggtgtataggaatgcttgtgatttttgcacattgattttgcattctgatactttgctgaagttgcttatcagcttaaggagattttgggctgagacaatggggttttctaaatatacaatcatgtcatctgcaaagagagacaatttgacttcctctcttcctatttgaataccctttatttctttctcttgcctgattgccctggacagaacttccaatactatgttgaataggagtggtgagggagggcatccttgtcttgtgctggttttcaaagggaatacttccagcttttgcccattcagtatgatattggatgtgggtttgtcataaatagttcttattattttgagatgcattccatcaatacctagtttattgagagtttttagcataaagcggtgttgaattttatcgaaggccttttctgcatctattgagataatcatgtggtttttgtcattggttctttttctgtgatggattacgtttattgatttgcgtatgttgaaccagtcttgcatcccagtgatgaagctgacctgatcgtggtggataagctttttgatgtgctgatgggttcgatttgccagtattttattgaggattttcgcatcagtgttcatcagggatattggcctgaaattttcctttttggttgtgtctctgccaggctttggtatcaggatgatgctggcctcataaaatgagttagggaggagtccctcttcttctgttgtttggaatagtttcagaaggaatggtaccagctcctctttatacctctggtggaattcagctgtgaatccttctggtcctggaccttttttgtttggtaggctattaattactgcctcaagttcagaacttgttattgttgtattcagggatttgacttcttcctggttcagtcttgggagggtgtatgtgtccaggaatttatccatttcttccagattttctagtttacttgcatagaggtgtttatagtattctctgatggtagtttgtatttctgtgggatcagtggtgataccccctttatcattttttattgtttctatttgattcttctctcttttctcctttattagtctcgctagcagtctatcaattttgttaatcttttcaaaaaaccagctcctggattcattgattctttttgaagggtttttcatgtctctttctccttcagttctgctctgatcttagttatttcttgtcttctgctacctttgaatttgtttgctcttgcttctctagttcttttaattgtgatgttagggtgttgactttaaatctttcccactttttgctgtgggcatttagtgctataaatttccctctaaatactgctttagctgtgtcccagagattctggtacgttgtgtctttattctcattggtttcaaaaaacttatttatttctgccttaattttgttatttacccagtagtcattcaggaacaggttgttcattttccatgtagttgtgcagttttgagtgagtttcttaatcctgagttctaatttgatggcactgtggtctgagagactgttggttacgatttccattttttgcatttgctgaggagtgttttacttccaattatgtgatcaactttagaataagtgcaatgtggtgctgagaagaatgtatattctgttgatttggcttggagagtactgtagatgtctattaggtcctcttggtccagagctgagttcaagtcctgaatatccttgttaatattctgtctcaatctaatattgacagtgggtgttaaagtctcctactattattgtgtgggagtctgagtctctttgtaggtctgtaagaacttgctttatgaatctgggtgctcctgtattgggtgcatatatatttaggatagttagctcttcttgttgcattgatccctttaccattatgtaatgcccttttttgtcttttttgatctttgttggtttaaagtctgttttatcagagactaggattgcagccactgcttttttttgctttccatttgcttagtaaataatcctctatccctttattttgagcctgtgtgtgtctttgcacatgagatgggtctcctgaatgcagcacatgggtgggtcttgattctttattcaatttgccagtctgtgtcttttatttggggcatttaccccatttacatttaaggttaatattgttatgtgtgaatttgatcctgtgattataatgctagttggttattttgcttgttagtcgatatagtttcttcatagtgttgatggtctttacagtttgatatgtttttgcagtggctggtactggtttttcctttccatatttagtgcttccttcaggacctcttgtaaggcaggcctggtggtgacaaaatctctcagcatttgcatgtctgtaaaggattttatttctccttcacttataaagcttagtttggttggatatgaaattctgggttgaaaattcttttctttaagaatgttgaatattcgcccccagtctcttctggcttgtagggtttctgtcgagagatctgctgttagtctgatgggcttccctttgtgggtagcctgacctttctctctggctgcccttaacattttttcctgcatttcatccttggtgaatctgacgattatgtgtcttggagttgctcttctcgaggagtatctttgtggtgttctctgtatttcccaaatttgaatgttgacctatcttgctaggttggggaagttctcctggttaatatcctaaagaatgttttccaacttggttctgttctccctgtcactttcaagcacaccaatcaaacataggtttggtcttttcatatagtcccatatgtcttggagcctttgttcattccttttcattattttttctctaatcttgtcttcacactttatttcattaagttgatctacaatctctgatatcctttcttccacctgatcagttcggctattgatacttttgtatgcttcacaaagttctcgtgccgtgtttttcagtcccatcaggtcatttatgttcttctctaaactggctattctagttagcaattcctctaaccttttttcaaggtccttagtttccttgcatggggttagaacattctcctttagcttggaggagtttgttattatccaccttctgaagcctgcttctgtcaatttgtcaaactcattctccgtccagtttgttctcttggaattttcagcctttttgcactggtttttcctcatcttcatggatttatctacctttggtctttgatgttggtgacctttggatggggtttctatgtggacatcctttttgttgatgttgatgctattcctttctgtttgttagttttccttctaacaggcctctctgctgcaggtctgctggagtttgttggaggtccactccagacccagtttgcctgggtatcaccagcggaggctgcagaacagcaaagattgctgcctgttccttcctctggaagcttcgtcccagaggggcacctgccagatgccagccagagctctcctgtatgagatgtctgtcgactcctgctgggaggtatcttccagtcaggaggcatggagctcagggacccacttgaggaggcagtctatactttagcagagcttgagcactgtgctgggattgccgctgctctcttccgaactggcaggcaggaacgtttaagtctgctgaaactgagtccacagccaccccttcccccaggtgctcggtcccaaggagatgggagttttatctataagcctctggctggggctgctgcctttctttcagagatgcgctgcccagagaggaggaatctagagaggcagtctggctacagggactttgcggagctgcggtgggctctccccggttcaaacttcctggccactctgtttacacagtgaggggaaaactgcctactcaagcctcagtaatggcagacgcccctccctccaccaagctcgagtgtcccaggtcgacttcagactgttgtgctggcaatgagaatttcaagccagtggatcttagcctgctgggctccgtgggggtggaatatactgagctagaccacttgcctccctggcttcagcccctttccaggcgagtgaacagttatgtctcactggcattccaggcgccactggggtatgaaaaaaaaactcctgcagctagctcggtgtctgcccaaatggccgcccagttttgtgcttgaaacccaggtccctggtggcataggcacccaagggaatctcctggtctgcagattgcgaagactgtgggaaaagcatagtatctgggccagagtgcaccattcctcacggcacggtccctcaaggcttcccttggttaggggagggagttccccgaccccttgtgcttcctggatgaggcaacgccccaccctgcttcggctcaccctccgtgggctgcacccactgtctaaccagtcccaatgagatgagccgggtacctcagttggaaatgcagaaattacccaccttctgcattgatttcactgggagctgcagaccagagctgttcctattcggtcatcttgccaaccaccctgagatgttgaattttatcaaatgctttttttatcagatgctttctctgcatctattaaggtgatcatgtggcttttattctctattctattgatggaatgtttcatgtttattgatttgcatgcattgaatcatcattgcatccctgggataaatcccacttgatcatggtgtattatctttttgatgtgatgtttgatttggtttgctagtatttcgttgaggatttttgcatctgtgatcatcagggttgttggcctgcagttttgtttttttgttgagtccttatcaggttttggtatcagggtaatgctggccttatagaatgagtagggagaattccctcctcttgaattttttggcatagtttgagaagtgatattagttcttctctgtaagtttcatggagttctccagtgaagccagctgattctgggcattgttttggttttgttgggagactttattactgattatactttattactgattcaatcccattactcattactggcttgttcaggttttctatttctttctgattcagtcttggtaggttgcatgtgtcctgggatttatccatttcttctgggttttcaagtttattagcatatagttgttaatagtatttctatggtcacttcttccaatttttagatttgctttaatatgcaaggactttttcttgaggatatatctatggtgttggttgggcagggcacttagactttgattatgggtacattcagtagtgtagtctgtataatttcttcagctataaacagcatcatcaaccatgtctgtatttttcttagtggcttagggtgtagttgttatggaggctgtggtgaagttttgatgggcatggggatttcaggtgggctagtccttgttttcgagtggtgtcaccagtgggtgaagcatgcctgtcctttggccccaggacagtgtattcattaagttatattacttttttaaaaaaagtttattttattctacaatggaaaacttgaccttttctacttttccaatattttcagatctggtagctcagcgaggagaaagattggaattattgattgacaaaacagaaaatcttgtggattctgtaagtatggaatctgataatatggagtctgatgtaaagtggagaaactatggatgatggctaacataattgggaaataccttaaattcaaatatttggtggtttttttttctttctcatttccattatgtgattactttgtaataatgaggataacaatgaggcatagaaaagaaacatcatcccctaatagccattaaggtagctttggtttggaaaacatactcagtatacagaaacaattttctaaagctttggattgaggcctatataatttagcacctcaactgcatgtaacagtctgttccctttacaaatttgtaaaacatgaaacaaatgtgcaagccgtttgtgacccagtatgaatcttgaaaactggacaattcacttttttgcttacactgatagtttcatcttgccttgtatcaatcaagagacatcgattggaaagcgccaataagccttaaaggagacaatgtgtccttgtgagctgcttatactatggttccgtatgtcctcacattttcaatgcagttactgtggatgaaagttttaaggaaagatgacagatatatggtgaacagaaggagggcagagatcagctacaatttgggtctacacaattataaatgtaaatgtacagtgcaggtttacaccttgaaagaaaacagtgattgattatgttcgttgtgactgacagctggattgtagtggttaagaacacaggctctagtatcaggttgcctggatttgaatcccacctctgctacttactagttgtgtgaccttaggcaaatgacttaacctctttgtgcctcagtcatcatcttctgtaaaatgaagatgtacccacttcagagcattttaaggattaaatcagataatgcatgtaaagtgcctaacacagtatttgatacatagtaagagctatttaaatgttcatcattattgttaattttacagggacatctattagcagcaggttttagtatatacagtctactatcaggttttctaggagtttataaacagttttttcatcaaagcatgtggtaggtggaggaaggatgctaccatacaggaagtcaaaacacctgggttctagatctcactttgtgacccattgctggggagcaaagaaaacagagaagtatctgattccagatctgcagaccaatttctttgatacttccaggctgtctcttagttattcttaattcttgaggattaccctgcttagggggaatggtctgtctttgaccaatagtagtatgatctgtactttacaaataaaagtcttaattttgttgacttcatgactgaaaacagaaggtactaatgaactaacaggtatctctctttatggtagaataacatacgtgcagcaaattgtatcaagtgtacaacttttaagtgtatagctcaattattttttatatatatctatacccatgtaaccaccacccagatctagatagaaaacattaccaacaccccagaaggctgcctcataccccttccagttaataatccccaatagacgtaattatgtttctgacttatatcaccacagatagtgttttgcctgttcttaaaatttatttgtgtctggcctctttcactcactgttatgcctgtgaaattcatccacgttttttattatagtaatcacttattcttttttattgttttatattattccattatacaaatctaccacaatttgtttatccgttcttctctgtggggctttatttctggattctctattttgttccattggtcagtttgtctacctttatgccagtaccacactgtgttgattagtataacttaatagaattcttgaaattaagtagtgtaagtcttccaactatattcttgttgtccaatattgtcttcactcttttaggtgctttgcatttccatatatgttttagaataagcttgttttccatctcttgaccccacaacaatgtgtatctttgtgactgcatttaatatataggtcactttaggggacattggtatcttgacagtatagagtttttcggtccatgaacgtgacatatctctgcttttgcttaggatttaaaaatttttctcagcagtattttttagtttttggtgtacaggtcttgcacatatttgttaaatttacccttgagaatatcatgcttttgtattgtgtaacaaatttttaaattttgtttctaattctttattgctagtatatggaaataaagttggttattgtatattgaccttgtttgtattctgcaaccttagaaaaattcatttaccagttctggttactgttttgtacattcctgccttttattttccttcccttattctggctagaaccttctacacaatactgaatacaagtgataacagtgaacatccttgcctattgaccatcttgtggggaaaaattcaatactttttgaaaaaaataaattcagtgttaagtttgtggttaactgtagattttttgtaggtaccctttaataggtggaagaattccctttaattcctcatttgagagttgtattcatgattttatcaaatgctttttctccatttattgagatctttggtttttctcctttattcagttagtatggcaaattacattgatttttcagtgttaaaccaactttgcattcctgcaaggtcatgacttactacccttcttatataacactttattggatttgctattgttttgttcaggaatttggcatctatgtttataagagatagtggtctgtaatttatttttctctttaggttttggtatcaggaatatgctggcctcattaaacaagttgggaaatcttacctctctatcttctgagtttgggtactattggtattatctgtcttagatgtttggaagaatttactagtaaagcagattgggcctcgagttttcttcgttggaaaatttaaaatctgccatcttgctgtttgtttcctatttataccatctagtctttgttccctttttgttctgccttccattggatttagtacatttgttattccattatgtctcctttgtcagtttattagctatagctccattctgtcattttctgattgctttagggtttacagtatgtctttgatttataatctcccttaaagtggcatttttccacttcatgaatagataagaaccttataatagtatacttctagctgtttcttcttggcctttatgctattgttgacatatttttatttacacatgtattaaaaacttcataatacattgttgttgtttttgtttaaagagttgattatcttttaaagagatttaaataataagggaagtcttttctgtttacccatgcagctaccatttcagtgctcttaattcttttgtgtaggccgagtttctatctgatgttattttctttctgcctgtatgctttaatttaacatataatcttccattgtagttcaagtgtgtaggtctactggaaatgaattctttcaggtttggtatgtctgagaagtttttatttcacttcctttttttttttgaaagacattttcactgagtatagaattctaggtcagtgatttttctttcttttaatacttgatgaacggtggttcatcactgtcttttacattgtttctgacaagaattctgctgtcattcttacatacataaagtgtatttttttttcttctggatgctttaaagattttctctttatcattggttttaagaaatttgattataatatatatgccttggtatatatttctttatgtttctttggctttgagtttgttgtagttttcatcaaattatgaaaatgtttagctctttctaggcttccagtgacatctgtattaagccacttgaagctgtcccacaactcactgatgctttgttcatttttaagtcttttttccactatgtttcatttagaatagtttctattgctatgtcttcaagtttacttaccttttcttctgcagttcgcaatctgctgtttctgtcctgtgtatgtttcatctttacaggtttgttttggatcttttttatatcttccatgtgtctccttaacatgtgcatactttcctctaccttgagtatatgaagtatatttataattgaagtgcttattccacttacatgtaatgcaaattttgatagagttaggtgtaggtatcttgctctttgttttttatttgccgcatccctgtcctcttcttttttattttgattactcaagtactttttaaattgttttttaaccatctctatttgttttttaacacttctattgagagataactcacagaccatacaaattgcccatttaaagggtacacttcagtggaatttagtatattacattattaaaattgtggtaaaatatgtatagcataaaattttgccattttaacctttttaaagtgcacaattcagtgatgttaattacatccacaatgttgtgcatccatcactactagctatttccaaaacttttttatcaccccttaacaaaaactctgtaaccattaagtaataataactccccattccccttactctcagcccctggtaactctaatctactttctgtctctgaatttgcctgttctagatatgtcatataagtgggatcatacaaaatttgcccttttgtgtctggcttatttcactaagcataatagtttattgcttaaaaaaaaatgctaacaatcacctgagccttcagtgagccttaatctttttgctggtggagggtctcaccttgatgttgatggctactgactgatcgatcaggctggtggttgctgaaggttgtggtggctgtggcaatttcttaaaataagacaacagtgaagtttaccacattgattgactctttcacaaaagatttctctgtagcatgtgttgctatttgatagcaatttactggcaatagaacttctttcaaaattggagtcaatcctctcaaaccctgctactgctttatcagctgagttgatgtaattttctaaatcttttgttgtcatttcaacagtgttcacagcatcttcaccaggaatagttgccatctcaagaaaccactttccttgcccatgcataagaaacaactcctcattcattaaagttttatcaagaaactgcagcagttcagtcatgtcttcaggctccagttctaattctagttctcttctatttctaccacatctgcagttactcactccactgaagtcttgaacccctcaaagtaatttgtgagggttgtaatcagtttcttccaaacacctgttaatgtttatattttgacttcctcccacgaatcatgaatgttcttaatggcatctagaatggtgaatcctttctagaaggtcttcagtttactttgcccagatccatcagaggaatcattatctatggcagctatactaaatgtttttcttaaataataagacttgaaagttgaaatcactccttgattcatgggcagcagaatggatgttgtattagcaggtgtgaaccccaaaagtctgagacaggtctcagttgatttagaaagtttattttgccaaagttgagagcgcacacccgtgacacagcctcaggaggtcctgacaacatgtgcccaaggtggtcaaagcccagtttggttttatacattctagggagacgtgagacatcagtcaacatatgcaagatgaacattggtttggcctggaaaggcggaacaactcgaagcaaaggcgggaaggctcgaagtggggagggggcctccaggtcttagatagataagagacaaatggttctattcttttgagtttctgatgagcctctccaaaggaggcaatcagatacgcatttatctcagtgagcagaggggtgactttgaatagaatgggaggcaggttggccataagcagttcccagcttgacttttccctttagcttagtgatttggaggccccaagatttattttcctttcacacaggcatgaaaacgacatttatctcctcgtaagtctccatcagagctcttgagtgactaggttcattgtcaatgagcagtaatactttgaaaggaatcttttctttttgagcagcagatctccacagatcttctgtacaccatcctgtaaacagatgtgctatcttccaggtttgttgttccatttcaagagcacaggcagagtatatttagcataattcttacgggccctagattttcagaatggtaaattaccattggcttcagcttaaagtcatcagctgcattggtccctaataaaagtcagcttatcctttgaagctttgaagccagtcattggcttctctctatgaaagtcctagatggcatcttcttccaaaagaagggtgttttgtttacattgaaaaatctgttgtttagtatagccacctttatcaatgatcttagctaggtctcctggataacttactgtggcttctctctcagcacttgctgcttcaccttgtacttttatgttatagagatggcttctttccttaaacctcatgaaccaacttctgctagctttaaacttttcttctgcaccttcctcgcctctctcagccttcatagagttgaagagttagggccttgctctgtattaggctttggcctaaggaaatgttatagctggtttaatcttctatccagacccctaaaacattctccatatcagcagtaagtctgttttgctttcttatatgtgtgttcactggagtagcactcctgatttccttcaagaactgttctttgcattcacaatttggttaactgtttgtcacaggacacctagctttaggcccatctcagctttcgacatgccttactcactaagcttaattatttttatcttttgatttaaagcaagggatgtgtgacttttcctttcacttgaatacatagatgccattgtaaggttattaattggccaaatttcaatattgtgtctcggcaaatagggaggcctgagagggagagagataagagaatagctggtcagtgaacagttagaacacacaacatttatccgttagctccgtcaccttatataggcacagtttatggcacccgaaaacaatcacaatagtaacatcagaggtcacagatcgtcataacagatagaatgaaaataatgaaaagtttgaaatgttataagaattaccaaaacacagacatgaggcgaccacatgctgttagaaaaatggtgctgccgcatgttctcactcctaagtgggagttgaacaatgagaacacatggacacagtgaggggaacatcacacactggggcctgtcggggagtgggggctaggggagggatagcattaggagaaatacctaatgtagataacgggttgatgggtacagcaaaccaccatgtcacgtgtatacctgtgtaagaaacctgcacgttctgcacatgtatcctagaacttaaagtataataataataataaaaagaaacaaaaagtgcaggccaagcaggaaaaaaaaaaaacaaaccagaaaaatggtgctgatagtctcatcatggggtttccacagaccttcgatttgccaaaaaaaaaaaaaaaaaaaaaaaaaaatccatgaagtgcgataatgtgaagtacaataaaaggggatatgcctgtaattctttctgtgtcctttattgttttcctgcagttctgtttcagtgtacgattttgtttgcttcaaactgaagaagttcttttattgtttcttataatgttgatctactgatgagagattctctaagcttttgtctgaaaatctgtttcatcatttttttaaagaatactttctttgcatagagttttttagtttttcacaatggcagtttttttttttttttaaagtgagtgctttaaaaatgccattccatttttctttggctttcatatgttctcaaagagattgtcatttctcttagtcttacttgaaaaataatgattcttaccccacctttggcttttgttgttgttgttgttgttgtttgttttgtttttttaagacagagtctctctctctcacccaggctggagtgcagtggcacgatcacagcttactgttgcctccacctcccaggctcaagtgatcctcctgccttgcctcagcctcccaagtaggaggaccacaggcatgcgccatcacacttagctaattttttaaatttttcttagagacgggtctccctatgttgctctggctggtctcaaatgcccaggctcaagtgatcctcccaccttggcttcccaaagtgctggaaatacaggcatgagccaccacacctggccccctttggctggttttaagagtgtctttttatatttggttttcaactttttatatatggttattagctttctgtggctgctatcacaaattatcacaaacttggtggcttaaaacaacaaaaatttattttctcccactactggatttcagaagttcaaaatcagtttaactgggctgaaattaaggtgttagcaaggctacactccttccagaggctctaggagaggatctgttccatgcctcttccagcttcaggtggctgccagtatttcttggcttgtggctatatcattgtagtctctgcctccatgttcacattaccttctcctttgcatgtgtgtcaagcctccatctactttcctcctatagagacatttgtgatgtcatttagggctcacatggataatccaggatactctcttcatctcaagattcttgacataatcacatctgtaaagaccccttttccagataatatcacatatgtcacattcatagggattaggacacaggcatgtcttagggcaacatttaacaattgttctttataggtgaacttgttttaaacagatggtttgtcagtgttcagatgttgacctgagagtggtggaggaatctccattacaacctgttgaatcacacagctatgttcggatttattagtttcattcctcactgctttttctcatctacatcatctttctctttcttgaattatttattgtgaattagtctttgtttgtagtatatcctcacacattttcttcatatgagtttgtggatgataatcccttcaagaataaaagtgttattttggtctcatatttgaacaattttttgactggtgtagaattctagggttaagatcattttctctcaaaattctctgaatattgctgcatttcagtgcatgaagaatttaggcatctgagaagttcaacaactatacagtttacacgttttttatttgggccaagtttgaggactgcaacccaggagcatagattcaagttgctctgaatatatgttctaattagcagcagttacaagtaggtttttaaaggaaaaaaggagaggcagtatctaatttgtttaccaagaatttacattaaaatagcataagctattgattgctatacattgtcctttgtatcacaaattccaggaacatgaagataatggttgaggcagctagtcagcaacaaattgcctttaaacagttgccccccctgggcattgtgtggggggtgtgactgaagtccccatactcatgtcttctgggcctgataaattttatatacctcacatagctcaggctgctctgagctgtttttcttttctcatttcccccttttgatcaaaatttttctcttctgaaagcattgatgatcagcattttagatataagtttatcccatgtcactggggaggcttattcccagatattcttgtcccgtgttggatggaaagacgtaaaaaaggtaccatggcttaaagaacttagtgaggtctcaaggccaaattgattggcaacacagaggagcagagcaacaggatctcagtcaagccatccactcacgctggagccatggcatgaacaactatacagtttactcaagtccaccctcacttaatggcaccaactgcaagtttggggattccccaaaccaccctcagatttgatagttcattagaaggatttataatactctgtgagcactattatactcacagttatggtttattacaggcaaattatacatagtaagaccagccaagggaaaaagtacatagggtggagtttgggaagataccaaatgtagagcttttgttgtcctcttcccatggagtcaggacacgttgctctcttggcatcagtgtgtgacaaaatgtgcagagcattgcctaacaggaaagcttacccaagccttagtgttcagagtttttattggggtttcattatgtaggcattattgactgactgccctctggcttgatctcagtctccagctccacttggtgtgatccaaagcctcctaaatcacatagtcattttttctggagtgtcttttccccaccctaaatcacattgttactatctagattacagtctattagaaaaataaatcaaggctgtgcatggtagctcatacctataatcctaatacttatactttgggaggccaaagctgaaagatctctaaaatccagaagttcaagaccagcctaggcaacaaagtgagaccttatctctacaaaaccaaacaaaaaaaaaaaaaaaataggtgtgattgggtgcacctgtagtcctagctacttggggggctgaagatggagaattgcttgaacccaggaattcagagctgcagagagctatgatcacaccactgcattccaggctgggttacagaggggtgacctccatctcaaaaaaaaaaaaattttttttcttttaattcttttttattttttattttttttataaatatatatattttttattatactttaagttctagggtacatgtgcacaacgtgcaggtttgttacatatgtaaacatgtgccgtgttggtgtgctgcacccattaactcatcatttacattaggtatatctccaaatgctatcccttccccctcccaccaccccacaacaggccccggtgtgtgatgttccccttcctgtgtccaggtgttctcattgttcagttcccacctatgagtgagaacatgtggtgtttggttttttgtccttgcagtagtttgctgagaatgatggtttccagcttcatccatgtccctgcaaaggacatgaactcatccttttttacggctgcgtagtatttcatagtgtatacgtgccacattttctgaatccagtctatcattgttggacatttgggttggttccaggtctttgctattgtgaatagtgccacgataaacatacgtgtgcatgtgtcttgatagcagcatgatttataatcctttgggtatatacccagtaatgggatggctgggtcaaatggtatttctacttctagatccctgaggaatcgccacactgtctttcacagtggttgaactagtttacagtcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgccatcttttgagaagtgtctgttcatatccttcacccacttgttgatggggttgtttgtttcttttcttataaatttgtttgagttctttgtagaatctggatattagccctttgtcagatgagtagattgcaaaacttttctcccactctgtaggttgcctgttcactctgatggtagtttcttttgctgtgcagaagctccttaattagatcccatttgtcaattttggcttttgtttccattgtttttggtgttttagatatgaagtccatgcccatgcctatgtcctcaatggtattacctaggttttcttctagggtttttatggttttaggtctaacatttaagtctttaatccatcttgaattaattttagtataaggtgtaaggaagggatccagtttcagctttctccatatggctagccagttttcccagcaccatttgttaaatagggaatcctttccccatttcttctttttgtcaggtttgtcaaagatgacatggttgtagatgtgtggtattacttctgagggctctgttctgttccattggtctatatctctgttttggtaccagtaccatgctgttttggttactgtagccttgcagtatagtttgaagtcaggtagcatgatgcctacagttttgttcttttggcttaggattgacttggcaatgcaggctcttttttggctccacatgaactttaaagtagttttttccaattcagtgaagaaagtcattggtagcttgatagggatggcattgaatctataaattaccttgggcagtatggccattttcatgatattgattcttcctatccatgagcatggaatgttcttccatttgtttgtgtcctcttttatttcgctgaacagtagtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacgttgatttcgtatcaagactttgctggagttgcttatcagcttaaggagattttgggctgagataatggggttttctagatatacaatcatgtcatctgcaaacagggacaatttgatttcctcttttcataattgaataccctttatgtctttctcttgcctgattgccctggccagaacttccaacactatgttgaataggagtggtgagagagggcatccctatcttgtgccagttttcaaagggaatgcttccggtttttgcccattcagtatgatattggctgtgggtttgtcatagctcttattattttgaaatacgtcccatcaatacctaatttattgagagtttttagcatgaagggctgttgaattttgtcaaaggccttttctgcatctattgagatgatcgtgtgttttttgtctttggttctgtttatatgctggattacatttattgatttgtatatgttgaaccagccttgcatcccagggatgaagcccacttgatcatggtagataagctttttgatgtgctgctggattcgatttgccagtattttattgaagatttttgcgtcggtgttcattagggatattggtctaaaattctctttttgtgttgtgtctctgccaggcttaggtatcaggatgatgctggcctcataaaatgagttagggaggattccctcattttctattgataggaatagtttcagaaggaatggtgtcagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtcaaggaatttatccatttcttctagattttctagtttatttgtgtagaggtgtttgtagtattctctgatggtagtttgtatttctgtgggatcggtggtgatatccccttttatcattttttattgcgtctatttgattcttctctcttttcttctttattagtcttgctagcagtctatcaattttgttgatcttttcaaaaaaccagctcctggattcattgatttcttgaagggttttttgtgtctctatctcgttcagttctgctctgagttatttcttgccttctgctagcttttgaatgtgtttgctcttgttcctctagttcttttaattgtgatgttagggtgtcaattttatatctttcctgcttccttttgtgggcatttagtgctataaatttccctctacacactgctttaaatgtgtcccagagattctggtatgttgtgtctttgttctcattggtttcaaagaacatgtttatttctgcattcatttcgttatgtacccagtagtcattcaggagcaggttgttcagtctccatgtagctgagcagttttgagtgagtttcttaatcttgagttctaatttgatttcactgtggtctgagagacagtttgttataatttctgttcttttacatttgctgaggagtgctttacttccaactatgtggtcaattttggaataagtgcgatgtggtgctgagaagaatgtatattctgttgatttggggtggagagttctgtagatgtctgttaggtccgcttggtgcagagctgagttcaattcctggatatccttgttaactttctgtctcattgatctgtctaatgttgacagtggggtgttaaagtctccctttattattgtatgggagtctaagtctctttgtaggtctctaaggacttgctttatgaatctgggtcctcctgtattgggtgcataaatatttaggatagttagctcttcttgttgaattgatccctttaccattatgtaatggccttctttgtctcttttgatccttgctagtttaaagtctgttttatcagagactaggattgcaacccctgcctttttttgttttccatttgcttggtagatcttcctgcatccctttattttgagcctatgtgtgtctctgcacatgagatggatttcctgaatacagcacactgatgggtctttactctttatctaatttgccagtctgtgtcttttaattggagcatttagcccatttacatttaaggttgatactgttatgtgtgaatttgatcctgtcattatgatgctagctggttattttgctcgttagttgatgcagtttcttcctagccttgatggtctttacaatttggcatgtttttccagtggctggtatgtgttgttcctttccatgtttagtgcttccttcaggagctcttgtaaggcaggcctggtggtgacaaaatctctcagcatttgcttgtctgtaaaggattttatttttccttcacctatgaagcttagtttggctggatatgaaattctgggttgaaaattcttttctttaagaattttggatattggcccccactctcttctggcttgtagagtttctgccgagagatcagctgttagtctgatgggcttccctttgtgggtaacccgacctttctctctggctgcccttaacattttttccttcatttcaactttggtgatctgacaattatgtgtctcggagttgctcttctcgaggagtatctttgtggcgttctctgtatttcctgaatttgaatgttggcctgccttgctaggttggggaagttctcctggctaatatcctgcagagtgttttccaacttggttccattctccccatcactttcaggtacaccaatcagacgtagatttggtcttttcacatagtcccatatttcttggaggcttttttcgtttctttttattcttttttctctaaacttctcttctcgcttcatttcattcatttggtcttcaatcacggataccctttcttccagttgttcgaatcggctactgaagtttgtgcattcgtcacttagttctcgtgccatggttttcagctccatcaggtcatttaaggacttgtctacattggttattctagttagccattcatctaatctttttttcaaggtttttagcttctttgtgctgggttcaaacttcctcctttagctcagagaagtttgatcatctgaagccttcttttctcaactcgtcaaagtcattctctgtctacctttgttctgttgctggtgaggagctgcgttcctttggaggaggagaggcgctctgatttttagaattttcagtttttctgctgtttttttccctatctttgtggttttatctacctttggtctttgatgatggtgacatacagatggggtttttgtgtggatgtcctttctgtttgttagttttccttctaacagtcaggaccctcagctgcaggtctgttggagtttgtcggagggccactccagaccctgtttgcctgggtatcagcagcggaggctgcagaacagtgaatattgctgaacaccaaatgttgctctctgatcgttcctctggaggttttgtctcagaggggtacccgccgtgtgaggtgtcagtctgcctctactggggggtacctcccagttaggctgcttgggggtcagggacccacttgaggaggcagtctgtctgttctcagatctcaaactctgtcctgggagaaccactactctcttcaaagctgtcagacagggacatttaagtttgcagaggtttctgctgccttttgttcagctatgccctgcccccagaggtggagtctacagaggcaggcaggcctccttgagctgtggtgggctccacccagttcgagcttcccggcagctttgtttacctactcaagcctcagcaatggcgggcgcctctcctccagcctcgctgccaccttgcagttcaatctcagactgctgtgctagcaatgagtgaggctccgtgggtgtgggaccctctgagccaggcgcgggatataatctcctggtgtgctgtttgctaagaccgttggaaaagcgcagtattagggtgggagtgatccgattttccaggtgccatctgtcacagcttcccttggctaggaaagggaattccctgaccccttgtgcttcccgggtgaggcgatgtctcgccctgcttcggctcacgctcggtgggctgcacccactgtccaacaagccccagtgagatgaagccggtatctcagttggaaatgcagaaatcatccgtcttgtgcgttgctcacgctgggggctgtagactggagctgttcctatttggccatcttggaacaggaatcaaaggaaattttttaaaaatcccatttatgatagcatcaaaaagagtacaatagttaggaataaatttaaccaaggatgtaataatgtgcacactgaaaattataaaacattgatgaaagaaattcaagaagacacaaatcaatggaaagataccttatgtttatggattggaagaatcaatattattaaaatgttcatactgcctgaagcaatacacagattcaacacaatccctattgaaattccaatggcatttttcacagaatagaaaaaaaaattctaaaatgtggatgaaactagaagacattatattaagtgaaatatactagacacagatagataaatactgtatgatttcacttatatatggaatctaaaaaaaatgttcagttcataaaagcagagagtaaaacagtggttgacagtgggtgggagacctggagagatgttggtcaaagtgtatgaacttacagttgtaagatgaataagttctggataccggacatacagcatggcaactatagttaataataatgtattgaatatttgaaatatgctataagaatagatcttaagcattctcaccacatacccaaaaaagtaactatgtgaggtgatggatattttacttagcttgattgtggtaataatttcacaatgtgtacatttatcagaatatcacattgtataccttgaatatataccatttttatttgccaattatacttcaaggcagaaaaaaataaaattagagtagaaacaaaagcttggaggtctgaaatgttactaaaagtgtaacattttccttttttcaatattcttgccacatggtgggtaggtccttttagtctgaagattcaagtctgtcttatttgggggatattttcttcaattagtcccttgattattgatccttctcttttggctgtattctctcctgtgactgctaataggtgtgtaaatcagtaccaggcacataataagcacatgttaaatatctgttgatcgtataaattgatcctggatttgcttgatcagttttccgtgtatcttacatcttctttcatgatttacaacctagacattttgctgttttcagaacaaattttttgaattgttactgcagaagctgcttttgctcatttatgttctgcttttaaaaaattatgccattttattaaaatatagtttttggaatgttgtcatgttatctaattttttatgtcctctgatgactttgtttaaaattagttcaattatgtcttgtatctgaggatacttattagaaatttttttattactgttattctatcttgtttcccatattaactttgttccattaaggactgtttgtccccattgctttttttgtctcctcactttaactgctgtttcttctcaaaagttctagtcaatgcatatattctattcaacatatatatttagctctagatgtaatcagttttggtatgtgcctccaggtggcatcctgtgcagtcttcatgaagtgaaacccaaagactggtgcccctgtcagttgttctactgcagagactttgtggagtatgtggttggagatgaatctatggttaagggagtggattttttaaaaccaatatgtgaagtataatatacataaagtgcatcaactgtaagcatacaacttgttgtgttttcacaaagtaaacataccatgtagaaccaacacccagattaagaactagagcacgaacagtaccccagaagctcccttctcccttcttttagtcactactcttctccaaaggtggccactgtcctgatttctccacatagattaataaaacatagcaggggccgagagtggtggcacacacctatagtcccagctactcaggaggctgaggtgggaggatcgtttgagcccaggaggtcaaagctgcagtgagtcgtaattgtgccactgcactccagcttgggcgacagagcaagaccctgtctcaagataaataataaaatatagcaggtattctgtttatgtcaagtttctattgctcaaaatgatgtttgtgagattcatctgtggtaaattgtataaatgtagtagtagattgtgaattgtcattactgtattgtattccatgttatgactctcctgtaatttatgcattgcacagttgatgggcatttgggtggtttccagtttaaggtatgaaaagtagtgctgtccaaaacatttttttatatgtcttttggtgaatttgcatacatctgtgggaccataccagagtggattgctggattattagggagttttgttggttggttgtttgccattttgttttaaactccttgtgtcctggtgggaattgttcagtagatactgagaaattgatgatgcaaaagaaaatggatagcagaaggaatgaagttctatgggttttggccctcacaaaagtaaatacatatcttcctacagaaatcaaacaggtttttatggctcaaagccccggaattatacggggcagaataggcgaatgtgcttgcagtcagctggctttaaaagagcctttcttattggaagtatagagaggaaaattcttttccactagcgggaagaaccacttctggtgctcaacatcatgtgcattgctgcagtggagaagaaaaaagagggaagcgttttcattgggctcatactgcttatgataggcctggcagagtcttgcttttggcaactattgagtatgaatggccagtctctacttgtaaagagaggtcattggacttaaatggaattaatggaagtaaaatgttctcaggttgttactgcaaatcattcatgtagtcagtgccaggggttaaacaattctcgcctcttttctagtctgtcaccttcaaaactaccagcagaaatcttgctcgagccatgtgtatgaagaacctcaagctcactattatcatcatcatcgtatcaattgtaagtttttgtccttttagtgtatggctttatttttcaatctctaagaaattaggtactagaattatttctcaatgattaacactctgaaatgagctacatatgtcttttaatagtgaaacacatgaccaggcagtggctttcctatgaagtcactatgaaatatctctacttaaacccctccttcctattgagaattattatatattctcaataggaagagatctataaaactgacctcacagaaatgtagttattttaaataaagacatttctggtttatatgtaatgggtttattgtttttatttttaaattaattatgtatttttaaagttttaatttctaatatggcaaatgctgataattataatcccccttaaacaagaactctttggagtcctcagtaatttttgagtgtgtaaagaggtcctaaaccacaactttaaaaactattgctaacaggtggggggtgctttaccctgttcatggtcagataaagttgcctttcctccccatcctccagtcatgtccagaagcccaaagttacctccaagcagataactctgaccctgcttctcctctaccacagcttgagggtcctctgccttagacagctggatttatctaaaagagaagagcagtcatagatctgtagattttatactggaagtaattgtcatggccttgaatggttccttgctcaggtttctctttctaatatcacattttaggctcctgagcttagcttcttacttattatttggtctgggagtttaggttgatttgtgcagctgaattgttaaattcagaatatatttactgattacttattacatgcagagcacagctctaaatgcaatatcaatctttgcgaaaaggtgttgtcacctaacgagatgtacttcagcttgaaaaatccttatattacagctgtgacaaatagtcaactttacatcaagttggtaaactttacatttgtggcatgtgtatgtgtgagtatgtgtgtgtatgtgtgaatatgatgtcagaagttcaacctattcattaataaacagaatttgctgtaatctgccccccaaccctggcaatatttatagttccctacaaggcaaaatgctttgctcacttttggagcaaagggcatgcaattcatcaatgcatccttttccaagcttgcaaataatgaaatcagtcacttaaagatctcaaaaagttgtaatttaaagcaaaataaagccaggcataggggcttatgcctgtaatcccagcactttgggaagctgaggcaggaggattgcttgaggccaagagtttgaagccagcctggtcaacatagtgacaccctatctctacaaaaataaaaaataaaaaataaataaaataaagtgactaatgcagtgaacctaatgtttaaaatctattttttgtgatataataatgtgaacaagtagtgacttttataatataatttaaaattataatctagaattaaaaagcaaacacatctgtaatagcaccagtatttttgcagtgttacttacatcatctgcttttcattgttttggtcatcgtaattattgtgtcattatccactgaacagttcgtagcagtgttcttgctcataagtgatatagatgaaagccttctactcaggcttttaaaatatattcttatattaatcaaaaataaaattcatgtgcaaaacctaaaaatataattaatgaaaccatacttcaggagaattatggttatttgtgatttttttatgacttgttaatgacacatcagtatgagttgctcatttagccttgattctgccgagttaccagtgaagagcaacaaccccactgctttctctcccactgaaggaaacgctagagttcaagtgggtgtgagttataccaaaaacgacaatgttaactacacttctgtcttggaaaatacttgtttagtgtgttccattactacataactgctactctaatggaatcagaagtatttcttaataaggctctactttcctatatatattatttagaataatatgattgattcaagaaaataaaattgctctcctcgtccctccaggtgttcatctatatcattgtttcacctctctgtggtggatttacatggccaagctgtgtgaagaaataggaaagaagaagttaccattaaccaaggatatgagagaa

SEQ ID NO: 4110 - DNA, 60552 bp, human
gcctcctctgggagcgggcagttggcgaccctgcactgacccgcgtccctccgtcccgagcccgcgcgccctcagagggtgcccggacaggtaaatggagtggggtgcgcctgcgggaggcggggagagaactgcggagggagggcggaggtgtcgatggaaaggtgctggggtggagcgaggaggcagtgcaggggtgacttgggcttctctggtgtcgacagttccagttgtcgggcaggaccagttttggcgaggtgcgtcttatgccactggaaaggcctcgagttaaagagtgtcagaatgcgtcacttaagctgtcattacaggagggaaaaaatgttaactttctctcagtttgtattctacaagacctttctgtagcatttaaatctcttgagatcgccagagtcttctaaaaactctctacgtccttgttcgatgacgtcactttctgcttcaccttctacttctggctgtttatgctccttcgtgggttcctagccccttattcgcccttcctccactgctcagtattgacagtccccttcttcctctgttcagggactgtatttctgcctagacccgtttcctcagcttcagacctgtttggtgtttttattaatggccaatgtttatcaaattctgactgcgtactttggtaaatgctttacatctccgtctcccataactctcacaaccaaccaactgtcttcatttggcctcattaattgctttcaactacctgtatctccattatccctcccttgatcccagaggatacagtcatgtttaggatattaattccctttgaatacctgtggctgagagcagatccattcatacatttaacaaatatttattgaacggctggtatatgcttgacactcttttaagtgcaggggatacagctgtaaacaagacttaggaggttgctactctcaggaacttacatgtttgtgtctagaggggaaaacaggaataatcaggattatgttatatattggttaatgcaaaataaaacaggtggttgacttgaaaggatgggatcctatcctaagaaagtcagaggtcagggcatcgtccagaaagaatagttgtaataccaacaggaataatcttgatctgtaacatgacttttcgtaaacacctcttcttttcccctgtctaagcagtgtttattcttcattcttctatctcctccaaggttattgcatcagaattcatggtttatctgtagttggtttattccttctaagacccagagagaagagtgggggattggattactattagctcaactgctttatcttacttagaaagatagtttggttgtgaaaatattattcttaccaggtccttctgaatataaagttatctaccatttatagtatattttaaaaccaaaatatgctcaatgttcactcatttattcaacagatatttgagggaatattagatggtaggcactgtgctgagcactgggaaaatagggtaaaatagacactttgacctctcttccaaggagaaataatcctaacagtatactgaggaaatttctaaggcataggctgacacctgcattcctgttcttcatccgaggtgagatcatcacaaaacattaagacatttcctgagcaattgcggacattcttagattattcacttattatactttattgcatttatttatatctgtcttccccattgttctatggctccctcaagtataggagtcccttcttccttaactttatacctctagtgtctactttgactgtcatatagtaacccaccagtatatacgtgttgaactgaaatagactccctatttgatcaaatttaaatgacatgatttatacaaggccttctttatgtaaggccatcagccgtattcctcaaccttctcattcaccaaaggtggaccattccatcttatcaggctagcttatgtaccttctttaccttgctctcagtgccttctcttcttccatccatccctcctaaaaggatctcccatctcttcccaagcaccttgtgtacctccctccattaatttggtgggccagttaatttaataatctgctcatgatacaggggtggaaaaaaattaatttcctttttatatttcctatgaaacattctgccaatgaactcttgcaagaattaatgtaatagatcctactgcaataatataatgatacagaatactttttaaagattttgcattgactatcaccatgtgctatgtaatgagttaattctactactttatttgaacagttgtataacctctgttcacacagcatgttttggtatcatttggtttctacttggtagaaacacatctttttttttttttttttttttgagacggagtctcactccgttgcctgggctggagtgcagcggcgcgatctcggctcactgcaacctccgcctcccaggttcaagcaattctcctgcctcagccccctgagtagctgggattacaggtgcacaccaccacgcctgactaatttttttttgtatttttagtagagacgggatttcaccatttttggtcaggctggtctcgaactcctgacctcaggtgatccacctcggcctcccaaagtgctgggattacaggcatgagccaccatgcccggccaagaaacacatctttgagtattactttctcagcctgaggtaatttaagtggtaatgttattctgccacattgtcattttcaggatgtcagataaaagcctcaagtattaaaattaaacttttttttttcttttgagacagagttttgctcttgttacccaggctggagtgcaatggcatgatcttggctcacctcagcctccacttcccgggttcaagcgattctcctgcctcagcctcccaagtagctggaattacaggcgtgcgccaccacgcctggctaattttgtatttttagtagaaacggggtttctccatgttggtcaggctggtctcgaactcctgaccttgggtgatccgcccgcctcagcctcccaaagtgctgggattacaggcatgaaccactgcgcccagccaaaattaaagtcttattccatgcaggtatctttcaattgtaaatcattactgcaaaagacaaattttgtctttataactgattaaaaacaacagcagtacaagagtgcttgagtcatgactgtcgtgaatttaggatgtgccaacctaagatcagccagatacttctaagatgtaaacattaagcattgttattttaggtgatttattgacacctatttctttatagacaggaatgcaagtgcagcactgaattgtgtgccattgctcgtttataagatacacatgtagatgatccagaatattcttatacatttttcagtgttatcaaaatacaaatgcagaattaaaagatttctcaaaacacatggacttggcctttccccttactcagttacctgaaactgtcttcagcctctacttgaagatgcttctgctgaggaggagcattttcatcattgctgttctatgttattaccaaattttttaatacaggcaatttcttacttacaaatggatatattctaaaagtactgttgtaagcttattgtttggaacgctggatgcatttccttctataaataatgctatccatgacatttacactgttatgccaaccagtatcattttattaacttttaatttagtggactcgaagaccttccccacaatttacaataattcctctattaaaaaactgcatttataattctcatttgaattcccttatagcatatctttttttagaaacccaacaactagaacaaaaatatcctttctttagtcccttaacatagtaaaaacaggcttttctaactccaaactgttgtgggtgacccttctagcccttagctctaaggacagtcctccaatatgagcaaggaaaacgaagggacagaggttttagagagggaggcaagttgggtgatatgagtatctggaaagggaagggtaggatttatttgggatgaacagtgagtttctaaaatggaagtttgcattgcttgtcagccttttggctaagatcaggtgtagtatcagtttaaaatgggggtttgttgtgggttgaattgtgtcctccagaaagctgtgttgaagtcctaacccgtggtacctgtgaatgggatcttatttagaaataggatctttgcagatgtaattaagatgtaattgaaaatggggtcatactggagtagagtgggccctttatccaatatgactggcatccatataaaagaagagagacagagagaatgcagtgtgaagacacagatacagagaacaccatgtgactacagaggtaaagattgaagtgctgcacctccaagccaaggaacaccaaggattgccaccaaactatcagaagctagaaagagataaggaaagattctcttctacaggtttcagagggagcataaccctgccaacatcttgattttggacttttaaccctcagaactggtaggcgatacatttctgttgttttaagcaaccaagtttttggtactttattactgcagctacaagaaactaatacaggattcttagcaggaataaagtagaattgggatggtggctgtgggaccaagtggggagtgaataggagaacaaagaggaacagtgttgatatggggctttcctttatgttgcattatctttttttcttcccttctctctctggcttatcttttcattctttttcttcttggatcttatctttatatagcactttatggtttattaggcatttacatactgctaataattagcagagccaggttttctaacttcaagtgcagtgttcattgtgccacaattgtttctgttatcccaatactcatcaagacgttatggattctattacaagacacttacaatgggggcaggtaagacttcataggtgggatttttagcagtatagcagagaggaaggaattcctattagtgacatctggaaggaaagtaaagtttctgttgctatgtacccactgtttaacagtcatttttaagttggggactgcttttattggaagaaacactacttgcgtataacttatattcattgttcctagttatattctgaataatgtgctccctgttccaggtgactgtactttatataaactcaaaaactattgtcatgttccctctaagtcctctctttctcatgttacatatctctagttcctccagccagtcttcagatgacacaatctccatgtctctcacccatattgtattgcctcccttttgtctagtcgttaaatattctacccagaattgaattcagtattttacatatgttctaaccagcacagagtgtaatgggactagtacttaaacaggtcaagacaccctatttcttaatgtactttgagattatgtaagcatttttaagcaatatcgcataccgttggttcataatgaacttacagtccactgaaacactagatctttttgtattaattgttgccaaggtcaagtttccttctgaacctgcacagggactgaggctgctgctactttttcatctctctgttccagggaccatatgatttcttatctctgtttctctttgtgtttttgttcctctctactgtgtctctttgaccctaagcaatgacctccttccttgttataaaatttcactgattgttttacagtcttcattctctttctttcctttcggcttctgggccaccacacttttggctttcccatttggtcctcctcagtctttgtgagtctctatttatctacctttccctcaactgttggttgtgctttgggttttatctttggcactattttttttttctgtatgcaatatatcttcagcaaataaatcatgtttaaaatggcagatctaactgagctcatctgggaataaaagggcacagaatcagtcccggaggaaagtcgacatttagaggtcaggtagaggaggaagagtcagcaagaagacaaaaagagcagccagagatgtaggagcatttcaagaaggagggtcggtcagcagtgttgactgtgcctaagaggtcaagtaaggtaagaatagagaagcaaccactgtattttgcaatatagaggctgttggtgaccttaggaagcatggttttctggagttttaagggcaaaagctggattatagtaagtagaagagttgaaaggaggcagaggagcagagataatgcgtaacgatgctttgaagaaacagaacagggccaggtacggtggctcatgcctgtaatcccagcactttgggaggccaaggcaggtggatcacttgagcccgggagttcaagaccagcctgggtgacatggtgaaaccctgtctgtacaaaaaaaaatacaaaaatagccggacatggtggcacacacctgtagtcccagatactccagaggctgaggtaggaggatcacttgagcctgataagtggaggctgtagtgagccaagattgtgccactgcactctagcctggagcttgggtgacagagcaagaccctgtctcaaaaaaaaaaaaaaaagaaaagaaacagaacagtaggatccacagttagggaggctttaggatcaagggagataaagtataagacagcaatttggaaactataacttactgcatatgtgtaaggagaattctagaaagaagatggttgagatcacaaccctggggaacaacttcagttagagagtaggaatgaaaaagagatccccaaaaggcattcagcccaagagacagatgagcaccttctgctctgtgtgctgtccttccatgctgggattgcaataaggaatctgcacattccttgatctcaaacagtttatagtttgctgttgtgtttcacaaagtatgtttgtgtgaatcacctgcatccagacagacttgtattaaatacagattccagggccctacctcaggcctacggaatcagaatttcaggaagtgatgccaagagtttgaatttttagcaaatgactcatactctgccacacaagatgattcgtattcccactacagtttgagaaccactggtatgttgggtactgagcatgttaacaaataagagtaggtttaacagttaatcgaagactagacaaggatttgttcatctctttttatgtttatgccattaaataagagaagctgggcttgttaggtgggaaataatagcacatattcataggcagacataaggaaaataatcttaaactcatgccatatggttttagtaatgttttgtttatgaagggtcttaccattcctttcttgtggaagctttgagttattttcactttgtttctgttatggataatgcctttatactggcagtgtacagtaaaaggctaagattatgagctctagaaccatactgcctaggtttaaattgcagctccacacttactagctctgtaatttgggggaaattatttaagtcatctgtgcttcagttttctcatctataatagaagtatcataatagtgtataatctcattgagttgtgaggattaaatggattaataattataaagtatttaaaatggtacctggcacatagtaaacaataaatataggctatttttattgttaatagttatctttgtgaatctagagtcttaacttctgttgaactatttctctaggataaattttcaggatggaatttctacattaaagaatgaagacatctttatgtccctttgctatctatagtcattgcttttcaaaagggtgatatctgtttgtgctataataatttgtaaatgcaagctatcaatggtgtgtgtgtgtgtgtatgtgttttgtatgtctctttatatgaatgcatacaagcatggcttaggttgtaagtttgtagaaaactttgaccttctttttaagcctgctcttaagtctgttgttaagtttcatgttatagtgcctcgttagatactatctccaggtagtatgttgataaatgatagtaagttacctttgaaagattatgtcaaagaaatattctaaatctgtgtctttttccttttgatagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaagtgagttctgttctgcatgtggtaagggatgaaagaagggaattctgttactctaatcagaacggtagaaaagtagaaaacaagcttctaggtacataatttgaataagctgacagaatagtaaccttcaccaacttagaaaatatatctggttttgttacttataaatttaacttgtaattattttattctattattgaagtgatattttattttgaagaaagatgaaatgttaaatgtaaaaatgactttgctctagagctgtgtgatatgtgaaaataattcagataagatagataatgttcctttgttcattctttcagtaaatatttactgagcacttaactattgccaggcactttgcttggtgctggggatataacaagatatgtggtatttgccctcataagggttatagtttaatgagggagaaagtcaaatccacgatgtcaagggttggggggatgggaagtagtagataggagaatggtattccaagtagaaggaacagcaggtagagaagtatggaggcatgagatcatagggcgggcatatttagggaactgcagactgttctctgtgactggtgcccaggatggtgaaaataaagctagagagatgggtagaagaaaagtcatgtagggccttgtaggccatattaagagcttggactttaccttgtgggcagtggaaaggcattgaaggttttcagccagggtgtgacagagtcaggtttgttttatttatttatttatttatttatttagaaacagagtctcactctgtcacccaggctggagtgcagtggtgcgatcttggctcactgcaacctccatctcccaggttcagatgattctcgtgccttagcctcctgagtagctgggattacaggcgtgcaccaccatgcccagctaatttttgtatttttagtagagttggggtttcaccatgttggccaggcttgtctcaagctcctgacctcaggtgattcgcctgccttggcctcccaaagcgttgggattacaggcgtgagccactgcccctggcccttcagtcagtttttgctttagaaagatcactctggtggcttattagagtggccatagttgggaaatcttagtaattagttttaaaaagtgcctcaaccttccccgttggcacttaaaaatcttttcttacttaacccagccttacttccttagttcttatctcagaatgaggtccttattactttctatggctaaccccttatacagtttaaggtgtactctaagctactatgagagagacccccaagatacagtattaattttaatgagatagtccagagatgagtggtttgggatgttggggtggctctgccatttccaattccctaattcccaaagcaattagtgctttccacttctggccaaggcagctcctttggtgcttgttatatcccagtgcttgcccagtaattttaaaggcagggcccagaagtggcctgatattgttgagaagcttccacttacatcttactgttcactacacagtcatgtagctagcatagctagaagggaggccaggaattgtcatctctggctatgtagtcgtaggctcaactaaaactctgttactctggaggaagttataggatatcaggggatgacttgcagtcttccagtctactctcctggccacccagatatttcagtgaacctttcttcccaaacatagaatacgcctcttctctgagagaggtagctccaaagacctatctagtcactgtgtttggctccaagtccagcatgtctaggtggtacacagtcctatccatcaggccctggtgtggctcctgtggtccactgaccataaagtaaaagataagtcatatgttttccctgctttcccagcctaacccagtagacaatggtgaaataagaaaaggatcatcacagtgagagttacaaactcccatttggaaaagggaagaatgagaaacatgtagaagtcattgctttccagtaatgatcaaataattgcctcacacaatttcaaagactccctattctgaccaggaagtggttagtggttctgctttcttggaggaactccctcaccctttttccctgactcctggctttgttctccaggaagtttttcctttctggccacatccaaaatggtagttagagagtatatcatctttgggaattgtacccattttgtagtcctcttgctgccagcgtaggtttgtgggcctagaggttaggggttaaataatcttagcttcttatgattttggctttatactttctctaaaaatgtattagacttacagtctttgtgtttctaggcagttcctgggaaaatgtccagggaaagcacatgtagtcgtccttttagaggcaagactgggaaatagggcatatatcttccactcatgtattatgagccagaatttagtcacagccatatgtagctttaagagagtatagaatatgtaatccaattaaaatgcagttatagtagaaggagatgttatctgtctgccatgcctctctgcctgtgtctctgatctagctgtgttatttcgagctttggtacctttttttcatgcttttgttatcttctaggaatgctgttctccccctaagcctccttgtaaacttttgctcactttacaggtcccaagcgaaatactttcttaatttgtactttaatgcttctaaaagggcagttctgatcatattccttccttcaacagatactgtctgccctcaaggtaaaattccttaacgggacttggaatattcttcaagatctgccactttttccttctgtgggctcatcttttactactttagtcctcagttttgctttccagccatacttcatacttagccatttacaattcaatgctaggttctttctctcttcctagcctttgcaatagctgttaccttttactggaatatatttatctacttaattttttaaaaatctcactttgtgtgcctgagcttagatgtttccttttccagaaacccctgaacattaacactgagtcaggcaccgcaatcagacactctttttatgtgtctacatagcatctagtttgttcatattgtaacacttttcacactgtattattattattattattattattattgagacgaagtttcgcttttgttgcccaggctggagtgcaatggcgcaatctcagctcaccgcaacctccacttcctgggttcaagtgattatcctgcctcagcctcccgagtaactgggatgacaggcgtgtgccaccacgcctggctaatttttgtatttttagtagagatggggtttcaccatgttggccaggcaggtctcgaactcctgacctcaggcaatccgcccgcctcggcctcccaaagtgctgggattacaggcatgagccaccgtgcctggcctcagactgtattataattgaaatgattgtttatttctgtaccctgactgtaggcttcttgatggcagggatcataccttgttaccttttgtggcctgtgcaccaagtgacttacaagtctggtttaggagaaacaaattttatggggaaagtgatgactttcattctgggcatgtcatgtttaagctgtctatggtatgtccagttggatatgtctagtagacagtagtgtaggtagtcctggagctcaggagataggtcagatggagatttgggaatcattggcataattgtggtagctgaaaacaaactacaacaaaacatgagagtgcatgctgccctccagggagtaagtaagtgtgaaaaaagcaggaggctaaggaagctagaaaacgttagtgtagagggaaagggactatgatataaaccaggtatattagcctgcttgggctgctataacaaaataccatagactgagtggcttgaacaacagatacttgtttctcacagttctggagactgcgtgaggtgcccgctaattcagttcttgatgagggccttcttcctggctggcagatggccaccttcttgctgtgttctcaggtggtggaaagagagtgatctttttcttcctcttttttaaagccactaatcccatcacgaggaccccaccctcatgacctcatctaatcttaagtgcctcccaaaggccttgtctccaaatatagtcacactgtaacatatgaattttgaaaggacacagttcagtctatagcaccaggcaagcctgatgtcaagaaatctagtgaagataaaacactttccaaaaggaagtggtcaacactatcatatgtttcagagagagccactggatatggcaatgtggaagtcattggtggaaatggtgcaaatagttttagagtattggaggaaaagattttgcctgagttcctgtatctccttgtaattcatgtcagtcctctgtgaacattaatataattcaacaggtacccctatctatccacttgcccaaggtacaaatgtgggaggcaaaatttagttaacctgtctcacgccagtcaccaagttctataaatgctgcctcctatctcttctctgtccctttttctttattacccattctactttagtttatttccctcctcatttcttacccggtatactgcagtagtctcctgtctggtcctcctttgagtcagttttccgcactctagccaatgtgtcctttgttttttttttttttttttttttaatgtgtcctttttaaagtgcaaatctgatcacaccctccctaggctaaaacttttggatgtttattcattattcttaggataatgcacagtgtggtttataaagtcttgtataacctggtttttgcttacttctccagtcttgtctgtccagataattcactttttcttcacattctgtactctagtcatgtgagccaattttactttcctaaatctattaggtgctgttttacctctaggcccttatgcttgctgcttcctctctggaaaaactctttgctcacttttttttgttgttgttgttttttgaaacaaggtctcactttgttacccaggctggagtgcagtggcgcaatctcagcttactacagcctcaacctcctgggttccagcgatcctcctgcctcagcctcccaagtagctgggactataggcgtgtgccaccacacctggctaatttttgtattttgtgtacagacggggttttgccatgttgcccaggctggtcttgaactcctgagctcaagcgatctgcccgcctcagcctcccaaagtgctaggattacaggcatgagccagccaccacgcctggcctttcgctcactctttaccttgccatctgttacttattcttcaggtcttaaatcagacatcacttgttctgggaagtctttctggttaccctttggcaaatctccatttcgtgcctcatctattaatgtgtccccagagcaccatgtactgcctttaactttcctgtcatcctgtttgccatgctgcactgtaattccttacactgtgatccctatgaagactgggacttggtggttttgcttttttgtatcctcagcatccagcacagtaactaactcaaagtggatactcaaatgttgagaatttggtagaaaagatgtttgctttaagaacttaggaaaaagcaaagaaaaccatatggcctattgggggttaatcttaattacatcctcctcctaagatgtcatctcttgttcatgctttaagagtccaattatgcttttgcagctatcgttctaatgggtaatacacatgctgttgtgctatgtagctagaatagagatctttttatttcttatgtacttctatcagtttgacttgaaagaaacaggtatattgggaaggggaagagggagaagagactgtatccgtaagtaatatggtgacattggcagtactgaacgtgcttatacatagatagaagatagaagtaaaagtgatgttgcttataaccacagtaagttttatatcttttattctacagttatttgtttcattacatctgccaagacaggattgtatatctttgtatcactgatgatgtaagtaacttgaagacatattgctatttaactatgtgtactgttaatacagccagttcttaattatctataccaggggtccccaacccccagggctgcagaccggtacaggtctgtggcttgttaggaaccaggccacatagcaggaggtgagtggcctatgagcattaccacctgagttctgcctcctgtcagatcagcagcagcattagattctcatatgagtgtgaaccctgttgtgaactctgcatccgagggatctaaattgcatgctccttaggagaatctaatgcctgatgatctgaggtggaacagtttaatcccgaaaccattcaccctcccccagtccttggaaaaattgtcttctacaaaaccggtccctggtgccaaaaaggttggggactgctgatctgtacctatagtgggcaaacgtgatgcgaactttacatagctggaattgttaatattttgcatttgtcatatagagcagcaaatgttaagaaaacttgatactggggtatgtgcaaatcaactcaattttggtagagttttagcttagcctcttgcaacttctatatttattctattttgtagtgagaattgatgttcataattataattctttgatatcaaaacctctcaaaaattgtttacgtggaatgttaaattagatagcatcatttcttctatcagtagttaatgaatcctttaatgtatgtgaactttggaaaaacaaaattacaatacattatgatcagctatataaacctgtagtttacattggttaggtatgactgtttgtcggctctcagcccaaaattctcagtaacttaatgatgtcattaaggtcctttctcttctctgcttatctccgtgtctccttcttcccagacaggttgccattatggtttcgtagagctacatacttatttattcatgtccggagtagagggactgtgtcttcttgagtgtcttattgtaggaatgaggaagcttttcccagctgcatgccctcccctccccctgctttcaaagtgaacttcctttcatgtcttattggctgcatgctcatttctaaactgcctactggcaaagagacttggaattggcatggttgccatagatcagggttcctaatctttattgtatcacagactcgtcacttgtgggacactcccagaatgtttttgttttctttttttaattttccttttccagaatgcttttaaatgtataaaacacacacaattctaacaaagccaattatattgaaatatatatatatatagtattcaaaatattttaaaaacttgatgtagtaatatatatgcttctttatgaactcattaacaagatctagtcataggtctaataactaatagtcttgatgtgatgggtgttgacagtattttgagatatctgtaactgtgatggtatacaaaaaaagatttctgttggtgacagttacaggtactgtttaatactaccccgattatgaatatacaacctatattcacaattgaaatataagttaacgattgataaaaataatgatgtgattttctttttttctatccaagttcaaaggccccttgaatttggaccattgaccccaatttaagaacccttggcttagactaagcatcttgggtgaaagggaaatgactgtcaaccatagtgatcatcacaatgatttttatctctggcttcacaatattttccaaaagtacgaaaaaatctagctatatgtgaaatgactgatgtgaaacagcttggaatagaaggaaaatactaatgaaatctgggatagttagagtcgagcctcatatttcttgagctataatttgatacacacatatacatgtatacataaacacacatacacacattcatttttttcctctaaggtattcttacagagaacacacatactttttggctggctgggattagacatgagtatgtcacttgatcttttcaaatataccaccactattgaaaaaattcgatttgaagttaatatcagtagtagtatctgtatgtgtgaaagactctatgattattatgggatttattaaacatattcttgtgctgggccttctaatagatcttatgaaatatatggaggaagtaaaattcaattcctgatgtcaagaagttgataacctaggtatcattatcttcagttgtcaatgaccagatatatctggattcattctcagctctttcatttactagttgttggacctttggacaagttagttactttttcagagccttcctttacttatctttaagataggatcaatgctagttcctcctcagataatcattgctcagtaaatgttagctgttttttattgttgttcttaatcactcacatcatctttgtttactttctaaatgtgagttctgtgttgatctcttttcaggattttgaacgttcccgagcctttaattttctgaatgagataaagaagaggttccagactacttacggttcaagagcacagacagcacttccatatgccatgaatagcgagttctcaagtgtcttagctgcacagctggtaagatctttctcaggataaggtattttgatttatatcttcttcattaccttcaaacactatgaatctagggggccctgacctgcaatatagttttctgattgtgttactgtaagccaacataataaaacttccctgattaaaaaaaaaatgtaaaggggccattttagggtagaaaacagtgatagtctttattatctctattaatagtggtcacagtgtctcatgattggaagagcattaaagatcatctagttgaactacccatctgatgcttaaatgtgttcagcatgccaaatgatcttttaaactatacgtaaaccttctacccttccatgagggaaatttaattttctaacaacccaaattaataatttgaaactctcctcatctgtatgaatccctaattgtcagcttagtgaggttttacatgtgaatatacctgtgaaataccactgtacttaagacagcattttaatcaccctaaaagttccctcatatcccttaccagttggtcccctcccctacactttgccccaggcaaccacggatctgttttctatcactataaattagttttgtctttcatagaactttctgtaaatagaatcatacagtatgtaaactttctgtaaatggaatcatacagtatgtacttttttgtgtcttgcttgtttcagtcagtgtaaggctcttgatattcttccatgttgtataaatcagtagtttgttcccctttttgctaagtagtagtatatgcatataccacaatttgtttatccatccacctgttgctggatatttgggttgcttccagttttcagctatcatgaataaagctgctgttaacctccatgtataagtctttgtgtggacatatgtttttatttctctctgataaatacctaggaatggaattgctgggtcatatggtaggtgatgtgtaattgaaaaaaaaaaatcaccacttttttttccaaagtggttgtaccattttatattctcaccagcagttccagtgtctctgcgtccttgccagtacttgatgtggtcttaagttttgccattccagttgatgtgtaatggtatctcattgtggttttaatttatgttttcatgatgtcagacacctttcgaaatgcttcccttttatccatgaaactatttgagtataaagacgtaagctctagctatgattttgttgtgagtttaaaaaaaagctgtattgtaatggaatactttcacttctcctgtggttttaatactctgagtattacatttctaaattttatgcacacacacacacacgcacacacatactcttctggcaataaagtccctttaaattggttacttataaacctttattattcaagcagttggtttgtttcatactccccactaggaaatgttcatctgtgtaaaactgtgtaaaacactacccacaacaaaaataccagtacttagtcaaaagtaaagggtcagctagaaacaaaactttcaaattaaccaatttgtcattagctctagatctgtgtgaccttctgaacaaaatctctacctgttcctttgtctgtaaatagagataatagcatcgtttcatagagttttggggtggattaaataatatcccgtttgaagcacttaacacaatgaaatgactggaacattgtgtattaagcaccccataattgctagctatggataaataatttcaaactatatattatcagtgtcttagattctagatcctgtgagaagccaataaaaatagtttatatgctgtgatcctggcagatacaagaacagattctgagaagctgggccagcccctacctcatcatactcaagaagtggggaacaattttgcagcattctttcccccactgccccaactacagtcttctttttctcctttcttccttgtctgagcacagattatatatcccccccaatctctgccccacaagtcacatgtatatttgatataatgtttatttttattttatttaaaataaggtaatttttagactacatacttatagtttgtatagaagcattttttatgctgcccatattttttcctgggtattgtaacatttttccagtgaagtgacatgtatcttttatatcaatagagacataattttatagcattcctcagtgtaaattgtcattccccttatttttgttttcctattgtaaataatgtctaggtaccataagttaaaacttattttcttatagaagcatcactctgagaataagggcctagacaaagtgatggagactcaagcccaagtggatgaactgaaaggaatcatggtcagaaacataggtatgtttcatggcatagtttcatgcatgtgggcaaaaatgataaagattacttgactggggtcaaattattctagagaagccaaaatagcacttccttattcttaccattggaagttaattgtcagctgagacaactgtgatactgtctgcttgtgcaaatggtttcttctttgtccttgcaactattcttcattctaaatttactagtttgcttaacaagactaatttctaagaaccttatgataattcagcagtttagaataatttggtcagtgtgattgtacagtatttcactgagttaatgtatcacgggttacctaaccttgcctgaattttggacgcataggttctttagcacagtgttagagtgctgttttgcaaccagataaggagcttgctgaagaatgtcaatcaatattgtgcttccttcactgaggccctcttgctatgaaaatgtcaattggactgaacagtatgcttagagacttagtcaaccagttgcaaatactcttaagtaggactgatttagaagtttatcctacagtagtaaccatactgttatatttttgtgcctattatgtttttcttattttcttgagattaattatcaggaatgggattaataatcaaaatgcgcaaacgttttcgtggttcttgatatgtacgtcttggctatttaaagtgatttcctttaattgattttagttttaattatatatctagatagagactagagaatctgttgagacaactactatttatttttattcttttttttgtcaccaaatgtatttattttgcccgaaagtggaggcagacaattgctacaatattatttattgcagatgcataaagtttccagaaaaatcaacgtttttaatcgactccttttaaatgacttatttatttttagagttatagaaacagcaaatttaatccatcttgaattaatttttgtataaggtataaggaagggatccagtttcagctttctacatatggctagccagttttcccagcaccatttattaaatagggaatcctttccccattgcttgtttttcttaggtttgtcaaagatcagatggttgtagatatgtggcgttatttctgagggctctgttctgttccattgatctatatctctgttttggtaccagtaccatgctgttttggttactatagccttgtagtatagtttgaagtcaggtagcatgatgcctccagctttgttcttttggcataggatggacttggtgatgcgggctcttttttggttccatatgaactttaaagtagtttcttccaattctgtgaagaaagtcattggtagcttgatggggatggcattgaatctataaattaccttgggcagtatggccattttcatgatattgattcttcctacccatgaacatggaatgttcttccatttctttgtatcctcttttatttcactgagcagtggtttgtagttctccttgaagtggtccttcacatcccttgtaagttggattcctaggtattttattctctttgaagcaactgtgaatgggagttcactcatgatttgactctctgtccgttattggtgtataagaatgcttgtgatttttgtacattgattttgtatcctgagactttgctgaagttgcttatcagcttaaggggattttgggctgagacaatggggttttctagatatacaatcatgtcatctgcaaatagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttccgtttatatgctggattacatttattgatttgcgtatactgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgattgtagtttgtatttctgtgggatcggtggtgatatcccctttatcatttagacctaaaaccataaaaaccgtagaagaaaacctaggcattaccattcaggacataggcatgggcaaggacttcatgtctaaaacaccaaaagcaatggcaacaaaagccaaaattgacaaatgcgatctaattaaactaaagagcttctgcacagcaaaagaaactactatcagagtgaacagacaacctacaaaataggagaaaattttcacaacctactcatctgacaaagagctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgtgataccatctcacaccagttagaatggcagtcattaaaaagtcaggaaacaacagttactggagaggatgtggagaaataggaacacttttacacagttggtcggactgtaaactagttcaacccttgtggaagtcagtgtggcgattcctcagggatctagaactagaaataccatttgacccagccatcccattactgggtatatacccaaggactataaatcatgccgctataaagacacatgcacacgtatgtttatagcggcagtattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcctcattctcagtaaactatcgcaagaacaaaaaaccaaacaccgcatgttctcactcataggtgagaattgaacaatgagaacacatggacacaggaaggggaacatcacactctggggactgttgtggggtggggggagggggaaggatagctttaggagatatacctaatgctaaatgacgagttaatgggtgcagcacaccagcatggcacatgtatacatatgtaacaaacctgcacattgtgcacatgtaccctaaaacttaaagtataataataataaaataaaataaaaaaagcaaatttaaaatgtgacaagaacattcctagttaattccctttcatttttttaacagcttaattgaaatataattcacatatcatataattcacccatttaaagtatacagtcagtggttactatattcacagaattgtacaaccattgctgcgatcaattttgtaacatttttatcatccctaaatgaagccctgtactcatttgcagttgctcctcaactctcagacctaagcaacaattaattcccttttcttcttcataaatttgcctattctggacatttcgtataaatggaatcttgtaatatgtggccttttgtgtcttcgttcacttagcgtaatgattgtgagattcattcatgtcgtagcataaatcaatacttaattcttttttatgactaataattccaatgcattaatgcattttatgtatctactcattagttcatggtctggttattataaataatgctgctatgaacatttgtgtacaagtttttgtgtgagcatatatatatattatatattatatatatatatatatgtttttggttctcttgcttacatacctaggaatagaattgctggatcacatggcaactttgtaacattttgaagaagggccaaactttcctaaagtgactgcacctttatacattcctaatagcaatgtatgaggattctgattcctccacatccttgccaaaacttatcttttttgattatacccagtctagtgaaatggtactttattgtgattttgatttgcatttccctgatgactaatgatgttgagcattttttcatgtgcttataggccattcgtatattttctttacctttggagaaatgtctatttaaaaatactttattgtttttaagtgggttatttgtctttttatggttgagctataacagtactttatatattctggatactagacccttatcagatacatgattttcaaatattttgctctattctgtgagttgtcttttcattttcttgatggtgttctttgaagcacaacagtttttatgaagtccaatttatttttttctttagtttgtgctttgaataacatatctaagaaactgtcgcctaagccaagatcatgaagatttactactttgttttcttctaagactagttttagctcttacatttctatctatgatctattttgagttaatgtttatgtatggaataaagaagagatccaacttaattctgttgaatatgtatatacagttgttccagaaccatttgctgaaaaggcttttctttccctgttgaatgatcttagcattcttatcaaaaattagttatcaatggatgtatagctttgtttctggaccttcagttctgttcagtttatctttatgccagtaccaggctgtcatgattattatagctttgtagtaggttttaaaatcaggaaatattcatcttccaactttattctttctcaaaattgctttgactattctgggtacctttcattttcatgaactttaggatgagcttgtcaatttcagatagcaaaaaaagctatctgggattttgatagggattgtgttgaatctgtagatcaattagggagccattttaacaatattaaacttctgatccatgaacatgggctttctttctattcatttaggtttctttaattttttccaacaatgttttgtagttttcagtgtgcaagtcttacatgacaaagactctgcttcaccaaattttagacaagctcctctgagcactctgttaaactaggtctcatcctcgggctctgtccttggcctgcctaaggaagtcttagcaaagaatcctgctaataccccacccttgatcaagttccttgtcccctatatttgttatataagtccggccagcttttagcaggaatcctgttaggccagtttagagagaatccccttgcccttgatgcctcctcttagtaattttccatcctctgaccccctcactctgttcattggccacaaatccccactggtcttggttgtgttaggagttgagctcaatctctcccctccattgtgatagccttgacccctattgcagtaatctcaaaatctgccttaccattttttaaccagtgtcagaataatttttctttaacaatatctcttctaacatccttcttgccttgttcctaagtatttttttatgctattgtaaatggaatttttctctttcattttcggattgttcagtactaatgtatagaaattttattgatttttataaattggtgttgtatcatacaaccttgttctcctttattagttctaatagctttttaatagtttccttaggattttctctatatagaatcatgctacttgcaaatagagatagttttaattcttccttttcagtctggatgcttttcatttctttttattgcttatttgccctagctagaacctccagtataatgttgaatagaagtggtaagagtggacatcattgtcttattcctgctcttagggagatcttgaagaatcttccacaattaagtatgaggttagctgtgggtttttcatagatgtcctttatcaggttgaggaagtttctttttcttatttgttgagtggttttatcattaaacagtgttggattttgtcaattttttttacatctattgaaatgatggtttttgttctttattaatatgatgtattataacaattgattttcagatattaaatcaaccttgtgtttctgaaatgaatcccactgcatcatggtgtatagtcctttttgcatattattggattcatcctgccagtagtctgttgaggatttgttaaatgtctgtatttttaagagttgttggtatatcattttcttttatttatttatttattttattatttttttttattgatcattcttgggtgtttctcacagacggggatttggcagggtcatgggacaatagtggagggaagatcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttcttcacagacacagcaaccatccgatttctcaatcttttccccacctttcccccttttctattccacaaaaccgccattgtcatcatggcccgttctcaatgagctattgggtacacctcccagacggggcggctgctgggcggaggggctcctcacttcgcagacggggcggctgccgggtggagggtctcctcacttctcagacagggcggccgggcagcgacgctcctcacctcccagaaggggcggcggggcagaggcgctccccacatctcagacgatgggcggccgggcagagacgctcctcacttcctagatgggatggcggctgggcagagacgctcctcacttcctagatgggatggcggccgggcagagacgctcctcactttccagactgggcagccaggcagaggggctcctcacatcccagacgatgggtgcccaggcagagacgctcctcacttcccagacggggtggcggctgggcagaggctgcaatctcggcactttgggaggccaaggcaggcggctgggaggtggaggttgcagcgagccgagatcgcgccactgcactccagcctgggcaccattgagcactgagtgaacgagactccgtctgcaatcccggcacctcgggaggccgaggctggcggatcactcgcggttagcagctggagaccagcccggccaacacagcgaaaccccgtctccaccaaaaaaatacgaaaaccagtcaggcgtggcagcactcggcaggctgaggcaggagaatcaggcagggaggttgcagtgagccgagatagcagtagtacagtccagcttcggctgggcatcagagggagaccgtggaaagagagggagagggagaccgtggggagagtgagagggggagggggagagggagagggagagccattttcttttcttgtgatgtctttggttttgataccagggtaatgctgggctcatagaatgagtcaagaagtgttccccttttcttctattttggaaagatttgtgaaagttttgtattaattcttgaaatgtttggtagaattcacctttgaagccacctgggcttgggcttttctttgtgtgaagcttttttgtttttgtttttgttttttgagatggggtctgtctgtcacccaggctggagtgcagtgacatgatcctctctaattcctctttcattcccttggtgggagggttacctgcagccttgacctcctgggctcaggtaatcttcccacctcagcctcccaagcagctgggactgcaggcatgtgccaccacacctggctaatttttgttttttggtttttttgtagagacaaggtcttgccatgttgcccaggctagtctcaaactcctgggctcaagcgatccacttgcctcagcctaccaaagtgctaggattacaggcatgagcctccatgcccggcctgaagttttaaaattactgatttagtctctatgcttgctgtagctattcagattttttatttcttcttgagtctgtttagcagtttgtatctttctaggaatttgtgcatttcatctaagttacctaatttatttacacactcctgtttatagaattcccctaagatcctcttcattttgtaagtttggtggtgatgtctcctctttcatttctgattttagtaatgtaagttttttctgttttacttggtcattctacgtaaaggtttgtcaattttattgatctttctaaagaaccaacttctggtttcatagattttttttctatagtttttctgttctctatttaatttgttcaccctaatatttatttccttcccactgctagctttagatttagtttacccttcttttctagatccataaggtagaaagttaagttgttaggttgttaatttgagatcatttgtcttagctcaggctgccataacaaaattccatagacgtagtgacttaaacaacagaaatttattttctcacatttctggaggctagaagtccaagatcacggtgccagtatggtcaggttctggtaagggctctcttcctggcttgcagacagcatcttctctctctgttctcccatcaggcaaggaaaagagagctagctgtctagtgtcttttatttaattgatacataatatttgtacacatttatggggtacgtgtgatattttgttacatgcaaagactgtgtaatgatcaagtcaggatatatggggtgtccatcagctcaagaatttatttctgtgtgatgggaacatttcaaattctctcttctagctattttgaaatatataatacactattgttaactttagtcaccctactctgctatcaaacattagaacttattccttctatccaactgtgtgtttgtacctattaaccatcctctcatattccctgctcggccccacatacccacacccttcctagcctctggtatctattgtgctattgtctacctccatgagatcaactgttttagttcccacatgtgagtaagaacatgtgatatttgtctttccatgcctgccttatatcacttaacataataacctccagttacatccatgttgctgtaaatggcatgacttcattctatttcatggtcaaatagtattccattgtgtttataaaccacattttctttatccattcatccattcatggacacttaggttgactccatatctttgctattgtgaatagggatgcaataaatatgcaagtgcagatatcccgtctatacactgatttcttttcctttgcataaatacccagtagtaggattgctggatcatatggtagtttaatttttagtttttggggaaatctccacactggtttccatagtagctgcactagtttactttcccaccaacagtgtgtaagtgttttttttttttttccttatactagccagcatctgttattttgtatctttttagtaaccattctaactggggtaacatgatatctcattttggcttttatttgcatttctatgatgttgagcattttttcatataccttttggccatttgtatgtcttcttttgagaaatggctattcatgtcctctgcccactttttaaggggattatttgtatatctcctgttgagttcattatatattctggatattattcccttatcaaatgaatagtttgcaactattttctcccattcaactggttgtctcttcactcttgattatttcctttgctgtgcaaaagcttttttgtttaatatagtcctatttgtctatttttcttttcgttacctgtccttttgaggtgttagccataaaatcttttcctagagcagtgttctgaagtgtttcccctatgttttcttctagtaggtttatagttctgggtctgaaatttaagtctttaatctatcttggttgatttttgtatgtgatgagagacagaggtccagtttaattcttccacatatggatatccagttttcccaataccatttattgaagaaagtgtcctttccccagtgtacgtccttggcacctttgttgaaaatcagttgcctatatatgtgtggctgtacatacgtggatcaatgtctggcttttctattctattccatcgaccttgtgtctgtttttataccaaaccatgctgttttggttactgtagccttgtaatatgttttgaagtcaggtagtgtgatgcctccagctttgttcattttgctcaggattgctttggctatttggactcttttttggttcctgaaatactaattttaggattgttttttctgtttctgtgaaaaatgacattggtacttcgatagagattgcattgaatctgtagattgctttgggcttatggtcattttaataatatacattcttatgatccatgaccataagatgtctttctgtatctttgtgtcatcttcagtttttttcatcagtgttttgtagttttacttgtaggagtctttcacctactcgttaaatttattcttcaatattttatatgttcataactattataaatgggattaccttcttgatttcataaagttttatttcaccaagttgattattgatgcatagaaacattacagatatttgtatgttgattctgtatcctgcaactttactgaatatatttatcagatctaggagttttttggtggagtctttgggtcttttagacataagatcatatcatctgcaaagagggataatttgacatcctctttttcaatttggatgccctttatttctttctcttgcctgattgctctggctaggacttccagtattgtgttgaataggagtagtgaaactgggcttccttccagtactatgttgaataggagtggtgagagttttccatttcttagaggaaaggcttttcgtttttcccattccgtatgatgttagctgtgggtttgtcataaatggcctttatcatgttgagggatattccttctatgcctagttttttgagagtttttatcatgaagagatgttgaattttttttgataccttgaactatatatttttatttgaatatataaaagtagaatatcctattttccttttgagctatgtcatcatactgctaaaattatggatgaaaatggaaatatttcaacctgacccattgcaatttctatgttacacatttgctctttttttattattatactttaaattctgggatacatgtgcagaatgtgcagctttgttacataggtatacacatgccatggtggtttgctgcacccattaacccatcatctacattaggtatttctcctaatgctatttctcccctagcccccctacccccaacaggccccagtgtgtgatgttcccctccctgtgtccatgtgttctcattgttcaactcccacttatgagtgagaacacgtggtgtttggttttctgttcctttcttaccttgctgagaatgatggtttccagcttcatccatgtccctgcaaaggacatgaactcctccttttttatggctgcatagtattccatcgtgtatatgtgccacattttctttatccagtctatcattgttgggcatttgggttggttccaagtctttgctattgtgaacagtgctgcaataaacatacgtgtgcatgtgtctttatagtaaaatgatttataatcctttgggtatatacccaataatgggattgctgggtcaaatggtatttctggttctagatccttgaggaatcgccacactgtctttgacaatggttgaactaatttacacttccaccaacagtgtaaaagcattcctattgctccacatcctctccagcatctgttctttcctgacttgttaatgattgccatttaatggtcgccattcttactggtgtgagaggatatctcattatggttttgatttgcatttctctaatgacccgtgatgatgagcttttttttcatatgtttattggccacataaatgtcttcttttgagaagtgtcttttcatatccttcacacactttttgatggggttgtttttttcttgtaaatttgtttaagttccttgtagattccggatattagccctttgtcagatggatagattgcaaaaattttttcccattctgtaggttgcctgttcactctgatgatagtttcttttgctgtgcagaagctctttgctttaattagatcccatttgtcaattttggcttttgttgccattgcttttggtgttttagtcatgaaatctttgcccatacctatgtcctgaatggtattgcccaggttttcttctagggattttatggttttaagtcttatgtttaagtctttaatccatcttgagttaatttttgtataaggtgtaaggaagggggccagtttcagttttctgaatatggctagccagttttcccaacaccatttattaaatagggaatcctttccccattgcttgtttttgtcaggtttgtcaaagatcagatggttgtagatgtgtagcgttatttctgaggcctctgttctgttccattggtctatgtatctgttttggtaccaataccatgctgttttggttactgtagccttgtagtataatttgaagtcaggtagcgtgatgtctccagctttgttcttcttgcttaggattgtcttggctatgtgggctcttttttggttccaaatgaaatttaaagtagtgtttttctaattctgtgaagaaagtcaatggtagctggatggggatagcattgaatctataaattactttgggcagtttggccatattcttcctatccatgagcatggaatgtttttccattcatttgtgtcctctcttatttccttgagcagtggtttgtcattctccttgaagaggtccttcacatcccctgtaagttgtatttctaggtattttattctctttgtagcaattgtgaatgggagttcactcatgatttggctctctgtttgtcttttattggtgtataggaatgcttgtgatttttgcacattgattttgcattctgatactttgctgaagttgcttatcagcttaaggagattttgggctgagacaatggggttttctaaatatacaatcatgtcatctgcaaagagagacaatttgacttcctctcttcctatttgaataccctttatttctttctcttgcctgattgccctggacagaacttccaatactatgttgaataggagtggtgagggagggcatccttgtcttgtgctggttttcaaagggaatacttccagcttttgcccattcagtatgatattggatgtgggtttgtcataaatagttcttattattttgagatgcattccatcaatacctagtttattgagagtttttagcataaagcggtgttgaattttatcgaaggccttttctgcatctattgagataatcatgtggtttttgtcattggttctttttctgtgatggattacgtttattgatttgcgtatgttgaaccagtcttgcatcccagtgatgaagctgacctgatcgtggtggataagctttttgatgtgctgatgggttcgatttgccagtattttattgaggattttcgcatcagtgttcatcagggatattggcctgaaattttcctttttggttgtgtctctgccaggctttggtatcaggatgatgctggcctcataaaatgagttagggaggagtccctcttcttctgttgtttggaatagtttcagaaggaatggtaccagctcctctttatacctctggtggaattcagctgtgaatccttctggtcctggaccttttttgtttggtaggctattaattactgcctcaagttcagaacttgttattgttgtattcagggatttgacttcttcctggttcagtcttgggagggtgtatgtgtccaggaatttatccatttcttccagattttctagtttacttgcatagaggtgtttatagtattctctgatggtagtttgtatttctgtgggatcagtggtgataccccctttatcattttttattgtttctatttgattcttctctcttttctcctttattagtctcgctagcagtctatcaattttgttaatcttttcaaaaaaccagctcctggattcattgattctttttgaagggtttttcatgtctctttctccttcagttctgctctgatcttagttatttcttgtcttctgctacctttgaatttgtttgctcttgcttctctagttcttttaattgtgatgttagggtgttgactttaaatctttcccactttttgctgtgggcatttagtgctataaatttccctctaaatactgctttagctgtgtcccagagattctggtacgttgtgtctttattctcattggtttcaaaaaacttatttatttctgccttaattttgttatttacccagtagtcattcaggaacaggttgttcattttccatgtagttgtgcagttttgagtgagtttcttaatcctgagttctaatttgatggcactgtggtctgagagactgttggttacgatttccattttttgcatttgctgaggagtgttttacttccaattatgtgatcaactttagaataagtgcaatgtggtgctgagaagaatgtatattctgttgatttggcttggagagtactgtagatgtctattaggtcctcttggtccagagctgagttcaagtcctgaatatccttgttaatattctgtctcaatctaatattgacagtgggtgttaaagtctcctactattattgtgtgggagtctgagtctctttgtaggtctgtaagaacttgctttatgaatctgggtgctcctgtattgggtgcatatatatttaggatagttagctcttcttgttgcattgatccctttaccattatgtaatgcccttttttgtcttttttgatctttgttggtttaaagtctgttttatcagagactaggattgcagccactgcttttttttgctttccatttgcttagtaaataatcctctatccctttattttgagcctgtgtgtgtctttgcacatgagatgggtctcctgaatgcagcacatgggtgggtcttgattctttattcaatttgccagtctgtgtcttttatttggggcatttaccccatttacatttaaggttaatattgttatgtgtgaatttgatcctgtgattataatgctagttggttattttgcttgttagtcgatatagtttcttcatagtgttgatggtctttacagtttgatatgtttttgcagtggctggtactggtttttcctttccatatttagtgcttccttcaggacctcttgtaaggcaggcctggtggtgacaaaatctctcagcatttgcatgtctgtaaaggattttatttctccttcacttataaagcttagtttggttggatatgaaattctgggttgaaaattcttttctttaagaatgttgaatattcgcccccagtctcttctggcttgtagggtttctgtcgagagatctgctgttagtctgatgggcttccctttgtgggtagcctgacctttctctctggctgcccttaacattttttcctgcatttcatccttggtgaatctgacgattatgtgtcttggagttgctcttctcgaggagtatctttgtggtgttctctgtatttcccaaatttgaatgttgacctatcttgctaggttggggaagttctcctggttaatatcctaaagaatgttttccaacttggttctgttctccctgtcactttcaagcacaccaatcaaacataggtttggtcttttcatatagtcccatatgtcttggagcctttgttcattccttttcattattttttctctaatcttgtcttcacactttatttcattaagttgatctacaatctctgatatcctttcttccacctgatcagttcggctattgatacttttgtatgcttcacaaagttctcgtgccgtgtttttcagtcccatcaggtcatttatgttcttctctaaactggctattctagttagcaattcctctaaccttttttcaaggtccttagtttccttgcatggggttagaacattctcctttagcttggaggagtttgttattatccaccttctgaagcctgcttctgtcaatttgtcaaactcattctccgtccagtttgttctcttggaattttcagcctttttgcactggtttttcctcatcttcatggatttatctacctttggtctttgatgttggtgacctttggatggggtttctatgtggacatcctttttgttgatgttgatgctattcctttctgtttgttagttttccttctaacaggcctctctgctgcaggtctgctggagtttgttggaggtccactccagacccagtttgcctgggtatcaccagcggaggctgcagaacagcaaagattgctgcctgttccttcctctggaagcttcgtcccagaggggcacctgccagatgccagccagagctctcctgtatgagatgtctgtcgactcctgctgggaggtatcttccagtcaggaggcatggagctcagggacccacttgaggaggcagtctatactttagcagagcttgagcactgtgctgggattgccgctgctctcttccgaactggcaggcaggaacgtttaagtctgctgaaactgagtccacagccaccccttcccccaggtgctcggtcccaaggagatgggagttttatctataagcctctggctggggctgctgcctttctttcagagatgcgctgcccagagaggaggaatctagagaggcagtctggctacagggactttgcggagctgcggtgggctctccccggttcaaacttcctggccactctgtttacacagtgaggggaaaactgcctactcaagcctcagtaatggcagacgcccctccctccaccaagctcgagtgtcccaggtcgacttcagactgttgtgctggcaatgagaatttcaagccagtggatcttagcctgctgggctccgtgggggtggaatatactgagctagaccacttgcctccctggcttcagcccctttccaggcgagtgaacagttatgtctcactggcattccaggcgccactggggtatgaaaaaaaaactcctgcagctagctcggtgtctgcccaaatggccgcccagttttgtgcttgaaacccaggtccctggtggcataggcacccaagggaatctcctggtctgcagattgcgaagactgtgggaaaagcatagtatctgggccagagtgcaccattcctcacggcacggtccctcaaggcttcccttggttaggggagggagttccccgaccccttgtgcttcctggatgaggcaacgccccaccctgcttcggctcaccctccgtgggctgcacccactgtctaaccagtcccaatgagatgagccgggtacctcagttggaaatgcagaaattacccaccttctgcattgatttcactgggagctgcagaccagagctgttcctattcggtcatcttgccaaccaccctgagatgttgaattttatcaaatgctttttttatcagatgctttctctgcatctattaaggtgatcatgtggcttttattctctattctattgatggaatgtttcatgtttattgatttgcatgcattgaatcatcattgcatccctgggataaatcccacttgatcatggtgtattatctttttgatgtgatgtttgatttggtttgctagtatttcgttgaggatttttgcatctgtgatcatcagggttgttggcctgcagttttgtttttttgttgagtccttatcaggttttggtatcagggtaatgctggccttatagaatgagtagggagaattccctcctcttgaattttttggcatagtttgagaagtgatattagttcttctctgtaagtttcatggagttctccagtgaagccagctgattctgggcattgttttggttttgttgggagactttattactgattatactttattactgattcaatcccattactcattactggcttgttcaggttttctatttctttctgattcagtcttggtaggttgcatgtgtcctgggatttatccatttcttctgggttttcaagtttattagcatatagttgttaatagtatttctatggtcacttcttccaatttttagatttgctttaatatgcaaggactttttcttgaggatatatctatggtgttggttgggcagggcacttagactttgattatgggtacattcagtagtgtagtctgtataatttcttcagctataaacagcatcatcaaccatgtctgtatttttcttagtggcttagggtgtagttgttatggaggctgtggtgaagttttgatgggcatggggatttcaggtgggctagtccttgttttcgagtggtgtcaccagtgggtgaagcatgcctgtcctttggccccaggacagtgtattcattaagttatattacttttttaaaaaaagtttattttattctacaatggaaaacttgaccttttctacttttccaatattttcagatctggtagctcagcgaggagaaagattggaattattgattgacaaaacagaaaatcttgtggattctgtaagtatggaatctgataatatggagtctgatgtaaagtggagaaactatggatgatggctaacataattgggaaataccttaaattcaaatatttggtggtttttttttctttctcatttccattatgtgattactttgtaataatgaggataacaatgaggcatagaaaagaaacatcatcccctaatagccattaaggtagctttggtttggaaaacatactcagtatacagaaacaattttctaaagctttggattgaggcctatataatttagcacctcaactgcatgtaacagtctgttccctttacaaatttgtaaaacatgaaacaaatgtgcaagccgtttgtgacccagtatgaatcttgaaaactggacaattcacttttttgcttacactgatagtttcatcttgccttgtatcaatcaagagacatcgattggaaagcgccaataagccttaaaggagacaatgtgtccttgtgagctgcttatactatggttccgtatgtcctcacattttcaatgcagttactgtggatgaaagttttaaggaaagatgacagatatatggtgaacagaaggagggcagagatcagctacaatttgggtctacacaattataaatgtaaatgtacagtgcaggtttacaccttgaaagaaaacagtgattgattatgttcgttgtgactgacagctggattgtagtggttaagaacacaggctctagtatcaggttgcctggatttgaatcccacctctgctacttactagttgtgtgaccttaggcaaatgacttaacctctttgtgcctcagtcatcatcttctgtaaaatgaagatgtacccacttcagagcattttaaggattaaatcagataatgcatgtaaagtgcctaacacagtatttgatacatagtaagagctatttaaatgttcatcattattgttaattttacagggacatctattagcagcaggttttagtatatacagtctactatcaggttttctaggagtttataaacagttttttcatcaaagcatgtggtaggtggaggaaggatgctaccatacaggaagtcaaaacacctgggttctagatctcactttgtgacccattgctggggagcaaagaaaacagagaagtatctgattccagatctgcagaccaatttctttgatacttccaggctgtctcttagttattcttaattcttgaggattaccctgcttagggggaatggtctgtctttgaccaatagtagtatgatctgtactttacaaataaaagtcttaattttgttgacttcatgactgaaaacagaaggtactaatgaactaacaggtatctctctttatggtagaataacatacgtgcagcaaattgtatcaagtgtacaacttttaagtgtatagctcaattattttttatatatatctatacccatgtaaccaccacccagatctagatagaaaacattaccaacaccccagaaggctgcctcataccccttccagttaataatccccaatagacgtaattatgtttctgacttatatcaccacagatagtgttttgcctgttcttaaaatttatttgtgtctggcctctttcactcactgttatgcctgtgaaattcatccacgttttttattatagtaatcacttattcttttttattgttttatattattccattatacaaatctaccacaatttgtttatccgttcttctctgtggggctttatttctggattctctattttgttccattggtcagtttgtctacctttatgccagtaccacactgtgttgattagtataacttaatagaattcttgaaattaagtagtgtaagtcttccaactatattcttgttgtccaatattgtcttcactcttttaggtgctttgcatttccatatatgttttagaataagcttgttttccatctcttgaccccacaacaatgtgtatctttgtgactgcatttaatatataggtcactttaggggacattggtatcttgacagtatagagtttttcggtccatgaacgtgacatatctctgcttttgcttaggatttaaaaatttttctcagcagtattttttagtttttggtgtacaggtcttgcacatatttgttaaatttacccttgagaatatcatgcttttgtattgtgtaacaaatttttaaattttgtttctaattctttattgctagtatatggaaataaagttggttattgtatattgaccttgtttgtattctgcaaccttagaaaaattcatttaccagttctggttactgttttgtacattcctgccttttattttccttcccttattctggctagaaccttctacacaatactgaatacaagtgataacagtgaacatccttgcctattgaccatcttgtggggaaaaattcaatactttttgaaaaaaataaattcagtgttaagtttgtggttaactgtagattttttgtaggtaccctttaataggtggaagaattccctttaattcctcatttgagagttgtattcatgattttatcaaatgctttttctccatttattgagatctttggtttttctcctttattcagttagtatggcaaattacattgatttttcagtgttaaaccaactttgcattcctgcaaggtcatgacttactacccttcttatataacactttattggatttgctattgttttgttcaggaatttggcatctatgtttataagagatagtggtctgtaatttatttttctctttaggttttggtatcaggaatatgctggcctcattaaacaagttgggaaatcttacctctctatcttctgagtttgggtactattggtattatctgtcttagatgtttggaagaatttactagtaaagcagattgggcctcgagttttcttcgttggaaaatttaaaatctgccatcttgctgtttgtttcctatttataccatctagtctttgttccctttttgttctgccttccattggatttagtacatttgttattccattatgtctcctttgtcagtttattagctatagctccattctgtcattttctgattgctttagggtttacagtatgtctttgatttataatctcccttaaagtggcatttttccacttcatgaatagataagaaccttataatagtatacttctagctgtttcttcttggcctttatgctattgttgacatatttttatttacacatgtattaaaaacttcataatacattgttgttgtttttgtttaaagagttgattatcttttaaagagatttaaataataagggaagtcttttctgtttacccatgcagctaccatttcagtgctcttaattcttttgtgtaggccgagtttctatctgatgttattttctttctgcctgtatgctttaatttaacatataatcttccattgtagttcaagtgtgtaggtctactggaaatgaattctttcaggtttggtatgtctgagaagtttttatttcacttcctttttttttttgaaagacattttcactgagtatagaattctaggtcagtgatttttctttcttttaatacttgatgaacggtggttcatcactgtcttttacattgtttctgacaagaattctgctgtcattcttacatacataaagtgtatttttttttcttctggatgctttaaagattttctctttatcattggttttaagaaatttgattataatatatatgccttggtatatatttctttatgtttctttggctttgagtttgttgtagttttcatcaaattatgaaaatgtttagctctttctaggcttccagtgacatctgtattaagccacttgaagctgtcccacaactcactgatgctttgttcatttttaagtcttttttccactatgtttcatttagaatagtttctattgctatgtcttcaagtttacttaccttttcttctgcagttcgcaatctgctgtttctgtcctgtgtatgtttcatctttacaggtttgttttggatcttttttatatcttccatgtgtctccttaacatgtgcatactttcctctaccttgagtatatgaagtatatttataattgaagtgcttattccacttacatgtaatgcaaattttgatagagttaggtgtaggtatcttgctctttgttttttatttgccgcatccctgtcctcttcttttttattttgattactcaagtactttttaaattgttttttaaccatctctatttgttttttaacacttctattgagagataactcacagaccatacaaattgcccatttaaagggtacacttcagtggaatttagtatattacattattaaaattgtggtaaaatatgtatagcataaaattttgccattttaacctttttaaagtgcacaattcagtgatgttaattacatccacaatgttgtgcatccatcactactagctatttccaaaacttttttatcaccccttaacaaaaactctgtaaccattaagtaataataactccccattccccttactctcagcccctggtaactctaatctactttctgtctctgaatttgcctgttctagatatgtcatataagtgggatcatacaaaatttgcccttttgtgtctggcttatttcactaagcataatagtttattgcttaaaaaaaaatgctaacaatcacctgagccttcagtgagccttaatctttttgctggtggagggtctcaccttgatgttgatggctactgactgatcgatcaggctggtggttgctgaaggttgtggtggctgtggcaatttcttaaaataagacaacagtgaagtttaccacattgattgactctttcacaaaagatttctctgtagcatgtgttgctatttgatagcaatttactggcaatagaacttctttcaaaattggagtcaatcctctcaaaccctgctactgctttatcagctgagttgatgtaattttctaaatcttttgttgtcatttcaacagtgttcacagcatcttcaccaggaatagttgccatctcaagaaaccactttccttgcccatgcataagaaacaactcctcattcattaaagttttatcaagaaactgcagcagttcagtcatgtcttcaggctccagttctaattctagttctcttctatttctaccacatctgcagttactcactccactgaagtcttgaacccctcaaagtaatttgtgagggttgtaatcagtttcttccaaacacctgttaatgtttatattttgacttcctcccacgaatcatgaatgttcttaatggcatctagaatggtgaatcctttctagaaggtcttcagtttactttgcccagatccatcagaggaatcattatctatggcagctatactaaatgtttttcttaaataataagacttgaaagttgaaatcactccttgattcatgggcagcagaatggatgttgtattagcaggtgtgaaccccaaaagtctgagacaggtctcagttgatttagaaagtttattttgccaaagttgagagcgcacacccgtgacacagcctcaggaggtcctgacaacatgtgcccaaggtggtcaaagcccagtttggttttatacattctagggagacgtgagacatcagtcaacatatgcaagatgaacattggtttggcctggaaaggcggaacaactcgaagcaaaggcgggaaggctcgaagtggggagggggcctccaggtcttagatagataagagacaaatggttctattcttttgagtttctgatgagcctctccaaaggaggcaatcagatacgcatttatctcagtgagcagaggggtgactttgaatagaatgggaggcaggttggccataagcagttcccagcttgacttttccctttagcttagtgatttggaggccccaagatttattttcctttcacacaggcatgaaaacgacatttatctcctcgtaagtctccatcagagctcttgagtgactaggttcattgtcaatgagcagtaatactttgaaaggaatcttttctttttgagcagcagatctccacagatcttctgtacaccatcctgtaaacagatgtgctatcttccaggtttgttgttccatttcaagagcacaggcagagtatatttagcataattcttacgggccctagattttcagaatggtaaattaccattggcttcagcttaaagtcatcagctgcattggtccctaataaaagtcagcttatcctttgaagctttgaagccagtcattggcttctctctatgaaagtcctagatggcatcttcttccaaaagaagggtgttttgtttacattgaaaaatctgttgtttagtatagccacctttatcaatgatcttagctaggtctcctggataacttactgtggcttctctctcagcacttgctgcttcaccttgtacttttatgttatagagatggcttctttccttaaacctcatgaaccaacttctgctagctttaaacttttcttctgcaccttcctcgcctctctcagccttcatagagttgaagagttagggccttgctctgtattaggctttggcctaaggaaatgttatagctggtttaatcttctatccagacccctaaaacattctccatatcagcagtaagtctgttttgctttcttatatgtgtgttcactggagtagcactcctgatttccttcaagaactgttctttgcattcacaatttggttaactgtttgtcacaggacacctagctttaggcccatctcagctttcgacatgccttactcactaagcttaattatttttatcttttgatttaaagcaagggatgtgtgacttttcctttcacttgaatacatagatgccattgtaaggttattaattggccaaatttcaatattgtgtctcggcaaatagggaggcctgagagggagagagataagagaatagctggtcagtgaacagttagaacacacaacatttatccgttagctccgtcaccttatataggcacagtttatggcacccgaaaacaatcacaatagtaacatcagaggtcacagatcgtcataacagatagaatgaaaataatgaaaagtttgaaatgttataagaattaccaaaacacagacatgaggcgaccacatgctgttagaaaaatggtgctgccgcatgttctcactcctaagtgggagttgaacaatgagaacacatggacacagtgaggggaacatcacacactggggcctgtcggggagtgggggctaggggagggatagcattaggagaaatacctaatgtagataacgggttgatgggtacagcaaaccaccatgtcacgtgtatacctgtgtaagaaacctgcacgttctgcacatgtatcctagaacttaaagtataataataataataaaaagaaacaaaaagtgcaggccaagcaggaaaaaaaaaaaacaaaccagaaaaatggtgctgatagtctcatcatggggtttccacagaccttcgatttgccaaaaaaaaaaaaaaaaaaaaaaaaaaatccatgaagtgcgataatgtgaagtacaataaaaggggatatgcctgtaattctttctgtgtcctttattgttttcctgcagttctgtttcagtgtacgattttgtttgcttcaaactgaagaagttcttttattgtttcttataatgttgatctactgatgagagattctctaagcttttgtctgaaaatctgtttcatcatttttttaaagaatactttctttgcatagagttttttagtttttcacaatggcagtttttttttttttttaaagtgagtgctttaaaaatgccattccatttttctttggctttcatatgttctcaaagagattgtcatttctcttagtcttacttgaaaaataatgattcttaccccacctttggcttttgttgttgttgttgttgttgtttgttttgtttttttaagacagagtctctctctctcacccaggctggagtgcagtggcacgatcacagcttactgttgcctccacctcccaggctcaagtgatcctcctgccttgcctcagcctcccaagtaggaggaccacaggcatgcgccatcacacttagctaattttttaaatttttcttagagacgggtctccctatgttgctctggctggtctcaaatgcccaggctcaagtgatcctcccaccttggcttcccaaagtgctggaaatacaggcatgagccaccacacctggccccctttggctggttttaagagtgtctttttatatttggttttcaactttttatatatggttattagctttctgtggctgctatcacaaattatcacaaacttggtggcttaaaacaacaaaaatttattttctcccactactggatttcagaagttcaaaatcagtttaactgggctgaaattaaggtgttagcaaggctacactccttccagaggctctaggagaggatctgttccatgcctcttccagcttcaggtggctgccagtatttcttggcttgtggctatatcattgtagtctctgcctccatgttcacattaccttctcctttgcatgtgtgtcaagcctccatctactttcctcctatagagacatttgtgatgtcatttagggctcacatggataatccaggatactctcttcatctcaagattcttgacataatcacatctgtaaagaccccttttccagataatatcacatatgtcacattcatagggattaggacacaggcatgtcttagggcaacatttaacaattgttctttataggtgaacttgttttaaacagatggtttgtcagtgttcagatgttgacctgagagtggtggaggaatctccattacaacctgttgaatcacacagctatgttcggatttattagtttcattcctcactgctttttctcatctacatcatctttctctttcttgaattatttattgtgaattagtctttgtttgtagtatatcctcacacattttcttcatatgagtttgtggatgataatcccttcaagaataaaagtgttattttggtctcatatttgaacaattttttgactggtgtagaattctagggttaagatcattttctctcaaaattctctgaatattgctgcatttcagtgcatgaagaatttaggcatctgagaagttcaacaactatacagtttacacgttttttatttgggccaagtttgaggactgcaacccaggagcatagattcaagttgctctgaatatatgttctaattagcagcagttacaagtaggtttttaaaggaaaaaaggagaggcagtatctaatttgtttaccaagaatttacattaaaatagcataagctattgattgctatacattgtcctttgtatcacaaattccaggaacatgaagataatggttgaggcagctagtcagcaacaaattgcctttaaacagttgccccccctgggcattgtgtggggggtgtgactgaagtccccatactcatgtcttctgggcctgataaattttatatacctcacatagctcaggctgctctgagctgtttttcttttctcatttcccccttttgatcaaaatttttctcttctgaaagcattgatgatcagcattttagatataagtttatcccatgtcactggggaggcttattcccagatattcttgtcccgtgttggatggaaagacgtaaaaaaggtaccatggcttaaagaacttagtgaggtctcaaggccaaattgattggcaacacagaggagcagagcaacaggatctcagtcaagccatccactcacgctggagccatggcatgaacaactatacagtttactcaagtccaccctcacttaatggcaccaactgcaagtttggggattccccaaaccaccctcagatttgatagttcattagaaggatttataatactctgtgagcactattatactcacagttatggtttattacaggcaaattatacatagtaagaccagccaagggaaaaagtacatagggtggagtttgggaagataccaaatgtagagcttttgttgtcctcttcccatggagtcaggacacgttgctctcttggcatcagtgtgtgacaaaatgtgcagagcattgcctaacaggaaagcttacccaagccttagtgttcagagtttttattggggtttcattatgtaggcattattgactgactgccctctggcttgatctcagtctccagctccacttggtgtgatccaaagcctcctaaatcacatagtcattttttctggagtgtcttttccccaccctaaatcacattgttactatctagattacagtctattagaaaaataaatcaaggctgtgcatggtagctcatacctataatcctaatacttatactttgggaggccaaagctgaaagatctctaaaatccagaagttcaagaccagcctaggcaacaaagtgagaccttatctctacaaaaccaaacaaaaaaaaaaaaaaaataggtgtgattgggtgcacctgtagtcctagctacttggggggctgaagatggagaattgcttgaacccaggaattcagagctgcagagagctatgatcacaccactgcattccaggctgggttacagaggggtgacctccatctcaaaaaaaaaaaaattttttttcttttaattcttttttattttttattttttttataaatatatatattttttattatactttaagttctagggtacatgtgcacaacgtgcaggtttgttacatatgtaaacatgtgccgtgttggtgtgctgcacccattaactcatcatttacattaggtatatctccaaatgctatcccttccccctcccaccaccccacaacaggccccggtgtgtgatgttccccttcctgtgtccaggtgttctcattgttcagttcccacctatgagtgagaacatgtggtgtttggttttttgtccttgcagtagtttgctgagaatgatggtttccagcttcatccatgtccctgcaaaggacatgaactcatccttttttacggctgcgtagtatttcatagtgtatacgtgccacattttctgaatccagtctatcattgttggacatttgggttggttccaggtctttgctattgtgaatagtgccacgataaacatacgtgtgcatgtgtcttgatagcagcatgatttataatcctttgggtatatacccagtaatgggatggctgggtcaaatggtatttctacttctagatccctgaggaatcgccacactgtctttcacagtggttgaactagtttacagtcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgccatcttttgagaagtgtctgttcatatccttcacccacttgttgatggggttgtttgtttcttttcttataaatttgtttgagttctttgtagaatctggatattagccctttgtcagatgagtagattgcaaaacttttctcccactctgtaggttgcctgttcactctgatggtagtttcttttgctgtgcagaagctccttaattagatcccatttgtcaattttggcttttgtttccattgtttttggtgttttagatatgaagtccatgcccatgcctatgtcctcaatggtattacctaggttttcttctagggtttttatggttttaggtctaacatttaagtctttaatccatcttgaattaattttagtataaggtgtaaggaagggatccagtttcagctttctccatatggctagccagttttcccagcaccatttgttaaatagggaatcctttccccatttcttctttttgtcaggtttgtcaaagatgacatggttgtagatgtgtggtattacttctgagggctctgttctgttccattggtctatatctctgttttggtaccagtaccatgctgttttggttactgtagccttgcagtatagtttgaagtcaggtagcatgatgcctacagttttgttcttttggcttaggattgacttggcaatgcaggctcttttttggctccacatgaactttaaagtagttttttccaattcagtgaagaaagtcattggtagcttgatagggatggcattgaatctataaattaccttgggcagtatggccattttcatgatattgattcttcctatccatgagcatggaatgttcttccatttgtttgtgtcctcttttatttcgctgaacagtagtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacgttgatttcgtatcaagactttgctggagttgcttatcagcttaaggagattttgggctgagataatggggttttctagatatacaatcatgtcatctgcaaacagggacaatttgatttcctcttttcataattgaataccctttatgtctttctcttgcctgattgccctggccagaacttccaacactatgttgaataggagtggtgagagagggcatccctatcttgtgccagttttcaaagggaatgcttccggtttttgcccattcagtatgatattggctgtgggtttgtcatagctcttattattttgaaatacgtcccatcaatacctaatttattgagagtttttagcatgaagggctgttgaattttgtcaaaggccttttctgcatctattgagatgatcgtgtgttttttgtctttggttctgtttatatgctggattacatttattgatttgtatatgttgaaccagccttgcatcccagggatgaagcccacttgatcatggtagataagctttttgatgtgctgctggattcgatttgccagtattttattgaagatttttgcgtcggtgttcattagggatattggtctaaaattctctttttgtgttgtgtctctgccaggcttaggtatcaggatgatgctggcctcataaaatgagttagggaggattccctcattttctattgataggaatagtttcagaaggaatggtgtcagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtcaaggaatttatccatttcttctagattttctagtttatttgtgtagaggtgtttgtagtattctctgatggtagtttgtatttctgtgggatcggtggtgatatccccttttatcattttttattgcgtctatttgattcttctctcttttcttctttattagtcttgctagcagtctatcaattttgttgatcttttcaaaaaaccagctcctggattcattgatttcttgaagggttttttgtgtctctatctcgttcagttctgctctgagttatttcttgccttctgctagcttttgaatgtgtttgctcttgttcctctagttcttttaattgtgatgttagggtgtcaattttatatctttcctgcttccttttgtgggcatttagtgctataaatttccctctacacactgctttaaatgtgtcccagagattctggtatgttgtgtctttgttctcattggtttcaaagaacatgtttatttctgcattcatttcgttatgtacccagtagtcattcaggagcaggttgttcagtctccatgtagctgagcagttttgagtgagtttcttaatcttgagttctaatttgatttcactgtggtctgagagacagtttgttataatttctgttcttttacatttgctgaggagtgctttacttccaactatgtggtcaattttggaataagtgcgatgtggtgctgagaagaatgtatattctgttgatttggggtggagagttctgtagatgtctgttaggtccgcttggtgcagagctgagttcaattcctggatatccttgttaactttctgtctcattgatctgtctaatgttgacagtggggtgttaaagtctccctttattattgtatgggagtctaagtctctttgtaggtctctaaggacttgctttatgaatctgggtcctcctgtattgggtgcataaatatttaggatagttagctcttcttgttgaattgatccctttaccattatgtaatggccttctttgtctcttttgatccttgctagtttaaagtctgttttatcagagactaggattgcaacccctgcctttttttgttttccatttgcttggtagatcttcctgcatccctttattttgagcctatgtgtgtctctgcacatgagatggatttcctgaatacagcacactgatgggtctttactctttatctaatttgccagtctgtgtcttttaattggagcatttagcccatttacatttaaggttgatactgttatgtgtgaatttgatcctgtcattatgatgctagctggttattttgctcgttagttgatgcagtttcttcctagccttgatggtctttacaatttggcatgtttttccagtggctggtatgtgttgttcctttccatgtttagtgcttccttcaggagctcttgtaaggcaggcctggtggtgacaaaatctctcagcatttgcttgtctgtaaaggattttatttttccttcacctatgaagcttagtttggctggatatgaaattctgggttgaaaattcttttctttaagaattttggatattggcccccactctcttctggcttgtagagtttctgccgagagatcagctgttagtctgatgggcttccctttgtgggtaacccgacctttctctctggctgcccttaacattttttccttcatttcaactttggtgatctgacaattatgtgtctcggagttgctcttctcgaggagtatctttgtggcgttctctgtatttcctgaatttgaatgttggcctgccttgctaggttggggaagttctcctggctaatatcctgcagagtgttttccaacttggttccattctccccatcactttcaggtacaccaatcagacgtagatttggtcttttcacatagtcccatatttcttggaggcttttttcgtttctttttattcttttttctctaaacttctcttctcgcttcatttcattcatttggtcttcaatcacggataccctttcttccagttgttcgaatcggctactgaagtttgtgcattcgtcacttagttctcgtgccatggttttcagctccatcaggtcatttaaggacttgtctacattggttattctagttagccattcatctaatctttttttcaaggtttttagcttctttgtgctgggttcaaacttcctcctttagctcagagaagtttgatcatctgaagccttcttttctcaactcgtcaaagtcattctctgtctacctttgttctgttgctggtgaggagctgcgttcctttggaggaggagaggcgctctgatttttagaattttcagtttttctgctgtttttttccctatctttgtggttttatctacctttggtctttgatgatggtgacatacagatggggtttttgtgtggatgtcctttctgtttgttagttttccttctaacagtcaggaccctcagctgcaggtctgttggagtttgtcggagggccactccagaccctgtttgcctgggtatcagcagcggaggctgcagaacagtgaatattgctgaacaccaaatgttgctctctgatcgttcctctggaggttttgtctcagaggggtacccgccgtgtgaggtgtcagtctgcctctactggggggtacctcccagttaggctgcttgggggtcagggacccacttgaggaggcagtctgtctgttctcagatctcaaactctgtcctgggagaaccactactctcttcaaagctgtcagacagggacatttaagtttgcagaggtttctgctgccttttgttcagctatgccctgcccccagaggtggagtctacagaggcaggcaggcctccttgagctgtggtgggctccacccagttcgagcttcccggcagctttgtttacctactcaagcctcagcaatggcgggcgcctctcctccagcctcgctgccaccttgcagttcaatctcagactgctgtgctagcaatgagtgaggctccgtgggtgtgggaccctctgagccaggcgcgggatataatctcctggtgtgctgtttgctaagaccgttggaaaagcgcagtattagggtgggagtgatccgattttccaggtgccatctgtcacagcttcccttggctaggaaagggaattccctgaccccttgtgcttcccgggtgaggcgatgtctcgccctgcttcggctcacgctcggtgggctgcacccactgtccaacaagccccagtgagatgaagccggtatctcagttggaaatgcagaaatcatccgtcttgtgcgttgctcacgctgggggctgtagactggagctgttcctatttggccatcttggaacaggaatcaaaggaaattttttaaaaatcccatttatgatagcatcaaaaagagtacaatagttaggaataaatttaaccaaggatgtaataatgtgcacactgaaaattataaaacattgatgaaagaaattcaagaagacacaaatcaatggaaagataccttatgtttatggattggaagaatcaatattattaaaatgttcatactgcctgaagcaatacacagattcaacacaatccctattgaaattccaatggcatttttcacagaatagaaaaaaaaattctaaaatgtggatgaaactagaagacattatattaagtgaaatatactagacacagatagataaatactgtatgatttcacttatatatggaatctaaaaaaaatgttcagttcataaaagcagagagtaaaacagtggttgacagtgggtgggagacctggagagatgttggtcaaagtgtatgaacttacagttgtaagatgaataagttctggataccggacatacagcatggcaactatagttaataataatgtattgaatatttgaaatatgctataagaatagatcttaagcattctcaccacatacccaaaaaagtaactatgtgaggtgatggatattttacttagcttgattgtggtaataatttcacaatgtgtacatttatcagaatatcacattgtataccttgaatatataccatttttatttgccaattatacttcaaggcagaaaaaaataaaattagagtagaaacaaaagcttggaggtctgaaatgttactaaaagtgtaacattttccttttttcaatattcttgccacatggtgggtaggtccttttagtctgaagattcaagtctgtcttatttgggggatattttcttcaattagtcccttgattattgatccttctcttttggctgtattctctcctgtgactgctaataggtgtgtaaatcagtaccaggcacataataagcacatgttaaatatctgttgatcgtataaattgatcctggatttgcttgatcagttttccgtgtatcttacatcttctttcatgatttacaacctagacattttgctgttttcagaacaaattttttgaattgttactgcagaagctgcttttgctcatttatgttctgcttttaaaaaattatgccattttattaaaatatagtttttggaatgttgtcatgttatctaattttttatgtcctctgatgactttgtttaaaattagttcaattatgtcttgtatctgaggatacttattagaaatttttttattactgttattctatcttgtttcccatattaactttgttccattaaggactgtttgtccccattgctttttttgtctcctcactttaactgctgtttcttctcaaaagttctagtcaatgcatatattctattcaacatatatatttagctctagatgtaatcagttttggtatgtgcctccaggtggcatcctgtgcagtcttcatgaagtgaaacccaaagactggtgcccctgtcagttgttctactgcagagactttgtggagtatgtggttggagatgaatctatggttaagggagtggattttttaaaaccaatatgtgaagtataatatacataaagtgcatcaactgtaagcatacaacttgttgtgttttcacaaagtaaacataccatgtagaaccaacacccagattaagaactagagcacgaacagtaccccagaagctcccttctcccttcttttagtcactactcttctccaaaggtggccactgtcctgatttctccacatagattaataaaacatagcaggggccgagagtggtggcacacacctatagtcccagctactcaggaggctgaggtgggaggatcgtttgagcccaggaggtcaaagctgcagtgagtcgtaattgtgccactgcactccagcttgggcgacagagcaagaccctgtctcaagataaataataaaatatagcaggtattctgtttatgtcaagtttctattgctcaaaatgatgtttgtgagattcatctgtggtaaattgtataaatgtagtagtagattgtgaattgtcattactgtattgtattccatgttatgactctcctgtaatttatgcattgcacagttgatgggcatttgggtggtttccagtttaaggtatgaaaagtagtgctgtccaaaacatttttttatatgtcttttggtgaatttgcatacatctgtgggaccataccagagtggattgctggattattagggagttttgttggttggttgtttgccattttgttttaaactccttgtgtcctggtgggaattgttcagtagatactgagaaattgatgatgcaaaagaaaatggatagcagaaggaatgaagttctatgggttttggccctcacaaaagtaaatacatatcttcctacagaaatcaaacaggtttttatggctcaaagccccggaattatacggggcagaataggcgaatgtgcttgcagtcagctggctttaaaagagcctttcttattggaagtatagagaggaaaattcttttccactagcgggaagaaccacttctggtgctcaacatcatgtgcattgctgcagtggagaagaaaaaagagggaagcgttttcattgggctcatactgcttatgataggcctggcagagtcttgcttttggcaactattgagtatgaatggccagtctctacttgtaaagagaggtcattggacttaaatggaattaatggaagtaaaatgttctcaggttgttactgcaaatcattcatgtagtcagtgccaggggttaaacaattctcgcctcttttctagtctgtcaccttcaaaactaccagcagaaatcttgctcgagccatgtgtatgaagaacctcaagctcactattatcatcatcatcgtatcaattgtaagtttttgtccttttagtgtatggctttatttttcaatctctaagaaattaggtactagaattatttctcaatgattaacactctgaaatgagctacatatgtcttttaatagtgaaacacatgaccaggcagtggctttcctatgaagtcactatgaaatatctctacttaaacccctccttcctattgagaattattatatattctcaataggaagagatctataaaactgacctcacagaaatgtagttattttaaataaagacatttctggtttatatgtaatgggtttattgtttttatttttaaattaattatgtatttttaaagttttaatttctaatatggcaaatgctgataattataatcccccttaaacaagaactctttggagtcctcagtaatttttgagtgtgtaaagaggtcctaaaccacaactttaaaaactattgctaacaggtggggggtgctttaccctgttcatggtcagataaagttgcctttcctccccatcctccagtcatgtccagaagcccaaagttacctccaagcagataactctgaccctgcttctcctctaccacagcttgagggtcctctgccttagacagctggatttatctaaaagagaagagcagtcatagatctgtagattttatactggaagtaattgtcatggccttgaatggttccttgctcaggtttctctttctaatatcacattttaggctcctgagcttagcttcttacttattatttggtctgggagtttaggttgatttgtgcagctgaattgttaaattcagaatatatttactgattacttattacatgcagagcacagctctaaatgcaatatcaatctttgcgaaaaggtgttgtcacctaacgagatgtacttcagcttgaaaaatccttatattacagctgtgacaaatagtcaactttacatcaagttggtaaactttacatttgtggcatgtgtatgtgtgagtatgtgtgtgtatgtgtgaatatgatgtcagaagttcaacctattcattaataaacagaatttgctgtaatctgccccccaaccctggcaatatttatagttccctacaaggcaaaatgctttgctcacttttggagcaaagggcatgcaattcatcaatgcatccttttccaagcttgcaaataatgaaatcagtcacttaaagatctcaaaaagttgtaatttaaagcaaaataaagccaggcataggggcttatgcctgtaatcccagcactttgggaagctgaggcaggaggattgcttgaggccaagagtttgaagccagcctggtcaacatagtgacaccctatctctacaaaaataaaaaataaaaaataaataaaataaagtgactaatgcagtgaacctaatgtttaaaatctattttttgtgatataataatgtgaacaagtagtgacttttataatataatttaaaattataatctagaattaaaaagcaaacacatctgtaatagcaccagtatttttgcagtgttacttacatcatctgcttttcattgttttggtcatcgtaattattgtgtcattatccactgaacagttcgtagcagtgttcttgctcataagtgatatagatgaaagccttctactcaggcttttaaaatatattcttatattaatcaaaaataaaattcatgtgcaaaacctaaaaatataattaatgaaaccatacttcaggagaattatggttatttgtgatttttttatgacttgttaatgacacatcagtatgagttgctcatttagccttgattctgccgagttaccagtgaagagcaacaaccccactgctttctctcccactgaaggaaacgctagagttcaagtgggtgtgagttataccaaaaacgacaatgttaactacacttctgtcttggaaaatacttgtttagtgtgttccattactacataactgctactctaatggaatcagaagtatttcttaataaggctctactttcctatatatattatttagaataatatgattgattcaagaaaataaaattgctctcctcgtccctccaggtgttcatctatatcattgtttcacct

SEQ ID NO: 4111 - DNA, 58419 bp, human
cgggcagttggcgaccctgcactgacccgcgtccctccgtcccgagcccgcgcgccctcagagggtgcccggacaggtaaatggagtggggtgcgcctgcgggaggcggggagagaactgcggagggagggcggaggtgtcgatggaaaggtgctggggtggagcgaggaggcagtgcaggggtgacttgggcttctctggtgtcgacagttccagttgtcgggcaggaccagttttggcgaggtgcgtcttatgccactggaaaggcctcgagttaaagagtgtcagaatgcgtcacttaagctgtcattacaggagggaaaaaatgttaactttctctcagtttgtattctacaagacctttctgtagcatttaaatctcttgagatcgccagagtcttctaaaaactctctacgtccttgttcgatgacgtcactttctgcttcaccttctacttctggctgtttatgctccttcgtgggttcctagccccttattcgcccttcctccactgctcagtattgacagtccccttcttcctctgttcagggactgtatttctgcctagacccgtttcctcagcttcagacctgtttggtgtttttattaatggccaatgtttatcaaattctgactgcgtactttggtaaatgctttacatctccgtctcccataactctcacaaccaaccaactgtcttcatttggcctcattaattgctttcaactacctgtatctccattatccctcccttgatcccagaggatacagtcatgtttaggatattaattccctttgaatacctgtggctgagagcagatccattcatacatttaacaaatatttattgaacggctggtatatgcttgacactcttttaagtgcaggggatacagctgtaaacaagacttaggaggttgctactctcaggaacttacatgtttgtgtctagaggggaaaacaggaataatcaggattatgttatatattggttaatgcaaaataaaacaggtggttgacttgaaaggatgggatcctatcctaagaaagtcagaggtcagggcatcgtccagaaagaatagttgtaataccaacaggaataatcttgatctgtaacatgacttttcgtaaacacctcttcttttcccctgtctaagcagtgtttattcttcattcttctatctcctccaaggttattgcatcagaattcatggtttatctgtagttggtttattccttctaagacccagagagaagagtgggggattggattactattagctcaactgctttatcttacttagaaagatagtttggttgtgaaaatattattcttaccaggtccttctgaatataaagttatctaccatttatagtatattttaaaaccaaaatatgctcaatgttcactcatttattcaacagatatttgagggaatattagatggtaggcactgtgctgagcactgggaaaatagggtaaaatagacactttgacctctcttccaaggagaaataatcctaacagtatactgaggaaatttctaaggcataggctgacacctgcattcctgttcttcatccgaggtgagatcatcacaaaacattaagacatttcctgagcaattgcggacattcttagattattcacttattatactttattgcatttatttatatctgtcttccccattgttctatggctccctcaagtataggagtcccttcttccttaactttatacctctagtgtctactttgactgtcatatagtaacccaccagtatatacgtgttgaactgaaatagactccctatttgatcaaatttaaatgacatgatttatacaaggccttctttatgtaaggccatcagccgtattcctcaaccttctcattcaccaaaggtggaccattccatcttatcaggctagcttatgtaccttctttaccttgctctcagtgccttctcttcttccatccatccctcctaaaaggatctcccatctcttcccaagcaccttgtgtacctccctccattaatttggtgggccagttaatttaataatctgctcatgatacaggggtggaaaaaaattaatttcctttttatatttcctatgaaacattctgccaatgaactcttgcaagaattaatgtaatagatcctactgcaataatataatgatacagaatactttttaaagattttgcattgactatcaccatgtgctatgtaatgagttaattctactactttatttgaacagttgtataacctctgttcacacagcatgttttggtatcatttggtttctacttggtagaaacacatctttttttttttttttttttttgagacggagtctcactccgttgcctgggctggagtgcagcggcgcgatctcggctcactgcaacctccgcctcccaggttcaagcaattctcctgcctcagccccctgagtagctgggattacaggtgcacaccaccacgcctgactaatttttttttgtatttttagtagagacgggatttcaccatttttggtcaggctggtctcgaactcctgacctcaggtgatccacctcggcctcccaaagtgctgggattacaggcatgagccaccatgcccggccaagaaacacatctttgagtattactttctcagcctgaggtaatttaagtggtaatgttattctgccacattgtcattttcaggatgtcagataaaagcctcaagtattaaaattaaacttttttttttcttttgagacagagttttgctcttgttacccaggctggagtgcaatggcatgatcttggctcacctcagcctccacttcccgggttcaagcgattctcctgcctcagcctcccaagtagctggaattacaggcgtgcgccaccacgcctggctaattttgtatttttagtagaaacggggtttctccatgttggtcaggctggtctcgaactcctgaccttgggtgatccgcccgcctcagcctcccaaagtgctgggattacaggcatgaaccactgcgcccagccaaaattaaagtcttattccatgcaggtatctttcaattgtaaatcattactgcaaaagacaaattttgtctttataactgattaaaaacaacagcagtacaagagtgcttgagtcatgactgtcgtgaatttaggatgtgccaacctaagatcagccagatacttctaagatgtaaacattaagcattgttattttaggtgatttattgacacctatttctttatagacaggaatgcaagtgcagcactgaattgtgtgccattgctcgtttataagatacacatgtagatgatccagaatattcttatacatttttcagtgttatcaaaatacaaatgcagaattaaaagatttctcaaaacacatggacttggcctttccccttactcagttacctgaaactgtcttcagcctctacttgaagatgcttctgctgaggaggagcattttcatcattgctgttctatgttattaccaaattttttaatacaggcaatttcttacttacaaatggatatattctaaaagtactgttgtaagcttattgtttggaacgctggatgcatttccttctataaataatgctatccatgacatttacactgttatgccaaccagtatcattttattaacttttaatttagtggactcgaagaccttccccacaatttacaataattcctctattaaaaaactgcatttataattctcatttgaattcccttatagcatatctttttttagaaacccaacaactagaacaaaaatatcctttctttagtcccttaacatagtaaaaacaggcttttctaactccaaactgttgtgggtgacccttctagcccttagctctaaggacagtcctccaatatgagcaaggaaaacgaagggacagaggttttagagagggaggcaagttgggtgatatgagtatctggaaagggaagggtaggatttatttgggatgaacagtgagtttctaaaatggaagtttgcattgcttgtcagccttttggctaagatcaggtgtagtatcagtttaaaatgggggtttgttgtgggttgaattgtgtcctccagaaagctgtgttgaagtcctaacccgtggtacctgtgaatgggatcttatttagaaataggatctttgcagatgtaattaagatgtaattgaaaatggggtcatactggagtagagtgggccctttatccaatatgactggcatccatataaaagaagagagacagagagaatgcagtgtgaagacacagatacagagaacaccatgtgactacagaggtaaagattgaagtgctgcacctccaagccaaggaacaccaaggattgccaccaaactatcagaagctagaaagagataaggaaagattctcttctacaggtttcagagggagcataaccctgccaacatcttgattttggacttttaaccctcagaactggtaggcgatacatttctgttgttttaagcaaccaagtttttggtactttattactgcagctacaagaaactaatacaggattcttagcaggaataaagtagaattgggatggtggctgtgggaccaagtggggagtgaataggagaacaaagaggaacagtgttgatatggggctttcctttatgttgcattatctttttttcttcccttctctctctggcttatcttttcattctttttcttcttggatcttatctttatatagcactttatggtttattaggcatttacatactgctaataattagcagagccaggttttctaacttcaagtgcagtgttcattgtgccacaattgtttctgttatcccaatactcatcaagacgttatggattctattacaagacacttacaatgggggcaggtaagacttcataggtgggatttttagcagtatagcagagaggaaggaattcctattagtgacatctggaaggaaagtaaagtttctgttgctatgtacccactgtttaacagtcatttttaagttggggactgcttttattggaagaaacactacttgcgtataacttatattcattgttcctagttatattctgaataatgtgctccctgttccaggtgactgtactttatataaactcaaaaactattgtcatgttccctctaagtcctctctttctcatgttacatatctctagttcctccagccagtcttcagatgacacaatctccatgtctctcacccatattgtattgcctcccttttgtctagtcgttaaatattctacccagaattgaattcagtattttacatatgttctaaccagcacagagtgtaatgggactagtacttaaacaggtcaagacaccctatttcttaatgtactttgagattatgtaagcatttttaagcaatatcgcataccgttggttcataatgaacttacagtccactgaaacactagatctttttgtattaattgttgccaaggtcaagtttccttctgaacctgcacagggactgaggctgctgctactttttcatctctctgttccagggaccatatgatttcttatctctgtttctctttgtgtttttgttcctctctactgtgtctctttgaccctaagcaatgacctccttccttgttataaaatttcactgattgttttacagtcttcattctctttctttcctttcggcttctgggccaccacacttttggctttcccatttggtcctcctcagtctttgtgagtctctatttatctacctttccctcaactgttggttgtgctttgggttttatctttggcactattttttttttctgtatgcaatatatcttcagcaaataaatcatgtttaaaatggcagatctaactgagctcatctgggaataaaagggcacagaatcagtcccggaggaaagtcgacatttagaggtcaggtagaggaggaagagtcagcaagaagacaaaaagagcagccagagatgtaggagcatttcaagaaggagggtcggtcagcagtgttgactgtgcctaagaggtcaagtaaggtaagaatagagaagcaaccactgtattttgcaatatagaggctgttggtgaccttaggaagcatggttttctggagttttaagggcaaaagctggattatagtaagtagaagagttgaaaggaggcagaggagcagagataatgcgtaacgatgctttgaagaaacagaacagggccaggtacggtggctcatgcctgtaatcccagcactttgggaggccaaggcaggtggatcacttgagcccgggagttcaagaccagcctgggtgacatggtgaaaccctgtctgtacaaaaaaaaatacaaaaatagccggacatggtggcacacacctgtagtcccagatactccagaggctgaggtaggaggatcacttgagcctgataagtggaggctgtagtgagccaagattgtgccactgcactctagcctggagcttgggtgacagagcaagaccctgtctcaaaaaaaaaaaaaaaagaaaagaaacagaacagtaggatccacagttagggaggctttaggatcaagggagataaagtataagacagcaatttggaaactataacttactgcatatgtgtaaggagaattctagaaagaagatggttgagatcacaaccctggggaacaacttcagttagagagtaggaatgaaaaagagatccccaaaaggcattcagcccaagagacagatgagcaccttctgctctgtgtgctgtccttccatgctgggattgcaataaggaatctgcacattccttgatctcaaacagtttatagtttgctgttgtgtttcacaaagtatgtttgtgtgaatcacctgcatccagacagacttgtattaaatacagattccagggccctacctcaggcctacggaatcagaatttcaggaagtgatgccaagagtttgaatttttagcaaatgactcatactctgccacacaagatgattcgtattcccactacagtttgagaaccactggtatgttgggtactgagcatgttaacaaataagagtaggtttaacagttaatcgaagactagacaaggatttgttcatctctttttatgtttatgccattaaataagagaagctgggcttgttaggtgggaaataatagcacatattcataggcagacataaggaaaataatcttaaactcatgccatatggttttagtaatgttttgtttatgaagggtcttaccattcctttcttgtggaagctttgagttattttcactttgtttctgttatggataatgcctttatactggcagtgtacagtaaaaggctaagattatgagctctagaaccatactgcctaggtttaaattgcagctccacacttactagctctgtaatttgggggaaattatttaagtcatctgtgcttcagttttctcatctataatagaagtatcataatagtgtataatctcattgagttgtgaggattaaatggattaataattataaagtatttaaaatggtacctggcacatagtaaacaataaatataggctatttttattgttaatagttatctttgtgaatctagagtcttaacttctgttgaactatttctctaggataaattttcaggatggaatttctacattaaagaatgaagacatctttatgtccctttgctatctatagtcattgcttttcaaaagggtgatatctgtttgtgctataataatttgtaaatgcaagctatcaatggtgtgtgtgtgtgtgtatgtgttttgtatgtctctttatatgaatgcatacaagcatggcttaggttgtaagtttgtagaaaactttgaccttctttttaagcctgctcttaagtctgttgttaagtttcatgttatagtgcctcgttagatactatctccaggtagtatgttgataaatgatagtaagttacctttgaaagattatgtcaaagaaatattctaaatctgtgtctttttccttttgatagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaagtgagttctgttctgcatgtggtaagggatgaaagaagggaattctgttactctaatcagaacggtagaaaagtagaaaacaagcttctaggtacataatttgaataagctgacagaatagtaaccttcaccaacttagaaaatatatctggttttgttacttataaatttaacttgtaattattttattctattattgaagtgatattttattttgaagaaagatgaaatgttaaatgtaaaaatgactttgctctagagctgtgtgatatgtgaaaataattcagataagatagataatgttcctttgttcattctttcagtaaatatttactgagcacttaactattgccaggcactttgcttggtgctggggatataacaagatatgtggtatttgccctcataagggttatagtttaatgagggagaaagtcaaatccacgatgtcaagggttggggggatgggaagtagtagataggagaatggtattccaagtagaaggaacagcaggtagagaagtatggaggcatgagatcatagggcgggcatatttagggaactgcagactgttctctgtgactggtgcccaggatggtgaaaataaagctagagagatgggtagaagaaaagtcatgtagggccttgtaggccatattaagagcttggactttaccttgtgggcagtggaaaggcattgaaggttttcagccagggtgtgacagagtcaggtttgttttatttatttatttatttatttatttagaaacagagtctcactctgtcacccaggctggagtgcagtggtgcgatcttggctcactgcaacctccatctcccaggttcagatgattctcgtgccttagcctcctgagtagctgggattacaggcgtgcaccaccatgcccagctaatttttgtatttttagtagagttggggtttcaccatgttggccaggcttgtctcaagctcctgacctcaggtgattcgcctgccttggcctcccaaagcgttgggattacaggcgtgagccactgcccctggcccttcagtcagtttttgctttagaaagatcactctggtggcttattagagtggccatagttgggaaatcttagtaattagttttaaaaagtgcctcaaccttccccgttggcacttaaaaatcttttcttacttaacccagccttacttccttagttcttatctcagaatgaggtccttattactttctatggctaaccccttatacagtttaaggtgtactctaagctactatgagagagacccccaagatacagtattaattttaatgagatagtccagagatgagtggtttgggatgttggggtggctctgccatttccaattccctaattcccaaagcaattagtgctttccacttctggccaaggcagctcctttggtgcttgttatatcccagtgcttgcccagtaattttaaaggcagggcccagaagtggcctgatattgttgagaagcttccacttacatcttactgttcactacacagtcatgtagctagcatagctagaagggaggccaggaattgtcatctctggctatgtagtcgtaggctcaactaaaactctgttactctggaggaagttataggatatcaggggatgacttgcagtcttccagtctactctcctggccacccagatatttcagtgaacctttcttcccaaacatagaatacgcctcttctctgagagaggtagctccaaagacctatctagtcactgtgtttggctccaagtccagcatgtctaggtggtacacagtcctatccatcaggccctggtgtggctcctgtggtccactgaccataaagtaaaagataagtcatatgttttccctgctttcccagcctaacccagtagacaatggtgaaataagaaaaggatcatcacagtgagagttacaaactcccatttggaaaagggaagaatgagaaacatgtagaagtcattgctttccagtaatgatcaaataattgcctcacacaatttcaaagactccctattctgaccaggaagtggttagtggttctgctttcttggaggaactccctcaccctttttccctgactcctggctttgttctccaggaagtttttcctttctggccacatccaaaatggtagttagagagtatatcatctttgggaattgtacccattttgtagtcctcttgctgccagcgtaggtttgtgggcctagaggttaggggttaaataatcttagcttcttatgattttggctttatactttctctaaaaatgtattagacttacagtctttgtgtttctaggcagttcctgggaaaatgtccagggaaagcacatgtagtcgtccttttagaggcaagactgggaaatagggcatatatcttccactcatgtattatgagccagaatttagtcacagccatatgtagctttaagagagtatagaatatgtaatccaattaaaatgcagttatagtagaaggagatgttatctgtctgccatgcctctctgcctgtgtctctgatctagctgtgttatttcgagctttggtacctttttttcatgcttttgttatcttctaggaatgctgttctccccctaagcctccttgtaaacttttgctcactttacaggtcccaagcgaaatactttcttaatttgtactttaatgcttctaaaagggcagttctgatcatattccttccttcaacagatactgtctgccctcaaggtaaaattccttaacgggacttggaatattcttcaagatctgccactttttccttctgtgggctcatcttttactactttagtcctcagttttgctttccagccatacttcatacttagccatttacaattcaatgctaggttctttctctcttcctagcctttgcaatagctgttaccttttactggaatatatttatctacttaattttttaaaaatctcactttgtgtgcctgagcttagatgtttccttttccagaaacccctgaacattaacactgagtcaggcaccgcaatcagacactctttttatgtgtctacatagcatctagtttgttcatattgtaacacttttcacactgtattattattattattattattattattgagacgaagtttcgcttttgttgcccaggctggagtgcaatggcgcaatctcagctcaccgcaacctccacttcctgggttcaagtgattatcctgcctcagcctcccgagtaactgggatgacaggcgtgtgccaccacgcctggctaatttttgtatttttagtagagatggggtttcaccatgttggccaggcaggtctcgaactcctgacctcaggcaatccgcccgcctcggcctcccaaagtgctgggattacaggcatgagccaccgtgcctggcctcagactgtattataattgaaatgattgtttatttctgtaccctgactgtaggcttcttgatggcagggatcataccttgttaccttttgtggcctgtgcaccaagtgacttacaagtctggtttaggagaaacaaattttatggggaaagtgatgactttcattctgggcatgtcatgtttaagctgtctatggtatgtccagttggatatgtctagtagacagtagtgtaggtagtcctggagctcaggagataggtcagatggagatttgggaatcattggcataattgtggtagctgaaaacaaactacaacaaaacatgagagtgcatgctgccctccagggagtaagtaagtgtgaaaaaagcaggaggctaaggaagctagaaaacgttagtgtagagggaaagggactatgatataaaccaggtatattagcctgcttgggctgctataacaaaataccatagactgagtggcttgaacaacagatacttgtttctcacagttctggagactgcgtgaggtgcccgctaattcagttcttgatgagggccttcttcctggctggcagatggccaccttcttgctgtgttctcaggtggtggaaagagagtgatctttttcttcctcttttttaaagccactaatcccatcacgaggaccccaccctcatgacctcatctaatcttaagtgcctcccaaaggccttgtctccaaatatagtcacactgtaacatatgaattttgaaaggacacagttcagtctatagcaccaggcaagcctgatgtcaagaaatctagtgaagataaaacactttccaaaaggaagtggtcaacactatcatatgtttcagagagagccactggatatggcaatgtggaagtcattggtggaaatggtgcaaatagttttagagtattggaggaaaagattttgcctgagttcctgtatctccttgtaattcatgtcagtcctctgtgaacattaatataattcaacaggtacccctatctatccacttgcccaaggtacaaatgtgggaggcaaaatttagttaacctgtctcacgccagtcaccaagttctataaatgctgcctcctatctcttctctgtccctttttctttattacccattctactttagtttatttccctcctcatttcttacccggtatactgcagtagtctcctgtctggtcctcctttgagtcagttttccgcactctagccaatgtgtcctttgttttttttttttttttttttttaatgtgtcctttttaaagtgcaaatctgatcacaccctccctaggctaaaacttttggatgtttattcattattcttaggataatgcacagtgtggtttataaagtcttgtataacctggtttttgcttacttctccagtcttgtctgtccagataattcactttttcttcacattctgtactctagtcatgtgagccaattttactttcctaaatctattaggtgctgttttacctctaggcccttatgcttgctgcttcctctctggaaaaactctttgctcacttttttttgttgttgttgttttttgaaacaaggtctcactttgttacccaggctggagtgcagtggcgcaatctcagcttactacagcctcaacctcctgggttccagcgatcctcctgcctcagcctcccaagtagctgggactataggcgtgtgccaccacacctggctaatttttgtattttgtgtacagacggggttttgccatgttgcccaggctggtcttgaactcctgagctcaagcgatctgcccgcctcagcctcccaaagtgctaggattacaggcatgagccagccaccacgcctggcctttcgctcactctttaccttgccatctgttacttattcttcaggtcttaaatcagacatcacttgttctgggaagtctttctggttaccctttggcaaatctccatttcgtgcctcatctattaatgtgtccccagagcaccatgtactgcctttaactttcctgtcatcctgtttgccatgctgcactgtaattccttacactgtgatccctatgaagactgggacttggtggttttgcttttttgtatcctcagcatccagcacagtaactaactcaaagtggatactcaaatgttgagaatttggtagaaaagatgtttgctttaagaacttaggaaaaagcaaagaaaaccatatggcctattgggggttaatcttaattacatcctcctcctaagatgtcatctcttgttcatgctttaagagtccaattatgcttttgcagctatcgttctaatgggtaatacacatgctgttgtgctatgtagctagaatagagatctttttatttcttatgtacttctatcagtttgacttgaaagaaacaggtatattgggaaggggaagagggagaagagactgtatccgtaagtaatatggtgacattggcagtactgaacgtgcttatacatagatagaagatagaagtaaaagtgatgttgcttataaccacagtaagttttatatcttttattctacagttatttgtttcattacatctgccaagacaggattgtatatctttgtatcactgatgatgtaagtaacttgaagacatattgctatttaactatgtgtactgttaatacagccagttcttaattatctataccaggggtccccaacccccagggctgcagaccggtacaggtctgtggcttgttaggaaccaggccacatagcaggaggtgagtggcctatgagcattaccacctgagttctgcctcctgtcagatcagcagcagcattagattctcatatgagtgtgaaccctgttgtgaactctgcatccgagggatctaaattgcatgctccttaggagaatctaatgcctgatgatctgaggtggaacagtttaatcccgaaaccattcaccctcccccagtccttggaaaaattgtcttctacaaaaccggtccctggtgccaaaaaggttggggactgctgatctgtacctatagtgggcaaacgtgatgcgaactttacatagctggaattgttaatattttgcatttgtcatatagagcagcaaatgttaagaaaacttgatactggggtatgtgcaaatcaactcaattttggtagagttttagcttagcctcttgcaacttctatatttattctattttgtagtgagaattgatgttcataattataattctttgatatcaaaacctctcaaaaattgtttacgtggaatgttaaattagatagcatcatttcttctatcagtagttaatgaatcctttaatgtatgtgaactttggaaaaacaaaattacaatacattatgatcagctatataaacctgtagtttacattggttaggtatgactgtttgtcggctctcagcccaaaattctcagtaacttaatgatgtcattaaggtcctttctcttctctgcttatctccgtgtctccttcttcccagacaggttgccattatggtttcgtagagctacatacttatttattcatgtccggagtagagggactgtgtcttcttgagtgtcttattgtaggaatgaggaagcttttcccagctgcatgccctcccctccccctgctttcaaagtgaacttcctttcatgtcttattggctgcatgctcatttctaaactgcctactggcaaagagacttggaattggcatggttgccatagatcagggttcctaatctttattgtatcacagactcgtcacttgtgggacactcccagaatgtttttgttttctttttttaattttccttttccagaatgcttttaaatgtataaaacacacacaattctaacaaagccaattatattgaaatatatatatatatagtattcaaaatattttaaaaacttgatgtagtaatatatatgcttctttatgaactcattaacaagatctagtcataggtctaataactaatagtcttgatgtgatgggtgttgacagtattttgagatatctgtaactgtgatggtatacaaaaaaagatttctgttggtgacagttacaggtactgtttaatactaccccgattatgaatatacaacctatattcacaattgaaatataagttaacgattgataaaaataatgatgtgattttctttttttctatccaagttcaaaggccccttgaatttggaccattgaccccaatttaagaacccttggcttagactaagcatcttgggtgaaagggaaatgactgtcaaccatagtgatcatcacaatgatttttatctctggcttcacaatattttccaaaagtacgaaaaaatctagctatatgtgaaatgactgatgtgaaacagcttggaatagaaggaaaatactaatgaaatctgggatagttagagtcgagcctcatatttcttgagctataatttgatacacacatatacatgtatacataaacacacatacacacattcatttttttcctctaaggtattcttacagagaacacacatactttttggctggctgggattagacatgagtatgtcacttgatcttttcaaatataccaccactattgaaaaaattcgatttgaagttaatatcagtagtagtatctgtatgtgtgaaagactctatgattattatgggatttattaaacatattcttgtgctgggccttctaatagatcttatgaaatatatggaggaagtaaaattcaattcctgatgtcaagaagttgataacctaggtatcattatcttcagttgtcaatgaccagatatatctggattcattctcagctctttcatttactagttgttggacctttggacaagttagttactttttcagagccttcctttacttatctttaagataggatcaatgctagttcctcctcagataatcattgctcagtaaatgttagctgttttttattgttgttcttaatcactcacatcatctttgtttactttctaaatgtgagttctgtgttgatctcttttcaggattttgaacgttcccgagcctttaattttctgaatgagataaagaagaggttccagactacttacggttcaagagcacagacagcacttccatatgccatgaatagcgagttctcaagtgtcttagctgcacagctggtaagatctttctcaggataaggtattttgatttatatcttcttcattaccttcaaacactatgaatctagggggccctgacctgcaatatagttttctgattgtgttactgtaagccaacataataaaacttccctgattaaaaaaaaaatgtaaaggggccattttagggtagaaaacagtgatagtctttattatctctattaatagtggtcacagtgtctcatgattggaagagcattaaagatcatctagttgaactacccatctgatgcttaaatgtgttcagcatgccaaatgatcttttaaactatacgtaaaccttctacccttccatgagggaaatttaattttctaacaacccaaattaataatttgaaactctcctcatctgtatgaatccctaattgtcagcttagtgaggttttacatgtgaatatacctgtgaaataccactgtacttaagacagcattttaatcaccctaaaagttccctcatatcccttaccagttggtcccctcccctacactttgccccaggcaaccacggatctgttttctatcactataaattagttttgtctttcatagaactttctgtaaatagaatcatacagtatgtaaactttctgtaaatggaatcatacagtatgtacttttttgtgtcttgcttgtttcagtcagtgtaaggctcttgatattcttccatgttgtataaatcagtagtttgttcccctttttgctaagtagtagtatatgcatataccacaatttgtttatccatccacctgttgctggatatttgggttgcttccagttttcagctatcatgaataaagctgctgttaacctccatgtataagtctttgtgtggacatatgtttttatttctctctgataaatacctaggaatggaattgctgggtcatatggtaggtgatgtgtaattgaaaaaaaaaaatcaccacttttttttccaaagtggttgtaccattttatattctcaccagcagttccagtgtctctgcgtccttgccagtacttgatgtggtcttaagttttgccattccagttgatgtgtaatggtatctcattgtggttttaatttatgttttcatgatgtcagacacctttcgaaatgcttcccttttatccatgaaactatttgagtataaagacgtaagctctagctatgattttgttgtgagtttaaaaaaaagctgtattgtaatggaatactttcacttctcctgtggttttaatactctgagtattacatttctaaattttatgcacacacacacacacgcacacacatactcttctggcaataaagtccctttaaattggttacttataaacctttattattcaagcagttggtttgtttcatactccccactaggaaatgttcatctgtgtaaaactgtgtaaaacactacccacaacaaaaataccagtacttagtcaaaagtaaagggtcagctagaaacaaaactttcaaattaaccaatttgtcattagctctagatctgtgtgaccttctgaacaaaatctctacctgttcctttgtctgtaaatagagataatagcatcgtttcatagagttttggggtggattaaataatatcccgtttgaagcacttaacacaatgaaatgactggaacattgtgtattaagcaccccataattgctagctatggataaataatttcaaactatatattatcagtgtcttagattctagatcctgtgagaagccaataaaaatagtttatatgctgtgatcctggcagatacaagaacagattctgagaagctgggccagcccctacctcatcatactcaagaagtggggaacaattttgcagcattctttcccccactgccccaactacagtcttctttttctcctttcttccttgtctgagcacagattatatatcccccccaatctctgccccacaagtcacatgtatatttgatataatgtttatttttattttatttaaaataaggtaatttttagactacatacttatagtttgtatagaagcattttttatgctgcccatattttttcctgggtattgtaacatttttccagtgaagtgacatgtatcttttatatcaatagagacataattttatagcattcctcagtgtaaattgtcattccccttatttttgttttcctattgtaaataatgtctaggtaccataagttaaaacttattttcttatagaagcatcactctgagaataagggcctagacaaagtgatggagactcaagcccaagtggatgaactgaaaggaatcatggtcagaaacataggtatgtttcatggcatagtttcatgcatgtgggcaaaaatgataaagattacttgactggggtcaaattattctagagaagccaaaatagcacttccttattcttaccattggaagttaattgtcagctgagacaactgtgatactgtctgcttgtgcaaatggtttcttctttgtccttgcaactattcttcattctaaatttactagtttgcttaacaagactaatttctaagaaccttatgataattcagcagtttagaataatttggtcagtgtgattgtacagtatttcactgagttaatgtatcacgggttacctaaccttgcctgaattttggacgcataggttctttagcacagtgttagagtgctgttttgcaaccagataaggagcttgctgaagaatgtcaatcaatattgtgcttccttcactgaggccctcttgctatgaaaatgtcaattggactgaacagtatgcttagagacttagtcaaccagttgcaaatactcttaagtaggactgatttagaagtttatcctacagtagtaaccatactgttatatttttgtgcctattatgtttttcttattttcttgagattaattatcaggaatgggattaataatcaaaatgcgcaaacgttttcgtggttcttgatatgtacgtcttggctatttaaagtgatttcctttaattgattttagttttaattatatatctagatagagactagagaatctgttgagacaactactatttatttttattcttttttttgtcaccaaatgtatttattttgcccgaaagtggaggcagacaattgctacaatattatttattgcagatgcataaagtttccagaaaaatcaacgtttttaatcgactccttttaaatgacttatttatttttagagttatagaaacagcaaatttaatccatcttgaattaatttttgtataaggtataaggaagggatccagtttcagctttctacatatggctagccagttttcccagcaccatttattaaatagggaatcctttccccattgcttgtttttcttaggtttgtcaaagatcagatggttgtagatatgtggcgttatttctgagggctctgttctgttccattgatctatatctctgttttggtaccagtaccatgctgttttggttactatagccttgtagtatagtttgaagtcaggtagcatgatgcctccagctttgttcttttggcataggatggacttggtgatgcgggctcttttttggttccatatgaactttaaagtagtttcttccaattctgtgaagaaagtcattggtagcttgatggggatggcattgaatctataaattaccttgggcagtatggccattttcatgatattgattcttcctacccatgaacatggaatgttcttccatttctttgtatcctcttttatttcactgagcagtggtttgtagttctccttgaagtggtccttcacatcccttgtaagttggattcctaggtattttattctctttgaagcaactgtgaatgggagttcactcatgatttgactctctgtccgttattggtgtataagaatgcttgtgatttttgtacattgattttgtatcctgagactttgctgaagttgcttatcagcttaaggggattttgggctgagacaatggggttttctagatatacaatcatgtcatctgcaaatagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttccgtttatatgctggattacatttattgatttgcgtatactgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgattgtagtttgtatttctgtgggatcggtggtgatatcccctttatcatttagacctaaaaccataaaaaccgtagaagaaaacctaggcattaccattcaggacataggcatgggcaaggacttcatgtctaaaacaccaaaagcaatggcaacaaaagccaaaattgacaaatgcgatctaattaaactaaagagcttctgcacagcaaaagaaactactatcagagtgaacagacaacctacaaaataggagaaaattttcacaacctactcatctgacaaagagctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgtgataccatctcacaccagttagaatggcagtcattaaaaagtcaggaaacaacagttactggagaggatgtggagaaataggaacacttttacacagttggtcggactgtaaactagttcaacccttgtggaagtcagtgtggcgattcctcagggatctagaactagaaataccatttgacccagccatcccattactgggtatatacccaaggactataaatcatgccgctataaagacacatgcacacgtatgtttatagcggcagtattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcctcattctcagtaaactatcgcaagaacaaaaaaccaaacaccgcatgttctcactcataggtgagaattgaacaatgagaacacatggacacaggaaggggaacatcacactctggggactgttgtggggtggggggagggggaaggatagctttaggagatatacctaatgctaaatgacgagttaatgggtgcagcacaccagcatggcacatgtatacatatgtaacaaacctgcacattgtgcacatgtaccctaaaacttaaagtataataataataaaataaaataaaaaaagcaaatttaaaatgtgacaagaacattcctagttaattccctttcatttttttaacagcttaattgaaatataattcacatatcatataattcacccatttaaagtatacagtcagtggttactatattcacagaattgtacaaccattgctgcgatcaattttgtaacatttttatcatccctaaatgaagccctgtactcatttgcagttgctcctcaactctcagacctaagcaacaattaattcccttttcttcttcataaatttgcctattctggacatttcgtataaatggaatcttgtaatatgtggccttttgtgtcttcgttcacttagcgtaatgattgtgagattcattcatgtcgtagcataaatcaatacttaattcttttttatgactaataattccaatgcattaatgcattttatgtatctactcattagttcatggtctggttattataaataatgctgctatgaacatttgtgtacaagtttttgtgtgagcatatatatatattatatattatatatatatatatatgtttttggttctcttgcttacatacctaggaatagaattgctggatcacatggcaactttgtaacattttgaagaagggccaaactttcctaaagtgactgcacctttatacattcctaatagcaatgtatgaggattctgattcctccacatccttgccaaaacttatcttttttgattatacccagtctagtgaaatggtactttattgtgattttgatttgcatttccctgatgactaatgatgttgagcattttttcatgtgcttataggccattcgtatattttctttacctttggagaaatgtctatttaaaaatactttattgtttttaagtgggttatttgtctttttatggttgagctataacagtactttatatattctggatactagacccttatcagatacatgattttcaaatattttgctctattctgtgagttgtcttttcattttcttgatggtgttctttgaagcacaacagtttttatgaagtccaatttatttttttctttagtttgtgctttgaataacatatctaagaaactgtcgcctaagccaagatcatgaagatttactactttgttttcttctaagactagttttagctcttacatttctatctatgatctattttgagttaatgtttatgtatggaataaagaagagatccaacttaattctgttgaatatgtatatacagttgttccagaaccatttgctgaaaaggcttttctttccctgttgaatgatcttagcattcttatcaaaaattagttatcaatggatgtatagctttgtttctggaccttcagttctgttcagtttatctttatgccagtaccaggctgtcatgattattatagctttgtagtaggttttaaaatcaggaaatattcatcttccaactttattctttctcaaaattgctttgactattctgggtacctttcattttcatgaactttaggatgagcttgtcaatttcagatagcaaaaaaagctatctgggattttgatagggattgtgttgaatctgtagatcaattagggagccattttaacaatattaaacttctgatccatgaacatgggctttctttctattcatttaggtttctttaattttttccaacaatgttttgtagttttcagtgtgcaagtcttacatgacaaagactctgcttcaccaaattttagacaagctcctctgagcactctgttaaactaggtctcatcctcgggctctgtccttggcctgcctaaggaagtcttagcaaagaatcctgctaataccccacccttgatcaagttccttgtcccctatatttgttatataagtccggccagcttttagcaggaatcctgttaggccagtttagagagaatccccttgcccttgatgcctcctcttagtaattttccatcctctgaccccctcactctgttcattggccacaaatccccactggtcttggttgtgttaggagttgagctcaatctctcccctccattgtgatagccttgacccctattgcagtaatctcaaaatctgccttaccattttttaaccagtgtcagaataatttttctttaacaatatctcttctaacatccttcttgccttgttcctaagtatttttttatgctattgtaaatggaatttttctctttcattttcggattgttcagtactaatgtatagaaattttattgatttttataaattggtgttgtatcatacaaccttgttctcctttattagttctaatagctttttaatagtttccttaggattttctctatatagaatcatgctacttgcaaatagagatagttttaattcttccttttcagtctggatgcttttcatttctttttattgcttatttgccctagctagaacctccagtataatgttgaatagaagtggtaagagtggacatcattgtcttattcctgctcttagggagatcttgaagaatcttccacaattaagtatgaggttagctgtgggtttttcatagatgtcctttatcaggttgaggaagtttctttttcttatttgttgagtggttttatcattaaacagtgttggattttgtcaattttttttacatctattgaaatgatggtttttgttctttattaatatgatgtattataacaattgattttcagatattaaatcaaccttgtgtttctgaaatgaatcccactgcatcatggtgtatagtcctttttgcatattattggattcatcctgccagtagtctgttgaggatttgttaaatgtctgtatttttaagagttgttggtatatcattttcttttatttatttatttattttattatttttttttattgatcattcttgggtgtttctcacagacggggatttggcagggtcatgggacaatagtggagggaagatcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttcttcacagacacagcaaccatccgatttctcaatcttttccccacctttcccccttttctattccacaaaaccgccattgtcatcatggcccgttctcaatgagctattgggtacacctcccagacggggcggctgctgggcggaggggctcctcacttcgcagacggggcggctgccgggtggagggtctcctcacttctcagacagggcggccgggcagcgacgctcctcacctcccagaaggggcggcggggcagaggcgctccccacatctcagacgatgggcggccgggcagagacgctcctcacttcctagatgggatggcggctgggcagagacgctcctcacttcctagatgggatggcggccgggcagagacgctcctcactttccagactgggcagccaggcagaggggctcctcacatcccagacgatgggtgcccaggcagagacgctcctcacttcccagacggggtggcggctgggcagaggctgcaatctcggcactttgggaggccaaggcaggcggctgggaggtggaggttgcagcgagccgagatcgcgccactgcactccagcctgggcaccattgagcactgagtgaacgagactccgtctgcaatcccggcacctcgggaggccgaggctggcggatcactcgcggttagcagctggagaccagcccggccaacacagcgaaaccccgtctccaccaaaaaaatacgaaaaccagtcaggcgtggcagcactcggcaggctgaggcaggagaatcaggcagggaggttgcagtgagccgagatagcagtagtacagtccagcttcggctgggcatcagagggagaccgtggaaagagagggagagggagaccgtggggagagtgagagggggagggggagagggagagggagagccattttcttttcttgtgatgtctttggttttgataccagggtaatgctgggctcatagaatgagtcaagaagtgttccccttttcttctattttggaaagatttgtgaaagttttgtattaattcttgaaatgtttggtagaattcacctttgaagccacctgggcttgggcttttctttgtgtgaagcttttttgtttttgtttttgttttttgagatggggtctgtctgtcacccaggctggagtgcagtgacatgatcctctctaattcctctttcattcccttggtgggagggttacctgcagccttgacctcctgggctcaggtaatcttcccacctcagcctcccaagcagctgggactgcaggcatgtgccaccacacctggctaatttttgttttttggtttttttgtagagacaaggtcttgccatgttgcccaggctagtctcaaactcctgggctcaagcgatccacttgcctcagcctaccaaagtgctaggattacaggcatgagcctccatgcccggcctgaagttttaaaattactgatttagtctctatgcttgctgtagctattcagattttttatttcttcttgagtctgtttagcagtttgtatctttctaggaatttgtgcatttcatctaagttacctaatttatttacacactcctgtttatagaattcccctaagatcctcttcattttgtaagtttggtggtgatgtctcctctttcatttctgattttagtaatgtaagttttttctgttttacttggtcattctacgtaaaggtttgtcaattttattgatctttctaaagaaccaacttctggtttcatagattttttttctatagtttttctgttctctatttaatttgttcaccctaatatttatttccttcccactgctagctttagatttagtttacccttcttttctagatccataaggtagaaagttaagttgttaggttgttaatttgagatcatttgtcttagctcaggctgccataacaaaattccatagacgtagtgacttaaacaacagaaatttattttctcacatttctggaggctagaagtccaagatcacggtgccagtatggtcaggttctggtaagggctctcttcctggcttgcagacagcatcttctctctctgttctcccatcaggcaaggaaaagagagctagctgtctagtgtcttttatttaattgatacataatatttgtacacatttatggggtacgtgtgatattttgttacatgcaaagactgtgtaatgatcaagtcaggatatatggggtgtccatcagctcaagaatttatttctgtgtgatgggaacatttcaaattctctcttctagctattttgaaatatataatacactattgttaactttagtcaccctactctgctatcaaacattagaacttattccttctatccaactgtgtgtttgtacctattaaccatcctctcatattccctgctcggccccacatacccacacccttcctagcctctggtatctattgtgctattgtctacctccatgagatcaactgttttagttcccacatgtgagtaagaacatgtgatatttgtctttccatgcctgccttatatcacttaacataataacctccagttacatccatgttgctgtaaatggcatgacttcattctatttcatggtcaaatagtattccattgtgtttataaaccacattttctttatccattcatccattcatggacacttaggttgactccatatctttgctattgtgaatagggatgcaataaatatgcaagtgcagatatcccgtctatacactgatttcttttcctttgcataaatacccagtagtaggattgctggatcatatggtagtttaatttttagtttttggggaaatctccacactggtttccatagtagctgcactagtttactttcccaccaacagtgtgtaagtgttttttttttttttccttatactagccagcatctgttattttgtatctttttagtaaccattctaactggggtaacatgatatctcattttggcttttatttgcatttctatgatgttgagcattttttcatataccttttggccatttgtatgtcttcttttgagaaatggctattcatgtcctctgcccactttttaaggggattatttgtatatctcctgttgagttcattatatattctggatattattcccttatcaaatgaatagtttgcaactattttctcccattcaactggttgtctcttcactcttgattatttcctttgctgtgcaaaagcttttttgtttaatatagtcctatttgtctatttttcttttcgttacctgtccttttgaggtgttagccataaaatcttttcctagagcagtgttctgaagtgtttcccctatgttttcttctagtaggtttatagttctgggtctgaaatttaagtctttaatctatcttggttgatttttgtatgtgatgagagacagaggtccagtttaattcttccacatatggatatccagttttcccaataccatttattgaagaaagtgtcctttccccagtgtacgtccttggcacctttgttgaaaatcagttgcctatatatgtgtggctgtacatacgtggatcaatgtctggcttttctattctattccatcgaccttgtgtctgtttttataccaaaccatgctgttttggttactgtagccttgtaatatgttttgaagtcaggtagtgtgatgcctccagctttgttcattttgctcaggattgctttggctatttggactcttttttggttcctgaaatactaattttaggattgttttttctgtttctgtgaaaaatgacattggtacttcgatagagattgcattgaatctgtagattgctttgggcttatggtcattttaataatatacattcttatgatccatgaccataagatgtctttctgtatctttgtgtcatcttcagtttttttcatcagtgttttgtagttttacttgtaggagtctttcacctactcgttaaatttattcttcaatattttatatgttcataactattataaatgggattaccttcttgatttcataaagttttatttcaccaagttgattattgatgcatagaaacattacagatatttgtatgttgattctgtatcctgcaactttactgaatatatttatcagatctaggagttttttggtggagtctttgggtcttttagacataagatcatatcatctgcaaagagggataatttgacatcctctttttcaatttggatgccctttatttctttctcttgcctgattgctctggctaggacttccagtattgtgttgaataggagtagtgaaactgggcttccttccagtactatgttgaataggagtggtgagagttttccatttcttagaggaaaggcttttcgtttttcccattccgtatgatgttagctgtgggtttgtcataaatggcctttatcatgttgagggatattccttctatgcctagttttttgagagtttttatcatgaagagatgttgaattttttttgataccttgaactatatatttttatttgaatatataaaagtagaatatcctattttccttttgagctatgtcatcatactgctaaaattatggatgaaaatggaaatatttcaacctgacccattgcaatttctatgttacacatttgctctttttttattattatactttaaattctgggatacatgtgcagaatgtgcagctttgttacataggtatacacatgccatggtggtttgctgcacccattaacccatcatctacattaggtatttctcctaatgctatttctcccctagcccccctacccccaacaggccccagtgtgtgatgttcccctccctgtgtccatgtgttctcattgttcaactcccacttatgagtgagaacacgtggtgtttggttttctgttcctttcttaccttgctgagaatgatggtttccagcttcatccatgtccctgcaaaggacatgaactcctccttttttatggctgcatagtattccatcgtgtatatgtgccacattttctttatccagtctatcattgttgggcatttgggttggttccaagtctttgctattgtgaacagtgctgcaataaacatacgtgtgcatgtgtctttatagtaaaatgatttataatcctttgggtatatacccaataatgggattgctgggtcaaatggtatttctggttctagatccttgaggaatcgccacactgtctttgacaatggttgaactaatttacacttccaccaacagtgtaaaagcattcctattgctccacatcctctccagcatctgttctttcctgacttgttaatgattgccatttaatggtcgccattcttactggtgtgagaggatatctcattatggttttgatttgcatttctctaatgacccgtgatgatgagcttttttttcatatgtttattggccacataaatgtcttcttttgagaagtgtcttttcatatccttcacacactttttgatggggttgtttttttcttgtaaatttgtttaagttccttgtagattccggatattagccctttgtcagatggatagattgcaaaaattttttcccattctgtaggttgcctgttcactctgatgatagtttcttttgctgtgcagaagctctttgctttaattagatcccatttgtcaattttggcttttgttgccattgcttttggtgttttagtcatgaaatctttgcccatacctatgtcctgaatggtattgcccaggttttcttctagggattttatggttttaagtcttatgtttaagtctttaatccatcttgagttaatttttgtataaggtgtaaggaagggggccagtttcagttttctgaatatggctagccagttttcccaacaccatttattaaatagggaatcctttccccattgcttgtttttgtcaggtttgtcaaagatcagatggttgtagatgtgtagcgttatttctgaggcctctgttctgttccattggtctatgtatctgttttggtaccaataccatgctgttttggttactgtagccttgtagtataatttgaagtcaggtagcgtgatgtctccagctttgttcttcttgcttaggattgtcttggctatgtgggctcttttttggttccaaatgaaatttaaagtagtgtttttctaattctgtgaagaaagtcaatggtagctggatggggatagcattgaatctataaattactttgggcagtttggccatattcttcctatccatgagcatggaatgtttttccattcatttgtgtcctctcttatttccttgagcagtggtttgtcattctccttgaagaggtccttcacatcccctgtaagttgtatttctaggtattttattctctttgtagcaattgtgaatgggagttcactcatgatttggctctctgtttgtcttttattggtgtataggaatgcttgtgatttttgcacattgattttgcattctgatactttgctgaagttgcttatcagcttaaggagattttgggctgagacaatggggttttctaaatatacaatcatgtcatctgcaaagagagacaatttgacttcctctcttcctatttgaataccctttatttctttctcttgcctgattgccctggacagaacttccaatactatgttgaataggagtggtgagggagggcatccttgtcttgtgctggttttcaaagggaatacttccagcttttgcccattcagtatgatattggatgtgggtttgtcataaatagttcttattattttgagatgcattccatcaatacctagtttattgagagtttttagcataaagcggtgttgaattttatcgaaggccttttctgcatctattgagataatcatgtggtttttgtcattggttctttttctgtgatggattacgtttattgatttgcgtatgttgaaccagtcttgcatcccagtgatgaagctgacctgatcgtggtggataagctttttgatgtgctgatgggttcgatttgccagtattttattgaggattttcgcatcagtgttcatcagggatattggcctgaaattttcctttttggttgtgtctctgccaggctttggtatcaggatgatgctggcctcataaaatgagttagggaggagtccctcttcttctgttgtttggaatagtttcagaaggaatggtaccagctcctctttatacctctggtggaattcagctgtgaatccttctggtcctggaccttttttgtttggtaggctattaattactgcctcaagttcagaacttgttattgttgtattcagggatttgacttcttcctggttcagtcttgggagggtgtatgtgtccaggaatttatccatttcttccagattttctagtttacttgcatagaggtgtttatagtattctctgatggtagtttgtatttctgtgggatcagtggtgataccccctttatcattttttattgtttctatttgattcttctctcttttctcctttattagtctcgctagcagtctatcaattttgttaatcttttcaaaaaaccagctcctggattcattgattctttttgaagggtttttcatgtctctttctccttcagttctgctctgatcttagttatttcttgtcttctgctacctttgaatttgtttgctcttgcttctctagttcttttaattgtgatgttagggtgttgactttaaatctttcccactttttgctgtgggcatttagtgctataaatttccctctaaatactgctttagctgtgtcccagagattctggtacgttgtgtctttattctcattggtttcaaaaaacttatttatttctgccttaattttgttatttacccagtagtcattcaggaacaggttgttcattttccatgtagttgtgcagttttgagtgagtttcttaatcctgagttctaatttgatggcactgtggtctgagagactgttggttacgatttccattttttgcatttgctgaggagtgttttacttccaattatgtgatcaactttagaataagtgcaatgtggtgctgagaagaatgtatattctgttgatttggcttggagagtactgtagatgtctattaggtcctcttggtccagagctgagttcaagtcctgaatatccttgttaatattctgtctcaatctaatattgacagtgggtgttaaagtctcctactattattgtgtgggagtctgagtctctttgtaggtctgtaagaacttgctttatgaatctgggtgctcctgtattgggtgcatatatatttaggatagttagctcttcttgttgcattgatccctttaccattatgtaatgcccttttttgtcttttttgatctttgttggtttaaagtctgttttatcagagactaggattgcagccactgcttttttttgctttccatttgcttagtaaataatcctctatccctttattttgagcctgtgtgtgtctttgcacatgagatgggtctcctgaatgcagcacatgggtgggtcttgattctttattcaatttgccagtctgtgtcttttatttggggcatttaccccatttacatttaaggttaatattgttatgtgtgaatttgatcctgtgattataatgctagttggttattttgcttgttagtcgatatagtttcttcatagtgttgatggtctttacagtttgatatgtttttgcagtggctggtactggtttttcctttccatatttagtgcttccttcaggacctcttgtaaggcaggcctggtggtgacaaaatctctcagcatttgcatgtctgtaaaggattttatttctccttcacttataaagcttagtttggttggatatgaaattctgggttgaaaattcttttctttaagaatgttgaatattcgcccccagtctcttctggcttgtagggtttctgtcgagagatctgctgttagtctgatgggcttccctttgtgggtagcctgacctttctctctggctgcccttaacattttttcctgcatttcatccttggtgaatctgacgattatgtgtcttggagttgctcttctcgaggagtatctttgtggtgttctctgtatttcccaaatttgaatgttgacctatcttgctaggttggggaagttctcctggttaatatcctaaagaatgttttccaacttggttctgttctccctgtcactttcaagcacaccaatcaaacataggtttggtcttttcatatagtcccatatgtcttggagcctttgttcattccttttcattattttttctctaatcttgtcttcacactttatttcattaagttgatctacaatctctgatatcctttcttccacctgatcagttcggctattgatacttttgtatgcttcacaaagttctcgtgccgtgtttttcagtcccatcaggtcatttatgttcttctctaaactggctattctagttagcaattcctctaaccttttttcaaggtccttagtttccttgcatggggttagaacattctcctttagcttggaggagtttgttattatccaccttctgaagcctgcttctgtcaatttgtcaaactcattctccgtccagtttgttctcttggaattttcagcctttttgcactggtttttcctcatcttcatggatttatctacctttggtctttgatgttggtgacctttggatggggtttctatgtggacatcctttttgttgatgttgatgctattcctttctgtttgttagttttccttctaacaggcctctctgctgcaggtctgctggagtttgttggaggtccactccagacccagtttgcctgggtatcaccagcggaggctgcagaacagcaaagattgctgcctgttccttcctctggaagcttcgtcccagaggggcacctgccagatgccagccagagctctcctgtatgagatgtctgtcgactcctgctgggaggtatcttccagtcaggaggcatggagctcagggacccacttgaggaggcagtctatactttagcagagcttgagcactgtgctgggattgccgctgctctcttccgaactggcaggcaggaacgtttaagtctgctgaaactgagtccacagccaccccttcccccaggtgctcggtcccaaggagatgggagttttatctataagcctctggctggggctgctgcctttctttcagagatgcgctgcccagagaggaggaatctagagaggcagtctggctacagggactttgcggagctgcggtgggctctccccggttcaaacttcctggccactctgtttacacagtgaggggaaaactgcctactcaagcctcagtaatggcagacgcccctccctccaccaagctcgagtgtcccaggtcgacttcagactgttgtgctggcaatgagaatttcaagccagtggatcttagcctgctgggctccgtgggggtggaatatactgagctagaccacttgcctccctggcttcagcccctttccaggcgagtgaacagttatgtctcactggcattccaggcgccactggggtatgaaaaaaaaactcctgcagctagctcggtgtctgcccaaatggccgcccagttttgtgcttgaaacccaggtccctggtggcataggcacccaagggaatctcctggtctgcagattgcgaagactgtgggaaaagcatagtatctgggccagagtgcaccattcctcacggcacggtccctcaaggcttcccttggttaggggagggagttccccgaccccttgtgcttcctggatgaggcaacgccccaccctgcttcggctcaccctccgtgggctgcacccactgtctaaccagtcccaatgagatgagccgggtacctcagttggaaatgcagaaattacccaccttctgcattgatttcactgggagctgcagaccagagctgttcctattcggtcatcttgccaaccaccctgagatgttgaattttatcaaatgctttttttatcagatgctttctctgcatctattaaggtgatcatgtggcttttattctctattctattgatggaatgtttcatgtttattgatttgcatgcattgaatcatcattgcatccctgggataaatcccacttgatcatggtgtattatctttttgatgtgatgtttgatttggtttgctagtatttcgttgaggatttttgcatctgtgatcatcagggttgttggcctgcagttttgtttttttgttgagtccttatcaggttttggtatcagggtaatgctggccttatagaatgagtagggagaattccctcctcttgaattttttggcatagtttgagaagtgatattagttcttctctgtaagtttcatggagttctccagtgaagccagctgattctgggcattgttttggttttgttgggagactttattactgattatactttattactgattcaatcccattactcattactggcttgttcaggttttctatttctttctgattcagtcttggtaggttgcatgtgtcctgggatttatccatttcttctgggttttcaagtttattagcatatagttgttaatagtatttctatggtcacttcttccaatttttagatttgctttaatatgcaaggactttttcttgaggatatatctatggtgttggttgggcagggcacttagactttgattatgggtacattcagtagtgtagtctgtataatttcttcagctataaacagcatcatcaaccatgtctgtatttttcttagtggcttagggtgtagttgttatggaggctgtggtgaagttttgatgggcatggggatttcaggtgggctagtccttgttttcgagtggtgtcaccagtgggtgaagcatgcctgtcctttggccccaggacagtgtattcattaagttatattacttttttaaaaaaagtttattttattctacaatggaaaacttgaccttttctacttttccaatattttcagatctggtagctcagcgaggagaaagattggaattattgattgacaaaacagaaaatcttgtggattctgtaagtatggaatctgataatatggagtctgatgtaaagtggagaaactatggatgatggctaacataattgggaaataccttaaattcaaatatttggtggtttttttttctttctcatttccattatgtgattactttgtaataatgaggataacaatgaggcatagaaaagaaacatcatcccctaatagccattaaggtagctttggtttggaaaacatactcagtatacagaaacaattttctaaagctttggattgaggcctatataatttagcacctcaactgcatgtaacagtctgttccctttacaaatttgtaaaacatgaaacaaatgtgcaagccgtttgtgacccagtatgaatcttgaaaactggacaattcacttttttgcttacactgatagtttcatcttgccttgtatcaatcaagagacatcgattggaaagcgccaataagccttaaaggagacaatgtgtccttgtgagctgcttatactatggttccgtatgtcctcacattttcaatgcagttactgtggatgaaagttttaaggaaagatgacagatatatggtgaacagaaggagggcagagatcagctacaatttgggtctacacaattataaatgtaaatgtacagtgcaggtttacaccttgaaagaaaacagtgattgattatgttcgttgtgactgacagctggattgtagtggttaagaacacaggctctagtatcaggttgcctggatttgaatcccacctctgctacttactagttgtgtgaccttaggcaaatgacttaacctctttgtgcctcagtcatcatcttctgtaaaatgaagatgtacccacttcagagcattttaaggattaaatcagataatgcatgtaaagtgcctaacacagtatttgatacatagtaagagctatttaaatgttcatcattattgttaattttacagggacatctattagcagcaggttttagtatatacagtctactatcaggttttctaggagtttataaacagttttttcatcaaagcatgtggtaggtggaggaaggatgctaccatacaggaagtcaaaacacctgggttctagatctcactttgtgacccattgctggggagcaaagaaaacagagaagtatctgattccagatctgcagaccaatttctttgatacttccaggctgtctcttagttattcttaattcttgaggattaccctgcttagggggaatggtctgtctttgaccaatagtagtatgatctgtactttacaaataaaagtcttaattttgttgacttcatgactgaaaacagaaggtactaatgaactaacaggtatctctctttatggtagaataacatacgtgcagcaaattgtatcaagtgtacaacttttaagtgtatagctcaattattttttatatatatctatacccatgtaaccaccacccagatctagatagaaaacattaccaacaccccagaaggctgcctcataccccttccagttaataatccccaatagacgtaattatgtttctgacttatatcaccacagatagtgttttgcctgttcttaaaatttatttgtgtctggcctctttcactcactgttatgcctgtgaaattcatccacgttttttattatagtaatcacttattcttttttattgttttatattattccattatacaaatctaccacaatttgtttatccgttcttctctgtggggctttatttctggattctctattttgttccattggtcagtttgtctacctttatgccagtaccacactgtgttgattagtataacttaatagaattcttgaaattaagtagtgtaagtcttccaactatattcttgttgtccaatattgtcttcactcttttaggtgctttgcatttccatatatgttttagaataagcttgttttccatctcttgaccccacaacaatgtgtatctttgtgactgcatttaatatataggtcactttaggggacattggtatcttgacagtatagagtttttcggtccatgaacgtgacatatctctgcttttgcttaggatttaaaaatttttctcagcagtattttttagtttttggtgtacaggtcttgcacatatttgttaaatttacccttgagaatatcatgcttttgtattgtgtaacaaatttttaaattttgtttctaattctttattgctagtatatggaaataaagttggttattgtatattgaccttgtttgtattctgcaaccttagaaaaattcatttaccagttctggttactgttttgtacattcctgccttttattttccttcccttattctggctagaaccttctacacaatactgaatacaagtgataacagtgaacatccttgcctattgaccatcttgtggggaaaaattcaatactttttgaaaaaaataaattcagtgttaagtttgtggttaactgtagattttttgtaggtaccctttaataggtggaagaattccctttaattcctcatttgagagttgtattcatgattttatcaaatgctttttctccatttattgagatctttggtttttctcctttattcagttagtatggcaaattacattgatttttcagtgttaaaccaactttgcattcctgcaaggtcatgacttactacccttcttatataacactttattggatttgctattgttttgttcaggaatttggcatctatgtttataagagatagtggtctgtaatttatttttctctttaggttttggtatcaggaatatgctggcctcattaaacaagttgggaaatcttacctctctatcttctgagtttgggtactattggtattatctgtcttagatgtttggaagaatttactagtaaagcagattgggcctcgagttttcttcgttggaaaatttaaaatctgccatcttgctgtttgtttcctatttataccatctagtctttgttccctttttgttctgccttccattggatttagtacatttgttattccattatgtctcctttgtcagtttattagctatagctccattctgtcattttctgattgctttagggtttacagtatgtctttgatttataatctcccttaaagtggcatttttccacttcatgaatagataagaaccttataatagtatacttctagctgtttcttcttggcctttatgctattgttgacatatttttatttacacatgtattaaaaacttcataatacattgttgttgtttttgtttaaagagttgattatcttttaaagagatttaaataataagggaagtcttttctgtttacccatgcagctaccatttcagtgctcttaattcttttgtgtaggccgagtttctatctgatgttattttctttctgcctgtatgctttaatttaacatataatcttccattgtagttcaagtgtgtaggtctactggaaatgaattctttcaggtttggtatgtctgagaagtttttatttcacttcctttttttttttgaaagacattttcactgagtatagaattctaggtcagtgatttttctttcttttaatacttgatgaacggtggttcatcactgtcttttacattgtttctgacaagaattctgctgtcattcttacatacataaagtgtatttttttttcttctggatgctttaaagattttctctttatcattggttttaagaaatttgattataatatatatgccttggtatatatttctttatgtttctttggctttgagtttgttgtagttttcatcaaattatgaaaatgtttagctctttctaggcttccagtgacatctgtattaagccacttgaagctgtcccacaactcactgatgctttgttcatttttaagtcttttttccactatgtttcatttagaatagtttctattgctatgtcttcaagtttacttaccttttcttctgcagttcgcaatctgctgtttctgtcctgtgtatgtttcatctttacaggtttgttttggatcttttttatatcttccatgtgtctccttaacatgtgcatactttcctctaccttgagtatatgaagtatatttataattgaagtgcttattccacttacatgtaatgcaaattttgatagagttaggtgtaggtatcttgctctttgttttttatttgccgcatccctgtcctcttcttttttattttgattactcaagtactttttaaattgttttttaaccatctctatttgttttttaacacttctattgagagataactcacagaccatacaaattgcccatttaaagggtacacttcagtggaatttagtatattacattattaaaattgtggtaaaatatgtatagcataaaattttgccattttaacctttttaaagtgcacaattcagtgatgttaattacatccacaatgttgtgcatccatcactactagctatttccaaaacttttttatcaccccttaacaaaaactctgtaaccattaagtaataataactccccattccccttactctcagcccctggtaactctaatctactttctgtctctgaatttgcctgttctagatatgtcatataagtgggatcatacaaaatttgcccttttgtgtctggcttatttcactaagcataatagtttattgcttaaaaaaaaatgctaacaatcacctgagccttcagtgagccttaatctttttgctggtggagggtctcaccttgatgttgatggctactgactgatcgatcaggctggtggttgctgaaggttgtggtggctgtggcaatttcttaaaataagacaacagtgaagtttaccacattgattgactctttcacaaaagatttctctgtagcatgtgttgctatttgatagcaatttactggcaatagaacttctttcaaaattggagtcaatcctctcaaaccctgctactgctttatcagctgagttgatgtaattttctaaatcttttgttgtcatttcaacagtgttcacagcatcttcaccaggaatagttgccatctcaagaaaccactttccttgcccatgcataagaaacaactcctcattcattaaagttttatcaagaaactgcagcagttcagtcatgtcttcaggctccagttctaattctagttctcttctatttctaccacatctgcagttactcactccactgaagtcttgaacccctcaaagtaatttgtgagggttgtaatcagtttcttccaaacacctgttaatgtttatattttgacttcctcccacgaatcatgaatgttcttaatggcatctagaatggtgaatcctttctagaaggtcttcagtttactttgcccagatccatcagaggaatcattatctatggcagctatactaaatgtttttcttaaataataagacttgaaagttgaaatcactccttgattcatgggcagcagaatggatgttgtattagcaggtgtgaaccccaaaagtctgagacaggtctcagttgatttagaaagtttattttgccaaagttgagagcgcacacccgtgacacagcctcaggaggtcctgacaacatgtgcccaaggtggtcaaagcccagtttggttttatacattctagggagacgtgagacatcagtcaacatatgcaagatgaacattggtttggcctggaaaggcggaacaactcgaagcaaaggcgggaaggctcgaagtggggagggggcctccaggtcttagatagataagagacaaatggttctattcttttgagtttctgatgagcctctccaaaggaggcaatcagatacgcatttatctcagtgagcagaggggtgactttgaatagaatgggaggcaggttggccataagcagttcccagcttgacttttccctttagcttagtgatttggaggccccaagatttattttcctttcacacaggcatgaaaacgacatttatctcctcgtaagtctccatcagagctcttgagtgactaggttcattgtcaatgagcagtaatactttgaaaggaatcttttctttttgagcagcagatctccacagatcttctgtacaccatcctgtaaacagatgtgctatcttccaggtttgttgttccatttcaagagcacaggcagagtatatttagcataattcttacgggccctagattttcagaatggtaaattaccattggcttcagcttaaagtcatcagctgcattggtccctaataaaagtcagcttatcctttgaagctttgaagccagtcattggcttctctctatgaaagtcctagatggcatcttcttccaaaagaagggtgttttgtttacattgaaaaatctgttgtttagtatagccacctttatcaatgatcttagctaggtctcctggataacttactgtggcttctctctcagcacttgctgcttcaccttgtacttttatgttatagagatggcttctttccttaaacctcatgaaccaacttctgctagctttaaacttttcttctgcaccttcctcgcctctctcagccttcatagagttgaagagttagggccttgctctgtattaggctttggcctaaggaaatgttatagctggtttaatcttctatccagacccctaaaacattctccatatcagcagtaagtctgttttgctttcttatatgtgtgttcactggagtagcactcctgatttccttcaagaactgttctttgcattcacaatttggttaactgtttgtcacaggacacctagctttaggcccatctcagctttcgacatgccttactcactaagcttaattatttttatcttttgatttaaagcaagggatgtgtgacttttcctttcacttgaatacatagatgccattgtaaggttattaattggccaaatttcaatattgtgtctcggcaaatagggaggcctgagagggagagagataagagaatagctggtcagtgaacagttagaacacacaacatttatccgttagctccgtcaccttatataggcacagtttatggcacccgaaaacaatcacaatagtaacatcagaggtcacagatcgtcataacagatagaatgaaaataatgaaaagtttgaaatgttataagaattaccaaaacacagacatgaggcgaccacatgctgttagaaaaatggtgctgccgcatgttctcactcctaagtgggagttgaacaatgagaacacatggacacagtgaggggaacatcacacactggggcctgtcggggagtgggggctaggggagggatagcattaggagaaatacctaatgtagataacgggttgatgggtacagcaaaccaccatgtcacgtgtatacctgtgtaagaaacctgcacgttctgcacatgtatcctagaacttaaagtataataataataataaaaagaaacaaaaagtgcaggccaagcaggaaaaaaaaaaaacaaaccagaaaaatggtgctgatagtctcatcatggggtttccacagaccttcgatttgccaaaaaaaaaaaaaaaaaaaaaaaaaaatccatgaagtgcgataatgtgaagtacaataaaaggggatatgcctgtaattctttctgtgtcctttattgttttcctgcagttctgtttcagtgtacgattttgtttgcttcaaactgaagaagttcttttattgtttcttataatgttgatctactgatgagagattctctaagcttttgtctgaaaatctgtttcatcatttttttaaagaatactttctttgcatagagttttttagtttttcacaatggcagtttttttttttttttaaagtgagtgctttaaaaatgccattccatttttctttggctttcatatgttctcaaagagattgtcatttctcttagtcttacttgaaaaataatgattcttaccccacctttggcttttgttgttgttgttgttgttgtttgttttgtttttttaagacagagtctctctctctcacccaggctggagtgcagtggcacgatcacagcttactgttgcctccacctcccaggctcaagtgatcctcctgccttgcctcagcctcccaagtaggaggaccacaggcatgcgccatcacacttagctaattttttaaatttttcttagagacgggtctccctatgttgctctggctggtctcaaatgcccaggctcaagtgatcctcccaccttggcttcccaaagtgctggaaatacaggcatgagccaccacacctggccccctttggctggttttaagagtgtctttttatatttggttttcaactttttatatatggttattagctttctgtggctgctatcacaaattatcacaaacttggtggcttaaaacaacaaaaatttattttctcccactactggatttcagaagttcaaaatcagtttaactgggctgaaattaaggtgttagcaaggctacactccttccagaggctctaggagaggatctgttccatgcctcttccagcttcaggtggctgccagtatttcttggcttgtggctatatcattgtagtctctgcctccatgttcacattaccttctcctttgcatgtgtgtcaagcctccatctactttcctcctatagagacatttgtgatgtcatttagggctcacatggataatccaggatactctcttcatctcaagattcttgacataatcacatctgtaaagaccccttttccagataatatcacatatgtcacattcatagggattaggacacaggcatgtcttagggcaacatttaacaattgttctttataggtgaacttgttttaaacagatggtttgtcagtgttcagatgttgacctgagagtggtggaggaatctccattacaacctgttgaatcacacagctatgttcggatttattagtttcattcctcactgctttttctcatctacatcatctttctctttcttgaattatttattgtgaattagtctttgtttgtagtatatcctcacacattttcttcatatgagtttgtggatgataatcccttcaagaataaaagtgttattttggtctcatatttgaacaattttttgactggtgtagaattctagggttaagatcattttctctcaaaattctctgaatattgctgcatttcagtgcatgaagaatttaggcatctgagaagttcaacaactatacagtttacacgttttttatttgggccaagtttgaggactgcaacccaggagcatagattcaagttgctctgaatatatgttctaattagcagcagttacaagtaggtttttaaaggaaaaaaggagaggcagtatctaatttgtttaccaagaatttacattaaaatagcataagctattgattgctatacattgtcctttgtatcacaaattccaggaacatgaagataatggttgaggcagctagtcagcaacaaattgcctttaaacagttgccccccctgggcattgtgtggggggtgtgactgaagtccccatactcatgtcttctgggcctgataaattttatatacctcacatagctcaggctgctctgagctgtttttcttttctcatttcccccttttgatcaaaatttttctcttctgaaagcattgatgatcagcattttagatataagtttatcccatgtcactggggaggcttattcccagatattcttgtcccgtgttggatggaaagacgtaaaaaaggtaccatggcttaaagaacttagtgaggtctcaaggccaaattgattggcaacacagaggagcagagcaacaggatctcagtcaagccatccactcacgctggagccatggcatgaacaactatacagtttactcaagtccaccctcacttaatggcaccaactgcaagtttggggattccccaaaccaccctcagatttgatagttcattagaaggatttataatactctgtgagcactattatactcacagttatggtttattacaggcaaattatacatagtaagaccagccaagggaaaaagtacatagggtggagtttgggaagataccaaatgtagagcttttgttgtcctcttcccatggagtcaggacacgttgctctcttggcatcagtgtgtgacaaaatgtgcagagcattgcctaacaggaaagcttacccaagccttagtgttcagagtttttattggggtttcattatgtaggcattattgactgactgccctctggcttgatctcagtctccagctccacttggtgtgatccaaagcctcctaaatcacatagtcattttttctggagtgtcttttccccaccctaaatcacattgttactatctagattacagtctattagaaaaataaatcaaggctgtgcatggtagctcatacctataatcctaatacttatactttgggaggccaaagctgaaagatctctaaaatccagaagttcaagaccagcctaggcaacaaagtgagaccttatctctacaaaaccaaacaaaaaaaaaaaaaaaataggtgtgattgggtgcacctgtagtcctagctacttggggggctgaagatggagaattgcttgaacccaggaattcagagctgcagagagctatgatcacaccactgcattccaggctgggttacagaggggtgacctccatctcaaaaaaaaaaaaattttttttcttttaattcttttttattttttattttttttataaatatatatattttttattatactttaagttctagggtacatgtgcacaacgtgcaggtttgttacatatgtaaacatgtgccgtgttggtgtgctgcacccattaactcatcatttacattaggtatatctccaaatgctatcccttccccctcccaccaccccacaacaggccccggtgtgtgatgttccccttcctgtgtccaggtgttctcattgttcagttcccacctatgagtgagaacatgtggtgtttggttttttgtccttgcagtagtttgctgagaatgatggtttccagcttcatccatgtccctgcaaaggacatgaactcatccttttttacggctgcgtagtatttcatagtgtatacgtgccacattttctgaatccagtctatcattgttggacatttgggttggttccaggtctttgctattgtgaatagtgccacgataaacatacgtgtgcatgtgtcttgatagcagcatgatttataatcctttgggtatatacccagtaatgggatggctgggtcaaatggtatttctacttctagatccctgaggaatcgccacactgtctttcacagtggttgaactagtttacagtcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgccatcttttgagaagtgtctgttcatatccttcacccacttgttgatggggttgtttgtttcttttcttataaatttgtttgagttctttgtagaatctggatattagccctttgtcagatgagtagattgcaaaacttttctcccactctgtaggttgcctgttcactctgatggtagtttcttttgctgtgcagaagctccttaattagatcccatttgtcaattttggcttttgtttccattgtttttggtgttttagatatgaagtccatgcccatgcctatgtcctcaatggtattacctaggttttcttctagggtttttatggttttaggtctaacatttaagtctttaatccatcttgaattaattttagtataaggtgtaaggaagggatccagtttcagctttctccatatggctagccagttttcccagcaccatttgttaaatagggaatcctttccccatttcttctttttgtcaggtttgtcaaagatgacatggttgtagatgtgtggtattacttctgagggctctgttctgttccattggtctatatctctgttttggtaccagtaccatgctgttttggttactgtagccttgcagtatagtttgaagtcaggtagcatgatgcctacagttttgttcttttggcttaggattgacttggcaatgcaggctcttttttggctccacatgaactttaaagtagttttttccaattcagtgaagaaagtcattggtagcttgatagggatggcattgaatctataaattaccttgggcagtatggccattttcatgatattgattcttcctatccatgagcatggaatgttcttccatttgtttgtgtcctcttttatttcgctgaacagtagtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacgttgatttcgtatcaagactttgctggagttgcttatcagcttaaggagattttgggctgagataatggggttttctagatatacaatcatgtcatctgcaaacagggacaatttgatttcctcttttcataattgaataccctttatgtctttctcttgcctgattgccctggccagaacttccaacactatgttgaataggagtggtgagagagggcatccctatcttgtgccagttttcaaagggaatgcttccggtttttgcccattcagtatgatattggctgtgggtttgtcatagctcttattattttgaaatacgtcccatcaatacctaatttattgagagtttttagcatgaagggctgttgaattttgtcaaaggccttttctgcatctattgagatgatcgtgtgttttttgtctttggttctgtttatatgctggattacatttattgatttgtatatgttgaaccagccttgcatcccagggatgaagcccacttgatcatggtagataagctttttgatgtgctgctggattcgatttgccagtattttattgaagatttttgcgtcggtgttcattagggatattggtctaaaattctctttttgtgttgtgtctctgccaggcttaggtatcaggatgatgctggcctcataaaatgagttagggaggattccctcattttctattgataggaatagtttcagaaggaatggtgtcagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtcaaggaatttatccatttcttctagattttctagtttatttgtgtagaggtgtttgtagtattctctgatggtagtttgtatttctgtgggatcggtggtgatatccccttttatcattttttattgcgtctatttgattcttctctcttttcttctttattagtcttgctagcagtctatcaattttgttgatcttttcaaaaaaccagctcctggattcattgatttcttgaagggttttttgtgtctctatctcgttcagttctgctctgagttatttcttgccttctgctagcttttgaatgtgtttgctcttgttcctctagttcttttaattgtgatgttagggtgtcaattttatatctttcctgcttccttttgtgggcatttagtgctataaatttccctctacacactgctttaaatgtgtcccagagattctggtatgttgtgtctttgttctcattggtttcaaagaacatgtttatttctgcattcatttcgttatgtacccagtagtcattcaggagcaggttgttcagtctccatgtagctgagcagttttgagtgagtttcttaatcttgagttctaatttgatttcactgtggtctgagagacagtttgttataatttctgttcttttacatttgctgaggagtgctttacttccaactatgtggtcaattttggaataagtgcgatgtggtgctgagaagaatgtatattctgttgatttggggtggagagttctgtagatgtctgttaggtccgcttggtgcagagctgagttcaattcctggatatccttgttaactttctgtctcattgatctgtctaatgttgacagtggggtgttaaagtctccctttattattgtatgggagtctaagtctctttgtaggtctctaaggacttgctttatgaatctgggtcctcctgtattgggtgcataaatatttaggatagttagctcttcttgttgaattgatccctttaccattatgtaatggccttctttgtctcttttgatccttgctagtttaaagtctgttttatcagagactaggattgcaacccctgcctttttttgttttccatttgcttggtagatcttcctgcatccctttattttgagcctatgtgtgtctctgcacatgagatggatttcctgaatacagcacactgatgggtctttactctttatctaatttgccagtctgtgtcttttaattggagcatttagcccatttacatttaaggttgatactgttatgtgtgaatttgatcctgtcattatgatgctagctggttattttgctcgttagttgatgcagtttcttcctagccttgatggtctttacaatttggcatgtttttccagtggctggtatgtgttgttcctttccatgtttagtgcttccttcaggagctcttgtaaggcaggcctggtggtgacaaaatctctcagcatttgcttgtctgtaaaggattttatttttccttcacctatgaagcttagtttggctggatatgaaattctgggttgaaaattcttttctttaagaattttggatattggcccccactctcttctggcttgtagagtttctgccgagagatcagctgttagtctgatgggcttccctttgtgggtaacccgacctttctctctggctgcccttaacattttttccttcatttcaactttggtgatctgacaattatgtgtctcggagttgctcttctcgaggagtatctttgtggcgttctctgtatttcctgaatttgaatgttggcctgccttgctaggttggggaagttctcctggctaatatcctgcagagtgttttccaacttggttccattctccccatcactttcaggtacaccaatcagacgtagatttggtcttttcacatagtcccatatttcttggaggcttttttcgtttctttttattcttttttctctaaacttctcttctcgcttcatttcattcatttggtcttcaatcacggataccctttcttccagttgttcgaatcggctactgaagtttgtgcattcgtcacttagttctcgtgccatggttttcagctccatcaggtcatttaaggacttgtctacattggttattctagttagccattcatctaatctttttttcaaggtttttagcttctttgtgctgggttcaaacttcctcctttagctcagagaagtttgatcatctgaagccttcttttctcaactcgtcaaagtcattctctgtctacctttgttctgttgctggtgaggagctgcgttcctttggaggaggagaggcgctctgatttttagaattttcagtttttctgctgtttttttccctatctttgtggttttatctacctttggtctttgatgatggtgacatacagatggggtttttgtgtggatgtcctttctgtttgttagttttccttctaacagtcaggaccctcagctgcaggtctgttggagtttgtcggagggccactccagaccctgtttgcctgggtatcagcagcggaggctgcagaacagtgaatattgctgaacaccaaatgttgctctctgatcgttcctctggaggttttgtctcagaggggtacccgccgtgtgaggtgtcagtctgcctctactggggggtacctcccagttaggctgcttgggggtcagggacccacttgaggaggcagtctgtctgttctcagatctcaaactctgtcctgggagaaccactactctcttcaaagctgtcagacagggacatttaagtttgcagaggtttctgctgccttttgttcagctatgccctgcccccagaggtggagtctacagaggcaggcaggcctccttgagctgtggtgggctccacccagttcgagcttcccggcagctttgtttacctactcaagcctcagcaatggcgggcgcctctcctccagcctcgctgccaccttgcagttcaatctcagactgctgtgctagcaatgagtgaggctccgtgggtgtgggaccctctgagccaggcgcgggatataatctcctggtgtgctgtttgctaagaccgttggaaaagcgcagtattagggtgggagtgatccgattttccaggtgccatctgtcacagcttcccttggctaggaaagggaattccctgaccccttgtgcttcccgggtgaggcgatgtctcgccctgcttcggctcacgctcggtgggctgcacccactgtccaacaagccccagtgagatgaagccggtatctcagttggaaatgcagaaatcatccgtcttgtgcgttgctcacgctgggggctgtagactggagctgttcctatttggccatcttggaacaggaatcaaaggaaattttttaaaaatcccatttatgatagcatcaaaaagagtacaatagttaggaataaatttaaccaaggatgtaataatgtgcacactgaaaattataaaacattgatgaaagaaattcaagaagacacaaatcaatggaaagataccttatgtttatggattggaagaatcaatattattaaaatgttcatactgcctgaagcaatacacagattcaacacaatccctattgaaattccaatggcatttttcacagaatagaaaaaaaaattctaaaatgtggatgaaactagaagacattatattaagtgaaatatactagacacagatagataaatactgtatgatttcacttatatatggaatctaaaaaaaatgttcagttcataaaagcagagagtaaaacagtggttgacagtgggtgggagacctggagagatgttggtcaaagtgtatgaacttacagttgtaagatgaataagttctggataccggacatacagcatggcaactatagttaataataatgtattgaatatttgaaatatgctataagaatagatcttaagcattctcaccacatacccaaaaaagtaactatgtgaggtgatggatattttacttagcttgattgtggtaataatttcacaatgtgtacatttatcagaatatcacattgtataccttgaatatataccatttttatttgccaattatacttcaaggcagaaaaaaataaaattagagtagaaacaaaagcttggaggtctgaaatgttactaaaagtgtaacattttccttttttcaatattcttgccacatggtgggtaggtccttttagtctgaagattcaagtctgtcttatttgggggatattttcttcaattagtcccttgattattgatccttctcttttggctgtattctctcctgtgactgctaataggtgtgtaaatcagtaccaggcacataataagcacatgttaaatatctgttgatcgtataaattgatcctggatttgcttgatcagttttccgtgtatcttacatcttctttcatgatttacaacctagacattttgctgttttcagaacaaattttttgaattgttactgcagaagctgcttttgctcatttatgttctgcttttaaaaaattatgccattttattaaaatatagtttttggaatgttgtcatgttatctaattttttatgtcctctgatgactttgtttaaaattagttcaattatgtcttgtatctgaggatacttattagaaatttttttattactgttattctatcttgtttcccatattaactttgttccattaaggactgtttgtccccattgctttttttgtctcctcactttaactgctgtttcttctcaaaagttctagtcaatgcatatattctattcaacatatatatttagctctagatgtaatcagttttggtatgtgcctccaggtggcatcctgtgcagtcttcatgaagtgaaacccaaagactggtgcccctgtcagttgttctactgcagagactttgtggagtatgtggttggagatgaatctatggttaagggagtggattttttaaaaccaatatgtgaagtataatatacataaagtgcatcaactgtaagcatacaacttgttgtgttttcacaaagtaaacataccatgtagaaccaacacccagattaagaactagagcacgaacagtaccccagaagctcccttctcccttcttttagtcactactcttctccaaaggtggccactgtcctgatttctccacatagattaataaaacatagcaggggccgagagtggtggcacacacctatagtcccagctactcaggaggctgaggtgggaggatcgtttgagcccaggaggtcaaagctgcagtgagtcgtaattgtgccactgcactccagcttgggcgacagagcaagaccctgtctcaagataaataataaaatatagcaggtattctgtttatgtcaagtttctattgctcaaaatgatgtttgtgagattcatctgtggtaaattgtataaatgtagtagtagattgtgaattgtcattactgtattgtattccatgttatgactctcctgtaatttatgcattgcacagttgatgggcatttgggtggtttccagtttaaggtatgaaaagtagtgctgtccaaaacatttttttatatgtcttttggtgaatttgcatacatctgtgggaccataccagagtggattgctggattattagggagttttgttggttggttgtttgccattttgttttaaactccttgtgtcctggtgggaattgttcagtagatactgagaaattgatgatgcaaaagaaaatggatagcagaaggaatgaagttctatgggttttggccctcacaaaagtaaatacatatcttcctacagaaatcaaacaggtttttatggctcaaagccccggaattatacggggcagaataggcgaatgtgcttgcagtcagctggctttaaaagagcctttcttattggaagtatagagaggaaaattcttttccactagcgggaagaaccacttctggtgctcaacatcatgtgcattgctgcagtggagaagaaaaaagagggaagcgttttcattgggctcatactgcttatgataggcctggcagagtcttgcttttggcaactattgagtatgaatggccagtctctacttgtaaagagaggtcattggacttaaatggaattaatggaagtaaaatgttctcaggttgttactgcaaatcattcatgtagtcagtgccaggggttaaacaattctcgcctcttttctagtctgtcaccttcaaaactaccagcagaaatcttgctcgagccatgtgtatgaagaacctcaagctcactattatcatcatcatcgtatca

SEQ ID NO: 4112 - DNA, 62395 bp, human
gcagttggcgaccctgcactgacccgcgtccctccgtcccgagcccgcgcgccctcagagggtgcccggacaggtaaatggagtggggtgcgcctgcgggaggcggggagagaactgcggagggagggcggaggtgtcgatggaaaggtgctggggtggagcgaggaggcagtgcaggggtgacttgggcttctctggtgtcgacagttccagttgtcgggcaggaccagttttggcgaggtgcgtcttatgccactggaaaggcctcgagttaaagagtgtcagaatgcgtcacttaagctgtcattacaggagggaaaaaatgttaactttctctcagtttgtattctacaagacctttctgtagcatttaaatctcttgagatcgccagagtcttctaaaaactctctacgtccttgttcgatgacgtcactttctgcttcaccttctacttctggctgtttatgctccttcgtgggttcctagccccttattcgcccttcctccactgctcagtattgacagtccccttcttcctctgttcagggactgtatttctgcctagacccgtttcctcagcttcagacctgtttggtgtttttattaatggccaatgtttatcaaattctgactgcgtactttggtaaatgctttacatctccgtctcccataactctcacaaccaaccaactgtcttcatttggcctcattaattgctttcaactacctgtatctccattatccctcccttgatcccagaggatacagtcatgtttaggatattaattccctttgaatacctgtggctgagagcagatccattcatacatttaacaaatatttattgaacggctggtatatgcttgacactcttttaagtgcaggggatacagctgtaaacaagacttaggaggttgctactctcaggaacttacatgtttgtgtctagaggggaaaacaggaataatcaggattatgttatatattggttaatgcaaaataaaacaggtggttgacttgaaaggatgggatcctatcctaagaaagtcagaggtcagggcatcgtccagaaagaatagttgtaataccaacaggaataatcttgatctgtaacatgacttttcgtaaacacctcttcttttcccctgtctaagcagtgtttattcttcattcttctatctcctccaaggttattgcatcagaattcatggtttatctgtagttggtttattccttctaagacccagagagaagagtgggggattggattactattagctcaactgctttatcttacttagaaagatagtttggttgtgaaaatattattcttaccaggtccttctgaatataaagttatctaccatttatagtatattttaaaaccaaaatatgctcaatgttcactcatttattcaacagatatttgagggaatattagatggtaggcactgtgctgagcactgggaaaatagggtaaaatagacactttgacctctcttccaaggagaaataatcctaacagtatactgaggaaatttctaaggcataggctgacacctgcattcctgttcttcatccgaggtgagatcatcacaaaacattaagacatttcctgagcaattgcggacattcttagattattcacttattatactttattgcatttatttatatctgtcttccccattgttctatggctccctcaagtataggagtcccttcttccttaactttatacctctagtgtctactttgactgtcatatagtaacccaccagtatatacgtgttgaactgaaatagactccctatttgatcaaatttaaatgacatgatttatacaaggccttctttatgtaaggccatcagccgtattcctcaaccttctcattcaccaaaggtggaccattccatcttatcaggctagcttatgtaccttctttaccttgctctcagtgccttctcttcttccatccatccctcctaaaaggatctcccatctcttcccaagcaccttgtgtacctccctccattaatttggtgggccagttaatttaataatctgctcatgatacaggggtggaaaaaaattaatttcctttttatatttcctatgaaacattctgccaatgaactcttgcaagaattaatgtaatagatcctactgcaataatataatgatacagaatactttttaaagattttgcattgactatcaccatgtgctatgtaatgagttaattctactactttatttgaacagttgtataacctctgttcacacagcatgttttggtatcatttggtttctacttggtagaaacacatctttttttttttttttttttttgagacggagtctcactccgttgcctgggctggagtgcagcggcgcgatctcggctcactgcaacctccgcctcccaggttcaagcaattctcctgcctcagccccctgagtagctgggattacaggtgcacaccaccacgcctgactaatttttttttgtatttttagtagagacgggatttcaccatttttggtcaggctggtctcgaactcctgacctcaggtgatccacctcggcctcccaaagtgctgggattacaggcatgagccaccatgcccggccaagaaacacatctttgagtattactttctcagcctgaggtaatttaagtggtaatgttattctgccacattgtcattttcaggatgtcagataaaagcctcaagtattaaaattaaacttttttttttcttttgagacagagttttgctcttgttacccaggctggagtgcaatggcatgatcttggctcacctcagcctccacttcccgggttcaagcgattctcctgcctcagcctcccaagtagctggaattacaggcgtgcgccaccacgcctggctaattttgtatttttagtagaaacggggtttctccatgttggtcaggctggtctcgaactcctgaccttgggtgatccgcccgcctcagcctcccaaagtgctgggattacaggcatgaaccactgcgcccagccaaaattaaagtcttattccatgcaggtatctttcaattgtaaatcattactgcaaaagacaaattttgtctttataactgattaaaaacaacagcagtacaagagtgcttgagtcatgactgtcgtgaatttaggatgtgccaacctaagatcagccagatacttctaagatgtaaacattaagcattgttattttaggtgatttattgacacctatttctttatagacaggaatgcaagtgcagcactgaattgtgtgccattgctcgtttataagatacacatgtagatgatccagaatattcttatacatttttcagtgttatcaaaatacaaatgcagaattaaaagatttctcaaaacacatggacttggcctttccccttactcagttacctgaaactgtcttcagcctctacttgaagatgcttctgctgaggaggagcattttcatcattgctgttctatgttattaccaaattttttaatacaggcaatttcttacttacaaatggatatattctaaaagtactgttgtaagcttattgtttggaacgctggatgcatttccttctataaataatgctatccatgacatttacactgttatgccaaccagtatcattttattaacttttaatttagtggactcgaagaccttccccacaatttacaataattcctctattaaaaaactgcatttataattctcatttgaattcccttatagcatatctttttttagaaacccaacaactagaacaaaaatatcctttctttagtcccttaacatagtaaaaacaggcttttctaactccaaactgttgtgggtgacccttctagcccttagctctaaggacagtcctccaatatgagcaaggaaaacgaagggacagaggttttagagagggaggcaagttgggtgatatgagtatctggaaagggaagggtaggatttatttgggatgaacagtgagtttctaaaatggaagtttgcattgcttgtcagccttttggctaagatcaggtgtagtatcagtttaaaatgggggtttgttgtgggttgaattgtgtcctccagaaagctgtgttgaagtcctaacccgtggtacctgtgaatgggatcttatttagaaataggatctttgcagatgtaattaagatgtaattgaaaatggggtcatactggagtagagtgggccctttatccaatatgactggcatccatataaaagaagagagacagagagaatgcagtgtgaagacacagatacagagaacaccatgtgactacagaggtaaagattgaagtgctgcacctccaagccaaggaacaccaaggattgccaccaaactatcagaagctagaaagagataaggaaagattctcttctacaggtttcagagggagcataaccctgccaacatcttgattttggacttttaaccctcagaactggtaggcgatacatttctgttgttttaagcaaccaagtttttggtactttattactgcagctacaagaaactaatacaggattcttagcaggaataaagtagaattgggatggtggctgtgggaccaagtggggagtgaataggagaacaaagaggaacagtgttgatatggggctttcctttatgttgcattatctttttttcttcccttctctctctggcttatcttttcattctttttcttcttggatcttatctttatatagcactttatggtttattaggcatttacatactgctaataattagcagagccaggttttctaacttcaagtgcagtgttcattgtgccacaattgtttctgttatcccaatactcatcaagacgttatggattctattacaagacacttacaatgggggcaggtaagacttcataggtgggatttttagcagtatagcagagaggaaggaattcctattagtgacatctggaaggaaagtaaagtttctgttgctatgtacccactgtttaacagtcatttttaagttggggactgcttttattggaagaaacactacttgcgtataacttatattcattgttcctagttatattctgaataatgtgctccctgttccaggtgactgtactttatataaactcaaaaactattgtcatgttccctctaagtcctctctttctcatgttacatatctctagttcctccagccagtcttcagatgacacaatctccatgtctctcacccatattgtattgcctcccttttgtctagtcgttaaatattctacccagaattgaattcagtattttacatatgttctaaccagcacagagtgtaatgggactagtacttaaacaggtcaagacaccctatttcttaatgtactttgagattatgtaagcatttttaagcaatatcgcataccgttggttcataatgaacttacagtccactgaaacactagatctttttgtattaattgttgccaaggtcaagtttccttctgaacctgcacagggactgaggctgctgctactttttcatctctctgttccagggaccatatgatttcttatctctgtttctctttgtgtttttgttcctctctactgtgtctctttgaccctaagcaatgacctccttccttgttataaaatttcactgattgttttacagtcttcattctctttctttcctttcggcttctgggccaccacacttttggctttcccatttggtcctcctcagtctttgtgagtctctatttatctacctttccctcaactgttggttgtgctttgggttttatctttggcactattttttttttctgtatgcaatatatcttcagcaaataaatcatgtttaaaatggcagatctaactgagctcatctgggaataaaagggcacagaatcagtcccggaggaaagtcgacatttagaggtcaggtagaggaggaagagtcagcaagaagacaaaaagagcagccagagatgtaggagcatttcaagaaggagggtcggtcagcagtgttgactgtgcctaagaggtcaagtaaggtaagaatagagaagcaaccactgtattttgcaatatagaggctgttggtgaccttaggaagcatggttttctggagttttaagggcaaaagctggattatagtaagtagaagagttgaaaggaggcagaggagcagagataatgcgtaacgatgctttgaagaaacagaacagggccaggtacggtggctcatgcctgtaatcccagcactttgggaggccaaggcaggtggatcacttgagcccgggagttcaagaccagcctgggtgacatggtgaaaccctgtctgtacaaaaaaaaatacaaaaatagccggacatggtggcacacacctgtagtcccagatactccagaggctgaggtaggaggatcacttgagcctgataagtggaggctgtagtgagccaagattgtgccactgcactctagcctggagcttgggtgacagagcaagaccctgtctcaaaaaaaaaaaaaaaagaaaagaaacagaacagtaggatccacagttagggaggctttaggatcaagggagataaagtataagacagcaatttggaaactataacttactgcatatgtgtaaggagaattctagaaagaagatggttgagatcacaaccctggggaacaacttcagttagagagtaggaatgaaaaagagatccccaaaaggcattcagcccaagagacagatgagcaccttctgctctgtgtgctgtccttccatgctgggattgcaataaggaatctgcacattccttgatctcaaacagtttatagtttgctgttgtgtttcacaaagtatgtttgtgtgaatcacctgcatccagacagacttgtattaaatacagattccagggccctacctcaggcctacggaatcagaatttcaggaagtgatgccaagagtttgaatttttagcaaatgactcatactctgccacacaagatgattcgtattcccactacagtttgagaaccactggtatgttgggtactgagcatgttaacaaataagagtaggtttaacagttaatcgaagactagacaaggatttgttcatctctttttatgtttatgccattaaataagagaagctgggcttgttaggtgggaaataatagcacatattcataggcagacataaggaaaataatcttaaactcatgccatatggttttagtaatgttttgtttatgaagggtcttaccattcctttcttgtggaagctttgagttattttcactttgtttctgttatggataatgcctttatactggcagtgtacagtaaaaggctaagattatgagctctagaaccatactgcctaggtttaaattgcagctccacacttactagctctgtaatttgggggaaattatttaagtcatctgtgcttcagttttctcatctataatagaagtatcataatagtgtataatctcattgagttgtgaggattaaatggattaataattataaagtatttaaaatggtacctggcacatagtaaacaataaatataggctatttttattgttaatagttatctttgtgaatctagagtcttaacttctgttgaactatttctctaggataaattttcaggatggaatttctacattaaagaatgaagacatctttatgtccctttgctatctatagtcattgcttttcaaaagggtgatatctgtttgtgctataataatttgtaaatgcaagctatcaatggtgtgtgtgtgtgtgtatgtgttttgtatgtctctttatatgaatgcatacaagcatggcttaggttgtaagtttgtagaaaactttgaccttctttttaagcctgctcttaagtctgttgttaagtttcatgttatagtgcctcgttagatactatctccaggtagtatgttgataaatgatagtaagttacctttgaaagattatgtcaaagaaatattctaaatctgtgtctttttccttttgatagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaagtgagttctgttctgcatgtggtaagggatgaaagaagggaattctgttactctaatcagaacggtagaaaagtagaaaacaagcttctaggtacataatttgaataagctgacagaatagtaaccttcaccaacttagaaaatatatctggttttgttacttataaatttaacttgtaattattttattctattattgaagtgatattttattttgaagaaagatgaaatgttaaatgtaaaaatgactttgctctagagctgtgtgatatgtgaaaataattcagataagatagataatgttcctttgttcattctttcagtaaatatttactgagcacttaactattgccaggcactttgcttggtgctggggatataacaagatatgtggtatttgccctcataagggttatagtttaatgagggagaaagtcaaatccacgatgtcaagggttggggggatgggaagtagtagataggagaatggtattccaagtagaaggaacagcaggtagagaagtatggaggcatgagatcatagggcgggcatatttagggaactgcagactgttctctgtgactggtgcccaggatggtgaaaataaagctagagagatgggtagaagaaaagtcatgtagggccttgtaggccatattaagagcttggactttaccttgtgggcagtggaaaggcattgaaggttttcagccagggtgtgacagagtcaggtttgttttatttatttatttatttatttatttagaaacagagtctcactctgtcacccaggctggagtgcagtggtgcgatcttggctcactgcaacctccatctcccaggttcagatgattctcgtgccttagcctcctgagtagctgggattacaggcgtgcaccaccatgcccagctaatttttgtatttttagtagagttggggtttcaccatgttggccaggcttgtctcaagctcctgacctcaggtgattcgcctgccttggcctcccaaagcgttgggattacaggcgtgagccactgcccctggcccttcagtcagtttttgctttagaaagatcactctggtggcttattagagtggccatagttgggaaatcttagtaattagttttaaaaagtgcctcaaccttccccgttggcacttaaaaatcttttcttacttaacccagccttacttccttagttcttatctcagaatgaggtccttattactttctatggctaaccccttatacagtttaaggtgtactctaagctactatgagagagacccccaagatacagtattaattttaatgagatagtccagagatgagtggtttgggatgttggggtggctctgccatttccaattccctaattcccaaagcaattagtgctttccacttctggccaaggcagctcctttggtgcttgttatatcccagtgcttgcccagtaattttaaaggcagggcccagaagtggcctgatattgttgagaagcttccacttacatcttactgttcactacacagtcatgtagctagcatagctagaagggaggccaggaattgtcatctctggctatgtagtcgtaggctcaactaaaactctgttactctggaggaagttataggatatcaggggatgacttgcagtcttccagtctactctcctggccacccagatatttcagtgaacctttcttcccaaacatagaatacgcctcttctctgagagaggtagctccaaagacctatctagtcactgtgtttggctccaagtccagcatgtctaggtggtacacagtcctatccatcaggccctggtgtggctcctgtggtccactgaccataaagtaaaagataagtcatatgttttccctgctttcccagcctaacccagtagacaatggtgaaataagaaaaggatcatcacagtgagagttacaaactcccatttggaaaagggaagaatgagaaacatgtagaagtcattgctttccagtaatgatcaaataattgcctcacacaatttcaaagactccctattctgaccaggaagtggttagtggttctgctttcttggaggaactccctcaccctttttccctgactcctggctttgttctccaggaagtttttcctttctggccacatccaaaatggtagttagagagtatatcatctttgggaattgtacccattttgtagtcctcttgctgccagcgtaggtttgtgggcctagaggttaggggttaaataatcttagcttcttatgattttggctttatactttctctaaaaatgtattagacttacagtctttgtgtttctaggcagttcctgggaaaatgtccagggaaagcacatgtagtcgtccttttagaggcaagactgggaaatagggcatatatcttccactcatgtattatgagccagaatttagtcacagccatatgtagctttaagagagtatagaatatgtaatccaattaaaatgcagttatagtagaaggagatgttatctgtctgccatgcctctctgcctgtgtctctgatctagctgtgttatttcgagctttggtacctttttttcatgcttttgttatcttctaggaatgctgttctccccctaagcctccttgtaaacttttgctcactttacaggtcccaagcgaaatactttcttaatttgtactttaatgcttctaaaagggcagttctgatcatattccttccttcaacagatactgtctgccctcaaggtaaaattccttaacgggacttggaatattcttcaagatctgccactttttccttctgtgggctcatcttttactactttagtcctcagttttgctttccagccatacttcatacttagccatttacaattcaatgctaggttctttctctcttcctagcctttgcaatagctgttaccttttactggaatatatttatctacttaattttttaaaaatctcactttgtgtgcctgagcttagatgtttccttttccagaaacccctgaacattaacactgagtcaggcaccgcaatcagacactctttttatgtgtctacatagcatctagtttgttcatattgtaacacttttcacactgtattattattattattattattattattgagacgaagtttcgcttttgttgcccaggctggagtgcaatggcgcaatctcagctcaccgcaacctccacttcctgggttcaagtgattatcctgcctcagcctcccgagtaactgggatgacaggcgtgtgccaccacgcctggctaatttttgtatttttagtagagatggggtttcaccatgttggccaggcaggtctcgaactcctgacctcaggcaatccgcccgcctcggcctcccaaagtgctgggattacaggcatgagccaccgtgcctggcctcagactgtattataattgaaatgattgtttatttctgtaccctgactgtaggcttcttgatggcagggatcataccttgttaccttttgtggcctgtgcaccaagtgacttacaagtctggtttaggagaaacaaattttatggggaaagtgatgactttcattctgggcatgtcatgtttaagctgtctatggtatgtccagttggatatgtctagtagacagtagtgtaggtagtcctggagctcaggagataggtcagatggagatttgggaatcattggcataattgtggtagctgaaaacaaactacaacaaaacatgagagtgcatgctgccctccagggagtaagtaagtgtgaaaaaagcaggaggctaaggaagctagaaaacgttagtgtagagggaaagggactatgatataaaccaggtatattagcctgcttgggctgctataacaaaataccatagactgagtggcttgaacaacagatacttgtttctcacagttctggagactgcgtgaggtgcccgctaattcagttcttgatgagggccttcttcctggctggcagatggccaccttcttgctgtgttctcaggtggtggaaagagagtgatctttttcttcctcttttttaaagccactaatcccatcacgaggaccccaccctcatgacctcatctaatcttaagtgcctcccaaaggccttgtctccaaatatagtcacactgtaacatatgaattttgaaaggacacagttcagtctatagcaccaggcaagcctgatgtcaagaaatctagtgaagataaaacactttccaaaaggaagtggtcaacactatcatatgtttcagagagagccactggatatggcaatgtggaagtcattggtggaaatggtgcaaatagttttagagtattggaggaaaagattttgcctgagttcctgtatctccttgtaattcatgtcagtcctctgtgaacattaatataattcaacaggtacccctatctatccacttgcccaaggtacaaatgtgggaggcaaaatttagttaacctgtctcacgccagtcaccaagttctataaatgctgcctcctatctcttctctgtccctttttctttattacccattctactttagtttatttccctcctcatttcttacccggtatactgcagtagtctcctgtctggtcctcctttgagtcagttttccgcactctagccaatgtgtcctttgttttttttttttttttttttttaatgtgtcctttttaaagtgcaaatctgatcacaccctccctaggctaaaacttttggatgtttattcattattcttaggataatgcacagtgtggtttataaagtcttgtataacctggtttttgcttacttctccagtcttgtctgtccagataattcactttttcttcacattctgtactctagtcatgtgagccaattttactttcctaaatctattaggtgctgttttacctctaggcccttatgcttgctgcttcctctctggaaaaactctttgctcacttttttttgttgttgttgttttttgaaacaaggtctcactttgttacccaggctggagtgcagtggcgcaatctcagcttactacagcctcaacctcctgggttccagcgatcctcctgcctcagcctcccaagtagctgggactataggcgtgtgccaccacacctggctaatttttgtattttgtgtacagacggggttttgccatgttgcccaggctggtcttgaactcctgagctcaagcgatctgcccgcctcagcctcccaaagtgctaggattacaggcatgagccagccaccacgcctggcctttcgctcactctttaccttgccatctgttacttattcttcaggtcttaaatcagacatcacttgttctgggaagtctttctggttaccctttggcaaatctccatttcgtgcctcatctattaatgtgtccccagagcaccatgtactgcctttaactttcctgtcatcctgtttgccatgctgcactgtaattccttacactgtgatccctatgaagactgggacttggtggttttgcttttttgtatcctcagcatccagcacagtaactaactcaaagtggatactcaaatgttgagaatttggtagaaaagatgtttgctttaagaacttaggaaaaagcaaagaaaaccatatggcctattgggggttaatcttaattacatcctcctcctaagatgtcatctcttgttcatgctttaagagtccaattatgcttttgcagctatcgttctaatgggtaatacacatgctgttgtgctatgtagctagaatagagatctttttatttcttatgtacttctatcagtttgacttgaaagaaacaggtatattgggaaggggaagagggagaagagactgtatccgtaagtaatatggtgacattggcagtactgaacgtgcttatacatagatagaagatagaagtaaaagtgatgttgcttataaccacagtaagttttatatcttttattctacagttatttgtttcattacatctgccaagacaggattgtatatctttgtatcactgatgatgtaagtaacttgaagacatattgctatttaactatgtgtactgttaatacagccagttcttaattatctataccaggggtccccaacccccagggctgcagaccggtacaggtctgtggcttgttaggaaccaggccacatagcaggaggtgagtggcctatgagcattaccacctgagttctgcctcctgtcagatcagcagcagcattagattctcatatgagtgtgaaccctgttgtgaactctgcatccgagggatctaaattgcatgctccttaggagaatctaatgcctgatgatctgaggtggaacagtttaatcccgaaaccattcaccctcccccagtccttggaaaaattgtcttctacaaaaccggtccctggtgccaaaaaggttggggactgctgatctgtacctatagtgggcaaacgtgatgcgaactttacatagctggaattgttaatattttgcatttgtcatatagagcagcaaatgttaagaaaacttgatactggggtatgtgcaaatcaactcaattttggtagagttttagcttagcctcttgcaacttctatatttattctattttgtagtgagaattgatgttcataattataattctttgatatcaaaacctctcaaaaattgtttacgtggaatgttaaattagatagcatcatttcttctatcagtagttaatgaatcctttaatgtatgtgaactttggaaaaacaaaattacaatacattatgatcagctatataaacctgtagtttacattggttaggtatgactgtttgtcggctctcagcccaaaattctcagtaacttaatgatgtcattaaggtcctttctcttctctgcttatctccgtgtctccttcttcccagacaggttgccattatggtttcgtagagctacatacttatttattcatgtccggagtagagggactgtgtcttcttgagtgtcttattgtaggaatgaggaagcttttcccagctgcatgccctcccctccccctgctttcaaagtgaacttcctttcatgtcttattggctgcatgctcatttctaaactgcctactggcaaagagacttggaattggcatggttgccatagatcagggttcctaatctttattgtatcacagactcgtcacttgtgggacactcccagaatgtttttgttttctttttttaattttccttttccagaatgcttttaaatgtataaaacacacacaattctaacaaagccaattatattgaaatatatatatatatagtattcaaaatattttaaaaacttgatgtagtaatatatatgcttctttatgaactcattaacaagatctagtcataggtctaataactaatagtcttgatgtgatgggtgttgacagtattttgagatatctgtaactgtgatggtatacaaaaaaagatttctgttggtgacagttacaggtactgtttaatactaccccgattatgaatatacaacctatattcacaattgaaatataagttaacgattgataaaaataatgatgtgattttctttttttctatccaagttcaaaggccccttgaatttggaccattgaccccaatttaagaacccttggcttagactaagcatcttgggtgaaagggaaatgactgtcaaccatagtgatcatcacaatgatttttatctctggcttcacaatattttccaaaagtacgaaaaaatctagctatatgtgaaatgactgatgtgaaacagcttggaatagaaggaaaatactaatgaaatctgggatagttagagtcgagcctcatatttcttgagctataatttgatacacacatatacatgtatacataaacacacatacacacattcatttttttcctctaaggtattcttacagagaacacacatactttttggctggctgggattagacatgagtatgtcacttgatcttttcaaatataccaccactattgaaaaaattcgatttgaagttaatatcagtagtagtatctgtatgtgtgaaagactctatgattattatgggatttattaaacatattcttgtgctgggccttctaatagatcttatgaaatatatggaggaagtaaaattcaattcctgatgtcaagaagttgataacctaggtatcattatcttcagttgtcaatgaccagatatatctggattcattctcagctctttcatttactagttgttggacctttggacaagttagttactttttcagagccttcctttacttatctttaagataggatcaatgctagttcctcctcagataatcattgctcagtaaatgttagctgttttttattgttgttcttaatcactcacatcatctttgtttactttctaaatgtgagttctgtgttgatctcttttcaggattttgaacgttcccgagcctttaattttctgaatgagataaagaagaggttccagactacttacggttcaagagcacagacagcacttccatatgccatgaatagcgagttctcaagtgtcttagctgcacagctggtaagatctttctcaggataaggtattttgatttatatcttcttcattaccttcaaacactatgaatctagggggccctgacctgcaatatagttttctgattgtgttactgtaagccaacataataaaacttccctgattaaaaaaaaaatgtaaaggggccattttagggtagaaaacagtgatagtctttattatctctattaatagtggtcacagtgtctcatgattggaagagcattaaagatcatctagttgaactacccatctgatgcttaaatgtgttcagcatgccaaatgatcttttaaactatacgtaaaccttctacccttccatgagggaaatttaattttctaacaacccaaattaataatttgaaactctcctcatctgtatgaatccctaattgtcagcttagtgaggttttacatgtgaatatacctgtgaaataccactgtacttaagacagcattttaatcaccctaaaagttccctcatatcccttaccagttggtcccctcccctacactttgccccaggcaaccacggatctgttttctatcactataaattagttttgtctttcatagaactttctgtaaatagaatcatacagtatgtaaactttctgtaaatggaatcatacagtatgtacttttttgtgtcttgcttgtttcagtcagtgtaaggctcttgatattcttccatgttgtataaatcagtagtttgttcccctttttgctaagtagtagtatatgcatataccacaatttgtttatccatccacctgttgctggatatttgggttgcttccagttttcagctatcatgaataaagctgctgttaacctccatgtataagtctttgtgtggacatatgtttttatttctctctgataaatacctaggaatggaattgctgggtcatatggtaggtgatgtgtaattgaaaaaaaaaaatcaccacttttttttccaaagtggttgtaccattttatattctcaccagcagttccagtgtctctgcgtccttgccagtacttgatgtggtcttaagttttgccattccagttgatgtgtaatggtatctcattgtggttttaatttatgttttcatgatgtcagacacctttcgaaatgcttcccttttatccatgaaactatttgagtataaagacgtaagctctagctatgattttgttgtgagtttaaaaaaaagctgtattgtaatggaatactttcacttctcctgtggttttaatactctgagtattacatttctaaattttatgcacacacacacacacgcacacacatactcttctggcaataaagtccctttaaattggttacttataaacctttattattcaagcagttggtttgtttcatactccccactaggaaatgttcatctgtgtaaaactgtgtaaaacactacccacaacaaaaataccagtacttagtcaaaagtaaagggtcagctagaaacaaaactttcaaattaaccaatttgtcattagctctagatctgtgtgaccttctgaacaaaatctctacctgttcctttgtctgtaaatagagataatagcatcgtttcatagagttttggggtggattaaataatatcccgtttgaagcacttaacacaatgaaatgactggaacattgtgtattaagcaccccataattgctagctatggataaataatttcaaactatatattatcagtgtcttagattctagatcctgtgagaagccaataaaaatagtttatatgctgtgatcctggcagatacaagaacagattctgagaagctgggccagcccctacctcatcatactcaagaagtggggaacaattttgcagcattctttcccccactgccccaactacagtcttctttttctcctttcttccttgtctgagcacagattatatatcccccccaatctctgccccacaagtcacatgtatatttgatataatgtttatttttattttatttaaaataaggtaatttttagactacatacttatagtttgtatagaagcattttttatgctgcccatattttttcctgggtattgtaacatttttccagtgaagtgacatgtatcttttatatcaatagagacataattttatagcattcctcagtgtaaattgtcattccccttatttttgttttcctattgtaaataatgtctaggtaccataagttaaaacttattttcttatagaagcatcactctgagaataagggcctagacaaagtgatggagactcaagcccaagtggatgaactgaaaggaatcatggtcagaaacataggtatgtttcatggcatagtttcatgcatgtgggcaaaaatgataaagattacttgactggggtcaaattattctagagaagccaaaatagcacttccttattcttaccattggaagttaattgtcagctgagacaactgtgatactgtctgcttgtgcaaatggtttcttctttgtccttgcaactattcttcattctaaatttactagtttgcttaacaagactaatttctaagaaccttatgataattcagcagtttagaataatttggtcagtgtgattgtacagtatttcactgagttaatgtatcacgggttacctaaccttgcctgaattttggacgcataggttctttagcacagtgttagagtgctgttttgcaaccagataaggagcttgctgaagaatgtcaatcaatattgtgcttccttcactgaggccctcttgctatgaaaatgtcaattggactgaacagtatgcttagagacttagtcaaccagttgcaaatactcttaagtaggactgatttagaagtttatcctacagtagtaaccatactgttatatttttgtgcctattatgtttttcttattttcttgagattaattatcaggaatgggattaataatcaaaatgcgcaaacgttttcgtggttcttgatatgtacgtcttggctatttaaagtgatttcctttaattgattttagttttaattatatatctagatagagactagagaatctgttgagacaactactatttatttttattcttttttttgtcaccaaatgtatttattttgcccgaaagtggaggcagacaattgctacaatattatttattgcagatgcataaagtttccagaaaaatcaacgtttttaatcgactccttttaaatgacttatttatttttagagttatagaaacagcaaatttaatccatcttgaattaatttttgtataaggtataaggaagggatccagtttcagctttctacatatggctagccagttttcccagcaccatttattaaatagggaatcctttccccattgcttgtttttcttaggtttgtcaaagatcagatggttgtagatatgtggcgttatttctgagggctctgttctgttccattgatctatatctctgttttggtaccagtaccatgctgttttggttactatagccttgtagtatagtttgaagtcaggtagcatgatgcctccagctttgttcttttggcataggatggacttggtgatgcgggctcttttttggttccatatgaactttaaagtagtttcttccaattctgtgaagaaagtcattggtagcttgatggggatggcattgaatctataaattaccttgggcagtatggccattttcatgatattgattcttcctacccatgaacatggaatgttcttccatttctttgtatcctcttttatttcactgagcagtggtttgtagttctccttgaagtggtccttcacatcccttgtaagttggattcctaggtattttattctctttgaagcaactgtgaatgggagttcactcatgatttgactctctgtccgttattggtgtataagaatgcttgtgatttttgtacattgattttgtatcctgagactttgctgaagttgcttatcagcttaaggggattttgggctgagacaatggggttttctagatatacaatcatgtcatctgcaaatagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttccgtttatatgctggattacatttattgatttgcgtatactgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgattgtagtttgtatttctgtgggatcggtggtgatatcccctttatcatttagacctaaaaccataaaaaccgtagaagaaaacctaggcattaccattcaggacataggcatgggcaaggacttcatgtctaaaacaccaaaagcaatggcaacaaaagccaaaattgacaaatgcgatctaattaaactaaagagcttctgcacagcaaaagaaactactatcagagtgaacagacaacctacaaaataggagaaaattttcacaacctactcatctgacaaagagctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgtgataccatctcacaccagttagaatggcagtcattaaaaagtcaggaaacaacagttactggagaggatgtggagaaataggaacacttttacacagttggtcggactgtaaactagttcaacccttgtggaagtcagtgtggcgattcctcagggatctagaactagaaataccatttgacccagccatcccattactgggtatatacccaaggactataaatcatgccgctataaagacacatgcacacgtatgtttatagcggcagtattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcctcattctcagtaaactatcgcaagaacaaaaaaccaaacaccgcatgttctcactcataggtgagaattgaacaatgagaacacatggacacaggaaggggaacatcacactctggggactgttgtggggtggggggagggggaaggatagctttaggagatatacctaatgctaaatgacgagttaatgggtgcagcacaccagcatggcacatgtatacatatgtaacaaacctgcacattgtgcacatgtaccctaaaacttaaagtataataataataaaataaaataaaaaaagcaaatttaaaatgtgacaagaacattcctagttaattccctttcatttttttaacagcttaattgaaatataattcacatatcatataattcacccatttaaagtatacagtcagtggttactatattcacagaattgtacaaccattgctgcgatcaattttgtaacatttttatcatccctaaatgaagccctgtactcatttgcagttgctcctcaactctcagacctaagcaacaattaattcccttttcttcttcataaatttgcctattctggacatttcgtataaatggaatcttgtaatatgtggccttttgtgtcttcgttcacttagcgtaatgattgtgagattcattcatgtcgtagcataaatcaatacttaattcttttttatgactaataattccaatgcattaatgcattttatgtatctactcattagttcatggtctggttattataaataatgctgctatgaacatttgtgtacaagtttttgtgtgagcatatatatatattatatattatatatatatatatatgtttttggttctcttgcttacatacctaggaatagaattgctggatcacatggcaactttgtaacattttgaagaagggccaaactttcctaaagtgactgcacctttatacattcctaatagcaatgtatgaggattctgattcctccacatccttgccaaaacttatcttttttgattatacccagtctagtgaaatggtactttattgtgattttgatttgcatttccctgatgactaatgatgttgagcattttttcatgtgcttataggccattcgtatattttctttacctttggagaaatgtctatttaaaaatactttattgtttttaagtgggttatttgtctttttatggttgagctataacagtactttatatattctggatactagacccttatcagatacatgattttcaaatattttgctctattctgtgagttgtcttttcattttcttgatggtgttctttgaagcacaacagtttttatgaagtccaatttatttttttctttagtttgtgctttgaataacatatctaagaaactgtcgcctaagccaagatcatgaagatttactactttgttttcttctaagactagttttagctcttacatttctatctatgatctattttgagttaatgtttatgtatggaataaagaagagatccaacttaattctgttgaatatgtatatacagttgttccagaaccatttgctgaaaaggcttttctttccctgttgaatgatcttagcattcttatcaaaaattagttatcaatggatgtatagctttgtttctggaccttcagttctgttcagtttatctttatgccagtaccaggctgtcatgattattatagctttgtagtaggttttaaaatcaggaaatattcatcttccaactttattctttctcaaaattgctttgactattctgggtacctttcattttcatgaactttaggatgagcttgtcaatttcagatagcaaaaaaagctatctgggattttgatagggattgtgttgaatctgtagatcaattagggagccattttaacaatattaaacttctgatccatgaacatgggctttctttctattcatttaggtttctttaattttttccaacaatgttttgtagttttcagtgtgcaagtcttacatgacaaagactctgcttcaccaaattttagacaagctcctctgagcactctgttaaactaggtctcatcctcgggctctgtccttggcctgcctaaggaagtcttagcaaagaatcctgctaataccccacccttgatcaagttccttgtcccctatatttgttatataagtccggccagcttttagcaggaatcctgttaggccagtttagagagaatccccttgcccttgatgcctcctcttagtaattttccatcctctgaccccctcactctgttcattggccacaaatccccactggtcttggttgtgttaggagttgagctcaatctctcccctccattgtgatagccttgacccctattgcagtaatctcaaaatctgccttaccattttttaaccagtgtcagaataatttttctttaacaatatctcttctaacatccttcttgccttgttcctaagtatttttttatgctattgtaaatggaatttttctctttcattttcggattgttcagtactaatgtatagaaattttattgatttttataaattggtgttgtatcatacaaccttgttctcctttattagttctaatagctttttaatagtttccttaggattttctctatatagaatcatgctacttgcaaatagagatagttttaattcttccttttcagtctggatgcttttcatttctttttattgcttatttgccctagctagaacctccagtataatgttgaatagaagtggtaagagtggacatcattgtcttattcctgctcttagggagatcttgaagaatcttccacaattaagtatgaggttagctgtgggtttttcatagatgtcctttatcaggttgaggaagtttctttttcttatttgttgagtggttttatcattaaacagtgttggattttgtcaattttttttacatctattgaaatgatggtttttgttctttattaatatgatgtattataacaattgattttcagatattaaatcaaccttgtgtttctgaaatgaatcccactgcatcatggtgtatagtcctttttgcatattattggattcatcctgccagtagtctgttgaggatttgttaaatgtctgtatttttaagagttgttggtatatcattttcttttatttatttatttattttattatttttttttattgatcattcttgggtgtttctcacagacggggatttggcagggtcatgggacaatagtggagggaagatcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttcttcacagacacagcaaccatccgatttctcaatcttttccccacctttcccccttttctattccacaaaaccgccattgtcatcatggcccgttctcaatgagctattgggtacacctcccagacggggcggctgctgggcggaggggctcctcacttcgcagacggggcggctgccgggtggagggtctcctcacttctcagacagggcggccgggcagcgacgctcctcacctcccagaaggggcggcggggcagaggcgctccccacatctcagacgatgggcggccgggcagagacgctcctcacttcctagatgggatggcggctgggcagagacgctcctcacttcctagatgggatggcggccgggcagagacgctcctcactttccagactgggcagccaggcagaggggctcctcacatcccagacgatgggtgcccaggcagagacgctcctcacttcccagacggggtggcggctgggcagaggctgcaatctcggcactttgggaggccaaggcaggcggctgggaggtggaggttgcagcgagccgagatcgcgccactgcactccagcctgggcaccattgagcactgagtgaacgagactccgtctgcaatcccggcacctcgggaggccgaggctggcggatcactcgcggttagcagctggagaccagcccggccaacacagcgaaaccccgtctccaccaaaaaaatacgaaaaccagtcaggcgtggcagcactcggcaggctgaggcaggagaatcaggcagggaggttgcagtgagccgagatagcagtagtacagtccagcttcggctgggcatcagagggagaccgtggaaagagagggagagggagaccgtggggagagtgagagggggagggggagagggagagggagagccattttcttttcttgtgatgtctttggttttgataccagggtaatgctgggctcatagaatgagtcaagaagtgttccccttttcttctattttggaaagatttgtgaaagttttgtattaattcttgaaatgtttggtagaattcacctttgaagccacctgggcttgggcttttctttgtgtgaagcttttttgtttttgtttttgttttttgagatggggtctgtctgtcacccaggctggagtgcagtgacatgatcctctctaattcctctttcattcccttggtgggagggttacctgcagccttgacctcctgggctcaggtaatcttcccacctcagcctcccaagcagctgggactgcaggcatgtgccaccacacctggctaatttttgttttttggtttttttgtagagacaaggtcttgccatgttgcccaggctagtctcaaactcctgggctcaagcgatccacttgcctcagcctaccaaagtgctaggattacaggcatgagcctccatgcccggcctgaagttttaaaattactgatttagtctctatgcttgctgtagctattcagattttttatttcttcttgagtctgtttagcagtttgtatctttctaggaatttgtgcatttcatctaagttacctaatttatttacacactcctgtttatagaattcccctaagatcctcttcattttgtaagtttggtggtgatgtctcctctttcatttctgattttagtaatgtaagttttttctgttttacttggtcattctacgtaaaggtttgtcaattttattgatctttctaaagaaccaacttctggtttcatagattttttttctatagtttttctgttctctatttaatttgttcaccctaatatttatttccttcccactgctagctttagatttagtttacccttcttttctagatccataaggtagaaagttaagttgttaggttgttaatttgagatcatttgtcttagctcaggctgccataacaaaattccatagacgtagtgacttaaacaacagaaatttattttctcacatttctggaggctagaagtccaagatcacggtgccagtatggtcaggttctggtaagggctctcttcctggcttgcagacagcatcttctctctctgttctcccatcaggcaaggaaaagagagctagctgtctagtgtcttttatttaattgatacataatatttgtacacatttatggggtacgtgtgatattttgttacatgcaaagactgtgtaatgatcaagtcaggatatatggggtgtccatcagctcaagaatttatttctgtgtgatgggaacatttcaaattctctcttctagctattttgaaatatataatacactattgttaactttagtcaccctactctgctatcaaacattagaacttattccttctatccaactgtgtgtttgtacctattaaccatcctctcatattccctgctcggccccacatacccacacccttcctagcctctggtatctattgtgctattgtctacctccatgagatcaactgttttagttcccacatgtgagtaagaacatgtgatatttgtctttccatgcctgccttatatcacttaacataataacctccagttacatccatgttgctgtaaatggcatgacttcattctatttcatggtcaaatagtattccattgtgtttataaaccacattttctttatccattcatccattcatggacacttaggttgactccatatctttgctattgtgaatagggatgcaataaatatgcaagtgcagatatcccgtctatacactgatttcttttcctttgcataaatacccagtagtaggattgctggatcatatggtagtttaatttttagtttttggggaaatctccacactggtttccatagtagctgcactagtttactttcccaccaacagtgtgtaagtgttttttttttttttccttatactagccagcatctgttattttgtatctttttagtaaccattctaactggggtaacatgatatctcattttggcttttatttgcatttctatgatgttgagcattttttcatataccttttggccatttgtatgtcttcttttgagaaatggctattcatgtcctctgcccactttttaaggggattatttgtatatctcctgttgagttcattatatattctggatattattcccttatcaaatgaatagtttgcaactattttctcccattcaactggttgtctcttcactcttgattatttcctttgctgtgcaaaagcttttttgtttaatatagtcctatttgtctatttttcttttcgttacctgtccttttgaggtgttagccataaaatcttttcctagagcagtgttctgaagtgtttcccctatgttttcttctagtaggtttatagttctgggtctgaaatttaagtctttaatctatcttggttgatttttgtatgtgatgagagacagaggtccagtttaattcttccacatatggatatccagttttcccaataccatttattgaagaaagtgtcctttccccagtgtacgtccttggcacctttgttgaaaatcagttgcctatatatgtgtggctgtacatacgtggatcaatgtctggcttttctattctattccatcgaccttgtgtctgtttttataccaaaccatgctgttttggttactgtagccttgtaatatgttttgaagtcaggtagtgtgatgcctccagctttgttcattttgctcaggattgctttggctatttggactcttttttggttcctgaaatactaattttaggattgttttttctgtttctgtgaaaaatgacattggtacttcgatagagattgcattgaatctgtagattgctttgggcttatggtcattttaataatatacattcttatgatccatgaccataagatgtctttctgtatctttgtgtcatcttcagtttttttcatcagtgttttgtagttttacttgtaggagtctttcacctactcgttaaatttattcttcaatattttatatgttcataactattataaatgggattaccttcttgatttcataaagttttatttcaccaagttgattattgatgcatagaaacattacagatatttgtatgttgattctgtatcctgcaactttactgaatatatttatcagatctaggagttttttggtggagtctttgggtcttttagacataagatcatatcatctgcaaagagggataatttgacatcctctttttcaatttggatgccctttatttctttctcttgcctgattgctctggctaggacttccagtattgtgttgaataggagtagtgaaactgggcttccttccagtactatgttgaataggagtggtgagagttttccatttcttagaggaaaggcttttcgtttttcccattccgtatgatgttagctgtgggtttgtcataaatggcctttatcatgttgagggatattccttctatgcctagttttttgagagtttttatcatgaagagatgttgaattttttttgataccttgaactatatatttttatttgaatatataaaagtagaatatcctattttccttttgagctatgtcatcatactgctaaaattatggatgaaaatggaaatatttcaacctgacccattgcaatttctatgttacacatttgctctttttttattattatactttaaattctgggatacatgtgcagaatgtgcagctttgttacataggtatacacatgccatggtggtttgctgcacccattaacccatcatctacattaggtatttctcctaatgctatttctcccctagcccccctacccccaacaggccccagtgtgtgatgttcccctccctgtgtccatgtgttctcattgttcaactcccacttatgagtgagaacacgtggtgtttggttttctgttcctttcttaccttgctgagaatgatggtttccagcttcatccatgtccctgcaaaggacatgaactcctccttttttatggctgcatagtattccatcgtgtatatgtgccacattttctttatccagtctatcattgttgggcatttgggttggttccaagtctttgctattgtgaacagtgctgcaataaacatacgtgtgcatgtgtctttatagtaaaatgatttataatcctttgggtatatacccaataatgggattgctgggtcaaatggtatttctggttctagatccttgaggaatcgccacactgtctttgacaatggttgaactaatttacacttccaccaacagtgtaaaagcattcctattgctccacatcctctccagcatctgttctttcctgacttgttaatgattgccatttaatggtcgccattcttactggtgtgagaggatatctcattatggttttgatttgcatttctctaatgacccgtgatgatgagcttttttttcatatgtttattggccacataaatgtcttcttttgagaagtgtcttttcatatccttcacacactttttgatggggttgtttttttcttgtaaatttgtttaagttccttgtagattccggatattagccctttgtcagatggatagattgcaaaaattttttcccattctgtaggttgcctgttcactctgatgatagtttcttttgctgtgcagaagctctttgctttaattagatcccatttgtcaattttggcttttgttgccattgcttttggtgttttagtcatgaaatctttgcccatacctatgtcctgaatggtattgcccaggttttcttctagggattttatggttttaagtcttatgtttaagtctttaatccatcttgagttaatttttgtataaggtgtaaggaagggggccagtttcagttttctgaatatggctagccagttttcccaacaccatttattaaatagggaatcctttccccattgcttgtttttgtcaggtttgtcaaagatcagatggttgtagatgtgtagcgttatttctgaggcctctgttctgttccattggtctatgtatctgttttggtaccaataccatgctgttttggttactgtagccttgtagtataatttgaagtcaggtagcgtgatgtctccagctttgttcttcttgcttaggattgtcttggctatgtgggctcttttttggttccaaatgaaatttaaagtagtgtttttctaattctgtgaagaaagtcaatggtagctggatggggatagcattgaatctataaattactttgggcagtttggccatattcttcctatccatgagcatggaatgtttttccattcatttgtgtcctctcttatttccttgagcagtggtttgtcattctccttgaagaggtccttcacatcccctgtaagttgtatttctaggtattttattctctttgtagcaattgtgaatgggagttcactcatgatttggctctctgtttgtcttttattggtgtataggaatgcttgtgatttttgcacattgattttgcattctgatactttgctgaagttgcttatcagcttaaggagattttgggctgagacaatggggttttctaaatatacaatcatgtcatctgcaaagagagacaatttgacttcctctcttcctatttgaataccctttatttctttctcttgcctgattgccctggacagaacttccaatactatgttgaataggagtggtgagggagggcatccttgtcttgtgctggttttcaaagggaatacttccagcttttgcccattcagtatgatattggatgtgggtttgtcataaatagttcttattattttgagatgcattccatcaatacctagtttattgagagtttttagcataaagcggtgttgaattttatcgaaggccttttctgcatctattgagataatcatgtggtttttgtcattggttctttttctgtgatggattacgtttattgatttgcgtatgttgaaccagtcttgcatcccagtgatgaagctgacctgatcgtggtggataagctttttgatgtgctgatgggttcgatttgccagtattttattgaggattttcgcatcagtgttcatcagggatattggcctgaaattttcctttttggttgtgtctctgccaggctttggtatcaggatgatgctggcctcataaaatgagttagggaggagtccctcttcttctgttgtttggaatagtttcagaaggaatggtaccagctcctctttatacctctggtggaattcagctgtgaatccttctggtcctggaccttttttgtttggtaggctattaattactgcctcaagttcagaacttgttattgttgtattcagggatttgacttcttcctggttcagtcttgggagggtgtatgtgtccaggaatttatccatttcttccagattttctagtttacttgcatagaggtgtttatagtattctctgatggtagtttgtatttctgtgggatcagtggtgataccccctttatcattttttattgtttctatttgattcttctctcttttctcctttattagtctcgctagcagtctatcaattttgttaatcttttcaaaaaaccagctcctggattcattgattctttttgaagggtttttcatgtctctttctccttcagttctgctctgatcttagttatttcttgtcttctgctacctttgaatttgtttgctcttgcttctctagttcttttaattgtgatgttagggtgttgactttaaatctttcccactttttgctgtgggcatttagtgctataaatttccctctaaatactgctttagctgtgtcccagagattctggtacgttgtgtctttattctcattggtttcaaaaaacttatttatttctgccttaattttgttatttacccagtagtcattcaggaacaggttgttcattttccatgtagttgtgcagttttgagtgagtttcttaatcctgagttctaatttgatggcactgtggtctgagagactgttggttacgatttccattttttgcatttgctgaggagtgttttacttccaattatgtgatcaactttagaataagtgcaatgtggtgctgagaagaatgtatattctgttgatttggcttggagagtactgtagatgtctattaggtcctcttggtccagagctgagttcaagtcctgaatatccttgttaatattctgtctcaatctaatattgacagtgggtgttaaagtctcctactattattgtgtgggagtctgagtctctttgtaggtctgtaagaacttgctttatgaatctgggtgctcctgtattgggtgcatatatatttaggatagttagctcttcttgttgcattgatccctttaccattatgtaatgcccttttttgtcttttttgatctttgttggtttaaagtctgttttatcagagactaggattgcagccactgcttttttttgctttccatttgcttagtaaataatcctctatccctttattttgagcctgtgtgtgtctttgcacatgagatgggtctcctgaatgcagcacatgggtgggtcttgattctttattcaatttgccagtctgtgtcttttatttggggcatttaccccatttacatttaaggttaatattgttatgtgtgaatttgatcctgtgattataatgctagttggttattttgcttgttagtcgatatagtttcttcatagtgttgatggtctttacagtttgatatgtttttgcagtggctggtactggtttttcctttccatatttagtgcttccttcaggacctcttgtaaggcaggcctggtggtgacaaaatctctcagcatttgcatgtctgtaaaggattttatttctccttcacttataaagcttagtttggttggatatgaaattctgggttgaaaattcttttctttaagaatgttgaatattcgcccccagtctcttctggcttgtagggtttctgtcgagagatctgctgttagtctgatgggcttccctttgtgggtagcctgacctttctctctggctgcccttaacattttttcctgcatttcatccttggtgaatctgacgattatgtgtcttggagttgctcttctcgaggagtatctttgtggtgttctctgtatttcccaaatttgaatgttgacctatcttgctaggttggggaagttctcctggttaatatcctaaagaatgttttccaacttggttctgttctccctgtcactttcaagcacaccaatcaaacataggtttggtcttttcatatagtcccatatgtcttggagcctttgttcattccttttcattattttttctctaatcttgtcttcacactttatttcattaagttgatctacaatctctgatatcctttcttccacctgatcagttcggctattgatacttttgtatgcttcacaaagttctcgtgccgtgtttttcagtcccatcaggtcatttatgttcttctctaaactggctattctagttagcaattcctctaaccttttttcaaggtccttagtttccttgcatggggttagaacattctcctttagcttggaggagtttgttattatccaccttctgaagcctgcttctgtcaatttgtcaaactcattctccgtccagtttgttctcttggaattttcagcctttttgcactggtttttcctcatcttcatggatttatctacctttggtctttgatgttggtgacctttggatggggtttctatgtggacatcctttttgttgatgttgatgctattcctttctgtttgttagttttccttctaacaggcctctctgctgcaggtctgctggagtttgttggaggtccactccagacccagtttgcctgggtatcaccagcggaggctgcagaacagcaaagattgctgcctgttccttcctctggaagcttcgtcccagaggggcacctgccagatgccagccagagctctcctgtatgagatgtctgtcgactcctgctgggaggtatcttccagtcaggaggcatggagctcagggacccacttgaggaggcagtctatactttagcagagcttgagcactgtgctgggattgccgctgctctcttccgaactggcaggcaggaacgtttaagtctgctgaaactgagtccacagccaccccttcccccaggtgctcggtcccaaggagatgggagttttatctataagcctctggctggggctgctgcctttctttcagagatgcgctgcccagagaggaggaatctagagaggcagtctggctacagggactttgcggagctgcggtgggctctccccggttcaaacttcctggccactctgtttacacagtgaggggaaaactgcctactcaagcctcagtaatggcagacgcccctccctccaccaagctcgagtgtcccaggtcgacttcagactgttgtgctggcaatgagaatttcaagccagtggatcttagcctgctgggctccgtgggggtggaatatactgagctagaccacttgcctccctggcttcagcccctttccaggcgagtgaacagttatgtctcactggcattccaggcgccactggggtatgaaaaaaaaactcctgcagctagctcggtgtctgcccaaatggccgcccagttttgtgcttgaaacccaggtccctggtggcataggcacccaagggaatctcctggtctgcagattgcgaagactgtgggaaaagcatagtatctgggccagagtgcaccattcctcacggcacggtccctcaaggcttcccttggttaggggagggagttccccgaccccttgtgcttcctggatgaggcaacgccccaccctgcttcggctcaccctccgtgggctgcacccactgtctaaccagtcccaatgagatgagccgggtacctcagttggaaatgcagaaattacccaccttctgcattgatttcactgggagctgcagaccagagctgttcctattcggtcatcttgccaaccaccctgagatgttgaattttatcaaatgctttttttatcagatgctttctctgcatctattaaggtgatcatgtggcttttattctctattctattgatggaatgtttcatgtttattgatttgcatgcattgaatcatcattgcatccctgggataaatcccacttgatcatggtgtattatctttttgatgtgatgtttgatttggtttgctagtatttcgttgaggatttttgcatctgtgatcatcagggttgttggcctgcagttttgtttttttgttgagtccttatcaggttttggtatcagggtaatgctggccttatagaatgagtagggagaattccctcctcttgaattttttggcatagtttgagaagtgatattagttcttctctgtaagtttcatggagttctccagtgaagccagctgattctgggcattgttttggttttgttgggagactttattactgattatactttattactgattcaatcccattactcattactggcttgttcaggttttctatttctttctgattcagtcttggtaggttgcatgtgtcctgggatttatccatttcttctgggttttcaagtttattagcatatagttgttaatagtatttctatggtcacttcttccaatttttagatttgctttaatatgcaaggactttttcttgaggatatatctatggtgttggttgggcagggcacttagactttgattatgggtacattcagtagtgtagtctgtataatttcttcagctataaacagcatcatcaaccatgtctgtatttttcttagtggcttagggtgtagttgttatggaggctgtggtgaagttttgatgggcatggggatttcaggtgggctagtccttgttttcgagtggtgtcaccagtgggtgaagcatgcctgtcctttggccccaggacagtgtattcattaagttatattacttttttaaaaaaagtttattttattctacaatggaaaacttgaccttttctacttttccaatattttcagatctggtagctcagcgaggagaaagattggaattattgattgacaaaacagaaaatcttgtggattctgtaagtatggaatctgataatatggagtctgatgtaaagtggagaaactatggatgatggctaacataattgggaaataccttaaattcaaatatttggtggtttttttttctttctcatttccattatgtgattactttgtaataatgaggataacaatgaggcatagaaaagaaacatcatcccctaatagccattaaggtagctttggtttggaaaacatactcagtatacagaaacaattttctaaagctttggattgaggcctatataatttagcacctcaactgcatgtaacagtctgttccctttacaaatttgtaaaacatgaaacaaatgtgcaagccgtttgtgacccagtatgaatcttgaaaactggacaattcacttttttgcttacactgatagtttcatcttgccttgtatcaatcaagagacatcgattggaaagcgccaataagccttaaaggagacaatgtgtccttgtgagctgcttatactatggttccgtatgtcctcacattttcaatgcagttactgtggatgaaagttttaaggaaagatgacagatatatggtgaacagaaggagggcagagatcagctacaatttgggtctacacaattataaatgtaaatgtacagtgcaggtttacaccttgaaagaaaacagtgattgattatgttcgttgtgactgacagctggattgtagtggttaagaacacaggctctagtatcaggttgcctggatttgaatcccacctctgctacttactagttgtgtgaccttaggcaaatgacttaacctctttgtgcctcagtcatcatcttctgtaaaatgaagatgtacccacttcagagcattttaaggattaaatcagataatgcatgtaaagtgcctaacacagtatttgatacatagtaagagctatttaaatgttcatcattattgttaattttacagggacatctattagcagcaggttttagtatatacagtctactatcaggttttctaggagtttataaacagttttttcatcaaagcatgtggtaggtggaggaaggatgctaccatacaggaagtcaaaacacctgggttctagatctcactttgtgacccattgctggggagcaaagaaaacagagaagtatctgattccagatctgcagaccaatttctttgatacttccaggctgtctcttagttattcttaattcttgaggattaccctgcttagggggaatggtctgtctttgaccaatagtagtatgatctgtactttacaaataaaagtcttaattttgttgacttcatgactgaaaacagaaggtactaatgaactaacaggtatctctctttatggtagaataacatacgtgcagcaaattgtatcaagtgtacaacttttaagtgtatagctcaattattttttatatatatctatacccatgtaaccaccacccagatctagatagaaaacattaccaacaccccagaaggctgcctcataccccttccagttaataatccccaatagacgtaattatgtttctgacttatatcaccacagatagtgttttgcctgttcttaaaatttatttgtgtctggcctctttcactcactgttatgcctgtgaaattcatccacgttttttattatagtaatcacttattcttttttattgttttatattattccattatacaaatctaccacaatttgtttatccgttcttctctgtggggctttatttctggattctctattttgttccattggtcagtttgtctacctttatgccagtaccacactgtgttgattagtataacttaatagaattcttgaaattaagtagtgtaagtcttccaactatattcttgttgtccaatattgtcttcactcttttaggtgctttgcatttccatatatgttttagaataagcttgttttccatctcttgaccccacaacaatgtgtatctttgtgactgcatttaatatataggtcactttaggggacattggtatcttgacagtatagagtttttcggtccatgaacgtgacatatctctgcttttgcttaggatttaaaaatttttctcagcagtattttttagtttttggtgtacaggtcttgcacatatttgttaaatttacccttgagaatatcatgcttttgtattgtgtaacaaatttttaaattttgtttctaattctttattgctagtatatggaaataaagttggttattgtatattgaccttgtttgtattctgcaaccttagaaaaattcatttaccagttctggttactgttttgtacattcctgccttttattttccttcccttattctggctagaaccttctacacaatactgaatacaagtgataacagtgaacatccttgcctattgaccatcttgtggggaaaaattcaatactttttgaaaaaaataaattcagtgttaagtttgtggttaactgtagattttttgtaggtaccctttaataggtggaagaattccctttaattcctcatttgagagttgtattcatgattttatcaaatgctttttctccatttattgagatctttggtttttctcctttattcagttagtatggcaaattacattgatttttcagtgttaaaccaactttgcattcctgcaaggtcatgacttactacccttcttatataacactttattggatttgctattgttttgttcaggaatttggcatctatgtttataagagatagtggtctgtaatttatttttctctttaggttttggtatcaggaatatgctggcctcattaaacaagttgggaaatcttacctctctatcttctgagtttgggtactattggtattatctgtcttagatgtttggaagaatttactagtaaagcagattgggcctcgagttttcttcgttggaaaatttaaaatctgccatcttgctgtttgtttcctatttataccatctagtctttgttccctttttgttctgccttccattggatttagtacatttgttattccattatgtctcctttgtcagtttattagctatagctccattctgtcattttctgattgctttagggtttacagtatgtctttgatttataatctcccttaaagtggcatttttccacttcatgaatagataagaaccttataatagtatacttctagctgtttcttcttggcctttatgctattgttgacatatttttatttacacatgtattaaaaacttcataatacattgttgttgtttttgtttaaagagttgattatcttttaaagagatttaaataataagggaagtcttttctgtttacccatgcagctaccatttcagtgctcttaattcttttgtgtaggccgagtttctatctgatgttattttctttctgcctgtatgctttaatttaacatataatcttccattgtagttcaagtgtgtaggtctactggaaatgaattctttcaggtttggtatgtctgagaagtttttatttcacttcctttttttttttgaaagacattttcactgagtatagaattctaggtcagtgatttttctttcttttaatacttgatgaacggtggttcatcactgtcttttacattgtttctgacaagaattctgctgtcattcttacatacataaagtgtatttttttttcttctggatgctttaaagattttctctttatcattggttttaagaaatttgattataatatatatgccttggtatatatttctttatgtttctttggctttgagtttgttgtagttttcatcaaattatgaaaatgtttagctctttctaggcttccagtgacatctgtattaagccacttgaagctgtcccacaactcactgatgctttgttcatttttaagtcttttttccactatgtttcatttagaatagtttctattgctatgtcttcaagtttacttaccttttcttctgcagttcgcaatctgctgtttctgtcctgtgtatgtttcatctttacaggtttgttttggatcttttttatatcttccatgtgtctccttaacatgtgcatactttcctctaccttgagtatatgaagtatatttataattgaagtgcttattccacttacatgtaatgcaaattttgatagagttaggtgtaggtatcttgctctttgttttttatttgccgcatccctgtcctcttcttttttattttgattactcaagtactttttaaattgttttttaaccatctctatttgttttttaacacttctattgagagataactcacagaccatacaaattgcccatttaaagggtacacttcagtggaatttagtatattacattattaaaattgtggtaaaatatgtatagcataaaattttgccattttaacctttttaaagtgcacaattcagtgatgttaattacatccacaatgttgtgcatccatcactactagctatttccaaaacttttttatcaccccttaacaaaaactctgtaaccattaagtaataataactccccattccccttactctcagcccctggtaactctaatctactttctgtctctgaatttgcctgttctagatatgtcatataagtgggatcatacaaaatttgcccttttgtgtctggcttatttcactaagcataatagtttattgcttaaaaaaaaatgctaacaatcacctgagccttcagtgagccttaatctttttgctggtggagggtctcaccttgatgttgatggctactgactgatcgatcaggctggtggttgctgaaggttgtggtggctgtggcaatttcttaaaataagacaacagtgaagtttaccacattgattgactctttcacaaaagatttctctgtagcatgtgttgctatttgatagcaatttactggcaatagaacttctttcaaaattggagtcaatcctctcaaaccctgctactgctttatcagctgagttgatgtaattttctaaatcttttgttgtcatttcaacagtgttcacagcatcttcaccaggaatagttgccatctcaagaaaccactttccttgcccatgcataagaaacaactcctcattcattaaagttttatcaagaaactgcagcagttcagtcatgtcttcaggctccagttctaattctagttctcttctatttctaccacatctgcagttactcactccactgaagtcttgaacccctcaaagtaatttgtgagggttgtaatcagtttcttccaaacacctgttaatgtttatattttgacttcctcccacgaatcatgaatgttcttaatggcatctagaatggtgaatcctttctagaaggtcttcagtttactttgcccagatccatcagaggaatcattatctatggcagctatactaaatgtttttcttaaataataagacttgaaagttgaaatcactccttgattcatgggcagcagaatggatgttgtattagcaggtgtgaaccccaaaagtctgagacaggtctcagttgatttagaaagtttattttgccaaagttgagagcgcacacccgtgacacagcctcaggaggtcctgacaacatgtgcccaaggtggtcaaagcccagtttggttttatacattctagggagacgtgagacatcagtcaacatatgcaagatgaacattggtttggcctggaaaggcggaacaactcgaagcaaaggcgggaaggctcgaagtggggagggggcctccaggtcttagatagataagagacaaatggttctattcttttgagtttctgatgagcctctccaaaggaggcaatcagatacgcatttatctcagtgagcagaggggtgactttgaatagaatgggaggcaggttggccataagcagttcccagcttgacttttccctttagcttagtgatttggaggccccaagatttattttcctttcacacaggcatgaaaacgacatttatctcctcgtaagtctccatcagagctcttgagtgactaggttcattgtcaatgagcagtaatactttgaaaggaatcttttctttttgagcagcagatctccacagatcttctgtacaccatcctgtaaacagatgtgctatcttccaggtttgttgttccatttcaagagcacaggcagagtatatttagcataattcttacgggccctagattttcagaatggtaaattaccattggcttcagcttaaagtcatcagctgcattggtccctaataaaagtcagcttatcctttgaagctttgaagccagtcattggcttctctctatgaaagtcctagatggcatcttcttccaaaagaagggtgttttgtttacattgaaaaatctgttgtttagtatagccacctttatcaatgatcttagctaggtctcctggataacttactgtggcttctctctcagcacttgctgcttcaccttgtacttttatgttatagagatggcttctttccttaaacctcatgaaccaacttctgctagctttaaacttttcttctgcaccttcctcgcctctctcagccttcatagagttgaagagttagggccttgctctgtattaggctttggcctaaggaaatgttatagctggtttaatcttctatccagacccctaaaacattctccatatcagcagtaagtctgttttgctttcttatatgtgtgttcactggagtagcactcctgatttccttcaagaactgttctttgcattcacaatttggttaactgtttgtcacaggacacctagctttaggcccatctcagctttcgacatgccttactcactaagcttaattatttttatcttttgatttaaagcaagggatgtgtgacttttcctttcacttgaatacatagatgccattgtaaggttattaattggccaaatttcaatattgtgtctcggcaaatagggaggcctgagagggagagagataagagaatagctggtcagtgaacagttagaacacacaacatttatccgttagctccgtcaccttatataggcacagtttatggcacccgaaaacaatcacaatagtaacatcagaggtcacagatcgtcataacagatagaatgaaaataatgaaaagtttgaaatgttataagaattaccaaaacacagacatgaggcgaccacatgctgttagaaaaatggtgctgccgcatgttctcactcctaagtgggagttgaacaatgagaacacatggacacagtgaggggaacatcacacactggggcctgtcggggagtgggggctaggggagggatagcattaggagaaatacctaatgtagataacgggttgatgggtacagcaaaccaccatgtcacgtgtatacctgtgtaagaaacctgcacgttctgcacatgtatcctagaacttaaagtataataataataataaaaagaaacaaaaagtgcaggccaagcaggaaaaaaaaaaaacaaaccagaaaaatggtgctgatagtctcatcatggggtttccacagaccttcgatttgccaaaaaaaaaaaaaaaaaaaaaaaaaaatccatgaagtgcgataatgtgaagtacaataaaaggggatatgcctgtaattctttctgtgtcctttattgttttcctgcagttctgtttcagtgtacgattttgtttgcttcaaactgaagaagttcttttattgtttcttataatgttgatctactgatgagagattctctaagcttttgtctgaaaatctgtttcatcatttttttaaagaatactttctttgcatagagttttttagtttttcacaatggcagtttttttttttttttaaagtgagtgctttaaaaatgccattccatttttctttggctttcatatgttctcaaagagattgtcatttctcttagtcttacttgaaaaataatgattcttaccccacctttggcttttgttgttgttgttgttgttgtttgttttgtttttttaagacagagtctctctctctcacccaggctggagtgcagtggcacgatcacagcttactgttgcctccacctcccaggctcaagtgatcctcctgccttgcctcagcctcccaagtaggaggaccacaggcatgcgccatcacacttagctaattttttaaatttttcttagagacgggtctccctatgttgctctggctggtctcaaatgcccaggctcaagtgatcctcccaccttggcttcccaaagtgctggaaatacaggcatgagccaccacacctggccccctttggctggttttaagagtgtctttttatatttggttttcaactttttatatatggttattagctttctgtggctgctatcacaaattatcacaaacttggtggcttaaaacaacaaaaatttattttctcccactactggatttcagaagttcaaaatcagtttaactgggctgaaattaaggtgttagcaaggctacactccttccagaggctctaggagaggatctgttccatgcctcttccagcttcaggtggctgccagtatttcttggcttgtggctatatcattgtagtctctgcctccatgttcacattaccttctcctttgcatgtgtgtcaagcctccatctactttcctcctatagagacatttgtgatgtcatttagggctcacatggataatccaggatactctcttcatctcaagattcttgacataatcacatctgtaaagaccccttttccagataatatcacatatgtcacattcatagggattaggacacaggcatgtcttagggcaacatttaacaattgttctttataggtgaacttgttttaaacagatggtttgtcagtgttcagatgttgacctgagagtggtggaggaatctccattacaacctgttgaatcacacagctatgttcggatttattagtttcattcctcactgctttttctcatctacatcatctttctctttcttgaattatttattgtgaattagtctttgtttgtagtatatcctcacacattttcttcatatgagtttgtggatgataatcccttcaagaataaaagtgttattttggtctcatatttgaacaattttttgactggtgtagaattctagggttaagatcattttctctcaaaattctctgaatattgctgcatttcagtgcatgaagaatttaggcatctgagaagttcaacaactatacagtttacacgttttttatttgggccaagtttgaggactgcaacccaggagcatagattcaagttgctctgaatatatgttctaattagcagcagttacaagtaggtttttaaaggaaaaaaggagaggcagtatctaatttgtttaccaagaatttacattaaaatagcataagctattgattgctatacattgtcctttgtatcacaaattccaggaacatgaagataatggttgaggcagctagtcagcaacaaattgcctttaaacagttgccccccctgggcattgtgtggggggtgtgactgaagtccccatactcatgtcttctgggcctgataaattttatatacctcacatagctcaggctgctctgagctgtttttcttttctcatttcccccttttgatcaaaatttttctcttctgaaagcattgatgatcagcattttagatataagtttatcccatgtcactggggaggcttattcccagatattcttgtcccgtgttggatggaaagacgtaaaaaaggtaccatggcttaaagaacttagtgaggtctcaaggccaaattgattggcaacacagaggagcagagcaacaggatctcagtcaagccatccactcacgctggagccatggcatgaacaactatacagtttactcaagtccaccctcacttaatggcaccaactgcaagtttggggattccccaaaccaccctcagatttgatagttcattagaaggatttataatactctgtgagcactattatactcacagttatggtttattacaggcaaattatacatagtaagaccagccaagggaaaaagtacatagggtggagtttgggaagataccaaatgtagagcttttgttgtcctcttcccatggagtcaggacacgttgctctcttggcatcagtgtgtgacaaaatgtgcagagcattgcctaacaggaaagcttacccaagccttagtgttcagagtttttattggggtttcattatgtaggcattattgactgactgccctctggcttgatctcagtctccagctccacttggtgtgatccaaagcctcctaaatcacatagtcattttttctggagtgtcttttccccaccctaaatcacattgttactatctagattacagtctattagaaaaataaatcaaggctgtgcatggtagctcatacctataatcctaatacttatactttgggaggccaaagctgaaagatctctaaaatccagaagttcaagaccagcctaggcaacaaagtgagaccttatctctacaaaaccaaacaaaaaaaaaaaaaaaataggtgtgattgggtgcacctgtagtcctagctacttggggggctgaagatggagaattgcttgaacccaggaattcagagctgcagagagctatgatcacaccactgcattccaggctgggttacagaggggtgacctccatctcaaaaaaaaaaaaattttttttcttttaattcttttttattttttattttttttataaatatatatattttttattatactttaagttctagggtacatgtgcacaacgtgcaggtttgttacatatgtaaacatgtgccgtgttggtgtgctgcacccattaactcatcatttacattaggtatatctccaaatgctatcccttccccctcccaccaccccacaacaggccccggtgtgtgatgttccccttcctgtgtccaggtgttctcattgttcagttcccacctatgagtgagaacatgtggtgtttggttttttgtccttgcagtagtttgctgagaatgatggtttccagcttcatccatgtccctgcaaaggacatgaactcatccttttttacggctgcgtagtatttcatagtgtatacgtgccacattttctgaatccagtctatcattgttggacatttgggttggttccaggtctttgctattgtgaatagtgccacgataaacatacgtgtgcatgtgtcttgatagcagcatgatttataatcctttgggtatatacccagtaatgggatggctgggtcaaatggtatttctacttctagatccctgaggaatcgccacactgtctttcacagtggttgaactagtttacagtcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgccatcttttgagaagtgtctgttcatatccttcacccacttgttgatggggttgtttgtttcttttcttataaatttgtttgagttctttgtagaatctggatattagccctttgtcagatgagtagattgcaaaacttttctcccactctgtaggttgcctgttcactctgatggtagtttcttttgctgtgcagaagctccttaattagatcccatttgtcaattttggcttttgtttccattgtttttggtgttttagatatgaagtccatgcccatgcctatgtcctcaatggtattacctaggttttcttctagggtttttatggttttaggtctaacatttaagtctttaatccatcttgaattaattttagtataaggtgtaaggaagggatccagtttcagctttctccatatggctagccagttttcccagcaccatttgttaaatagggaatcctttccccatttcttctttttgtcaggtttgtcaaagatgacatggttgtagatgtgtggtattacttctgagggctctgttctgttccattggtctatatctctgttttggtaccagtaccatgctgttttggttactgtagccttgcagtatagtttgaagtcaggtagcatgatgcctacagttttgttcttttggcttaggattgacttggcaatgcaggctcttttttggctccacatgaactttaaagtagttttttccaattcagtgaagaaagtcattggtagcttgatagggatggcattgaatctataaattaccttgggcagtatggccattttcatgatattgattcttcctatccatgagcatggaatgttcttccatttgtttgtgtcctcttttatttcgctgaacagtagtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacgttgatttcgtatcaagactttgctggagttgcttatcagcttaaggagattttgggctgagataatggggttttctagatatacaatcatgtcatctgcaaacagggacaatttgatttcctcttttcataattgaataccctttatgtctttctcttgcctgattgccctggccagaacttccaacactatgttgaataggagtggtgagagagggcatccctatcttgtgccagttttcaaagggaatgcttccggtttttgcccattcagtatgatattggctgtgggtttgtcatagctcttattattttgaaatacgtcccatcaatacctaatttattgagagtttttagcatgaagggctgttgaattttgtcaaaggccttttctgcatctattgagatgatcgtgtgttttttgtctttggttctgtttatatgctggattacatttattgatttgtatatgttgaaccagccttgcatcccagggatgaagcccacttgatcatggtagataagctttttgatgtgctgctggattcgatttgccagtattttattgaagatttttgcgtcggtgttcattagggatattggtctaaaattctctttttgtgttgtgtctctgccaggcttaggtatcaggatgatgctggcctcataaaatgagttagggaggattccctcattttctattgataggaatagtttcagaaggaatggtgtcagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtcaaggaatttatccatttcttctagattttctagtttatttgtgtagaggtgtttgtagtattctctgatggtagtttgtatttctgtgggatcggtggtgatatccccttttatcattttttattgcgtctatttgattcttctctcttttcttctttattagtcttgctagcagtctatcaattttgttgatcttttcaaaaaaccagctcctggattcattgatttcttgaagggttttttgtgtctctatctcgttcagttctgctctgagttatttcttgccttctgctagcttttgaatgtgtttgctcttgttcctctagttcttttaattgtgatgttagggtgtcaattttatatctttcctgcttccttttgtgggcatttagtgctataaatttccctctacacactgctttaaatgtgtcccagagattctggtatgttgtgtctttgttctcattggtttcaaagaacatgtttatttctgcattcatttcgttatgtacccagtagtcattcaggagcaggttgttcagtctccatgtagctgagcagttttgagtgagtttcttaatcttgagttctaatttgatttcactgtggtctgagagacagtttgttataatttctgttcttttacatttgctgaggagtgctttacttccaactatgtggtcaattttggaataagtgcgatgtggtgctgagaagaatgtatattctgttgatttggggtggagagttctgtagatgtctgttaggtccgcttggtgcagagctgagttcaattcctggatatccttgttaactttctgtctcattgatctgtctaatgttgacagtggggtgttaaagtctccctttattattgtatgggagtctaagtctctttgtaggtctctaaggacttgctttatgaatctgggtcctcctgtattgggtgcataaatatttaggatagttagctcttcttgttgaattgatccctttaccattatgtaatggccttctttgtctcttttgatccttgctagtttaaagtctgttttatcagagactaggattgcaacccctgcctttttttgttttccatttgcttggtagatcttcctgcatccctttattttgagcctatgtgtgtctctgcacatgagatggatttcctgaatacagcacactgatgggtctttactctttatctaatttgccagtctgtgtcttttaattggagcatttagcccatttacatttaaggttgatactgttatgtgtgaatttgatcctgtcattatgatgctagctggttattttgctcgttagttgatgcagtttcttcctagccttgatggtctttacaatttggcatgtttttccagtggctggtatgtgttgttcctttccatgtttagtgcttccttcaggagctcttgtaaggcaggcctggtggtgacaaaatctctcagcatttgcttgtctgtaaaggattttatttttccttcacctatgaagcttagtttggctggatatgaaattctgggttgaaaattcttttctttaagaattttggatattggcccccactctcttctggcttgtagagtttctgccgagagatcagctgttagtctgatgggcttccctttgtgggtaacccgacctttctctctggctgcccttaacattttttccttcatttcaactttggtgatctgacaattatgtgtctcggagttgctcttctcgaggagtatctttgtggcgttctctgtatttcctgaatttgaatgttggcctgccttgctaggttggggaagttctcctggctaatatcctgcagagtgttttccaacttggttccattctccccatcactttcaggtacaccaatcagacgtagatttggtcttttcacatagtcccatatttcttggaggcttttttcgtttctttttattcttttttctctaaacttctcttctcgcttcatttcattcatttggtcttcaatcacggataccctttcttccagttgttcgaatcggctactgaagtttgtgcattcgtcacttagttctcgtgccatggttttcagctccatcaggtcatttaaggacttgtctacattggttattctagttagccattcatctaatctttttttcaaggtttttagcttctttgtgctgggttcaaacttcctcctttagctcagagaagtttgatcatctgaagccttcttttctcaactcgtcaaagtcattctctgtctacctttgttctgttgctggtgaggagctgcgttcctttggaggaggagaggcgctctgatttttagaattttcagtttttctgctgtttttttccctatctttgtggttttatctacctttggtctttgatgatggtgacatacagatggggtttttgtgtggatgtcctttctgtttgttagttttccttctaacagtcaggaccctcagctgcaggtctgttggagtttgtcggagggccactccagaccctgtttgcctgggtatcagcagcggaggctgcagaacagtgaatattgctgaacaccaaatgttgctctctgatcgttcctctggaggttttgtctcagaggggtacccgccgtgtgaggtgtcagtctgcctctactggggggtacctcccagttaggctgcttgggggtcagggacccacttgaggaggcagtctgtctgttctcagatctcaaactctgtcctgggagaaccactactctcttcaaagctgtcagacagggacatttaagtttgcagaggtttctgctgccttttgttcagctatgccctgcccccagaggtggagtctacagaggcaggcaggcctccttgagctgtggtgggctccacccagttcgagcttcccggcagctttgtttacctactcaagcctcagcaatggcgggcgcctctcctccagcctcgctgccaccttgcagttcaatctcagactgctgtgctagcaatgagtgaggctccgtgggtgtgggaccctctgagccaggcgcgggatataatctcctggtgtgctgtttgctaagaccgttggaaaagcgcagtattagggtgggagtgatccgattttccaggtgccatctgtcacagcttcccttggctaggaaagggaattccctgaccccttgtgcttcccgggtgaggcgatgtctcgccctgcttcggctcacgctcggtgggctgcacccactgtccaacaagccccagtgagatgaagccggtatctcagttggaaatgcagaaatcatccgtcttgtgcgttgctcacgctgggggctgtagactggagctgttcctatttggccatcttggaacaggaatcaaaggaaattttttaaaaatcccatttatgatagcatcaaaaagagtacaatagttaggaataaatttaaccaaggatgtaataatgtgcacactgaaaattataaaacattgatgaaagaaattcaagaagacacaaatcaatggaaagataccttatgtttatggattggaagaatcaatattattaaaatgttcatactgcctgaagcaatacacagattcaacacaatccctattgaaattccaatggcatttttcacagaatagaaaaaaaaattctaaaatgtggatgaaactagaagacattatattaagtgaaatatactagacacagatagataaatactgtatgatttcacttatatatggaatctaaaaaaaatgttcagttcataaaagcagagagtaaaacagtggttgacagtgggtgggagacctggagagatgttggtcaaagtgtatgaacttacagttgtaagatgaataagttctggataccggacatacagcatggcaactatagttaataataatgtattgaatatttgaaatatgctataagaatagatcttaagcattctcaccacatacccaaaaaagtaactatgtgaggtgatggatattttacttagcttgattgtggtaataatttcacaatgtgtacatttatcagaatatcacattgtataccttgaatatataccatttttatttgccaattatacttcaaggcagaaaaaaataaaattagagtagaaacaaaagcttggaggtctgaaatgttactaaaagtgtaacattttccttttttcaatattcttgccacatggtgggtaggtccttttagtctgaagattcaagtctgtcttatttgggggatattttcttcaattagtcccttgattattgatccttctcttttggctgtattctctcctgtgactgctaataggtgtgtaaatcagtaccaggcacataataagcacatgttaaatatctgttgatcgtataaattgatcctggatttgcttgatcagttttccgtgtatcttacatcttctttcatgatttacaacctagacattttgctgttttcagaacaaattttttgaattgttactgcagaagctgcttttgctcatttatgttctgcttttaaaaaattatgccattttattaaaatatagtttttggaatgttgtcatgttatctaattttttatgtcctctgatgactttgtttaaaattagttcaattatgtcttgtatctgaggatacttattagaaatttttttattactgttattctatcttgtttcccatattaactttgttccattaaggactgtttgtccccattgctttttttgtctcctcactttaactgctgtttcttctcaaaagttctagtcaatgcatatattctattcaacatatatatttagctctagatgtaatcagttttggtatgtgcctccaggtggcatcctgtgcagtcttcatgaagtgaaacccaaagactggtgcccctgtcagttgttctactgcagagactttgtggagtatgtggttggagatgaatctatggttaagggagtggattttttaaaaccaatatgtgaagtataatatacataaagtgcatcaactgtaagcatacaacttgttgtgttttcacaaagtaaacataccatgtagaaccaacacccagattaagaactagagcacgaacagtaccccagaagctcccttctcccttcttttagtcactactcttctccaaaggtggccactgtcctgatttctccacatagattaataaaacatagcaggggccgagagtggtggcacacacctatagtcccagctactcaggaggctgaggtgggaggatcgtttgagcccaggaggtcaaagctgcagtgagtcgtaattgtgccactgcactccagcttgggcgacagagcaagaccctgtctcaagataaataataaaatatagcaggtattctgtttatgtcaagtttctattgctcaaaatgatgtttgtgagattcatctgtggtaaattgtataaatgtagtagtagattgtgaattgtcattactgtattgtattccatgttatgactctcctgtaatttatgcattgcacagttgatgggcatttgggtggtttccagtttaaggtatgaaaagtagtgctgtccaaaacatttttttatatgtcttttggtgaatttgcatacatctgtgggaccataccagagtggattgctggattattagggagttttgttggttggttgtttgccattttgttttaaactccttgtgtcctggtgggaattgttcagtagatactgagaaattgatgatgcaaaagaaaatggatagcagaaggaatgaagttctatgggttttggccctcacaaaagtaaatacatatcttcctacagaaatcaaacaggtttttatggctcaaagccccggaattatacggggcagaataggcgaatgtgcttgcagtcagctggctttaaaagagcctttcttattggaagtatagagaggaaaattcttttccactagcgggaagaaccacttctggtgctcaacatcatgtgcattgctgcagtggagaagaaaaaagagggaagcgttttcattgggctcatactgcttatgataggcctggcagagtcttgcttttggcaactattgagtatgaatggccagtctctacttgtaaagagaggtcattggacttaaatggaattaatggaagtaaaatgttctcaggttgttactgcaaatcattcatgtagtcagtgccaggggttaaacaattctcgcctcttttctagtctgtcaccttcaaaactaccagcagaaatcttgctcgagccatgtgtatgaagaacctcaagctcactattatcatcatcatcgtatcaattgtaagtttttgtccttttagtgtatggctttatttttcaatctctaagaaattaggtactagaattatttctcaatgattaacactctgaaatgagctacatatgtcttttaatagtgaaacacatgaccaggcagtggctttcctatgaagtcactatgaaatatctctacttaaacccctccttcctattgagaattattatatattctcaataggaagagatctataaaactgacctcacagaaatgtagttattttaaataaagacatttctggtttatatgtaatgggtttattgtttttatttttaaattaattatgtatttttaaagttttaatttctaatatggcaaatgctgataattataatcccccttaaacaagaactctttggagtcctcagtaatttttgagtgtgtaaagaggtcctaaaccacaactttaaaaactattgctaacaggtggggggtgctttaccctgttcatggtcagataaagttgcctttcctccccatcctccagtcatgtccagaagcccaaagttacctccaagcagataactctgaccctgcttctcctctaccacagcttgagggtcctctgccttagacagctggatttatctaaaagagaagagcagtcatagatctgtagattttatactggaagtaattgtcatggccttgaatggttccttgctcaggtttctctttctaatatcacattttaggctcctgagcttagcttcttacttattatttggtctgggagtttaggttgatttgtgcagctgaattgttaaattcagaatatatttactgattacttattacatgcagagcacagctctaaatgcaatatcaatctttgcgaaaaggtgttgtcacctaacgagatgtacttcagcttgaaaaatccttatattacagctgtgacaaatagtcaactttacatcaagttggtaaactttacatttgtggcatgtgtatgtgtgagtatgtgtgtgtatgtgtgaatatgatgtcagaagttcaacctattcattaataaacagaatttgctgtaatctgccccccaaccctggcaatatttatagttccctacaaggcaaaatgctttgctcacttttggagcaaagggcatgcaattcatcaatgcatccttttccaagcttgcaaataatgaaatcagtcacttaaagatctcaaaaagttgtaatttaaagcaaaataaagccaggcataggggcttatgcctgtaatcccagcactttgggaagctgaggcaggaggattgcttgaggccaagagtttgaagccagcctggtcaacatagtgacaccctatctctacaaaaataaaaaataaaaaataaataaaataaagtgactaatgcagtgaacctaatgtttaaaatctattttttgtgatataataatgtgaacaagtagtgacttttataatataatttaaaattataatctagaattaaaaagcaaacacatctgtaatagcaccagtatttttgcagtgttacttacatcatctgcttttcattgttttggtcatcgtaattattgtgtcattatccactgaacagttcgtagcagtgttcttgctcataagtgatatagatgaaagccttctactcaggcttttaaaatatattcttatattaatcaaaaataaaattcatgtgcaaaacctaaaaatataattaatgaaaccatacttcaggagaattatggttatttgtgatttttttatgacttgttaatgacacatcagtatgagttgctcatttagccttgattctgccgagttaccagtgaagagcaacaaccccactgctttctctcccactgaaggaaacgctagagttcaagtgggtgtgagttataccaaaaacgacaatgttaactacacttctgtcttggaaaatacttgtttagtgtgttccattactacataactgctactctaatggaatcagaagtatttcttaataaggctctactttcctatatatattatttagaataatatgattgattcaagaaaataaaattgctctcctcgtccctccaggtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatga

SEQ ID NO: 4113 - DNA, 2302 bp, human
gaaccggaggctcctgtaccggctgcatccggagcagggcatgccggccggcgtgtgcgtggacgctgcggggaagctctgggtggcctctgcgtcgatagaggcaaggtgatacgccttgaccccgagacaggtgtgtgccggatggcggggccgtatgaggcttggccacatcgggtgtccactgcgtctgcagcgttctggcttcagaagtcggggccgggcagcaatcgcgaatttgtagagactaaggggcctccgtttcccgacggcacggactcccaggttccctctgcaggtgtgctaggtcctggggctgccgcaaccaaggactggctgcctaagaaacaggaagtcacctcccccagtcctgcagagcaggagtctgagaccgaggagtttcagggccgtactccctccaggagctgtagtggagggtccttcctgcctctcccggctcctgggggctccaggcgtccctgggcttgtggccgcatcactccagtctctgcctccgtctccacgaggcctcatccactgtgtctgtgtctcctcttctgtctctagaaggacacctgtcattgcatttaggatccaccctactccaggatgatctcatctcaagatccttcactaactagatcttgaaacaccctatttctatacaaggtctcattcctaggttgtggatattagggtgtagacagatctttttgggaaccacagttcaatccacttcaattgtattgagactctaggggagggtccttcctgcctctcccagctcctgggggctccaggcatccctgggcttgaggccgcatcactccagtctctgcctccgtctccacgtggcctcctcctctgtgtctgtgtctgctcttctgtctcttagaaggacactggtgattggatgtaggacccaccctaacctgctctgacctactaattacctctgcaaacaccctatttccaaataatttcccattctgagatcctacttggcatgaatctggggagactacagagctcactagagcaggtgcggctgggcctggctaggcaggtgccaatctggcagctccaggtgccacagagacacccatgctgcccgggggttgggcccagggtcaggaggaacggccaggcaggcggcctggggtgctcaggctcagcccccacgctcgctcacagggaaggtgctgtgcacggtggagctgcctgtgtacagggtcacctcctgctgcttcggggacccggctacgacaacctctacgtgacctccgcggcggaccgcctgagtccggagcacttgttacgggagccccgggctggacacatcttcaaggttccgtaagggttttctgccgagagtccctcctggggccgcgggcgagagctcatctttaacctcggtgggaagctcgggcagggtgggcgatgtctgcagacagacggaggttattgtttctgtttcctagaaaacaaacgtttccaaactttttttttttgagatggagtttcgctcctgttgcctgggctgcagtgcagtggcgtgatctcggctcactgcaacctccgcctcctgggttcaagtgattctctcacctcagccgcctgagtagctgggattacagggaggcaccaccacacccggctaattttgtatttttagtagagacggggtttcaccatgttggtcagactggtctcgaactcccgacctcaggtgatccgccggcctcggcctcccaaagtgctgggatgacaggtgcgagccgctgcgcccggccagtttcaaaggttttatgcccccgggtgttagatagaaattgtgtttttaggccgggcccagtggctcatgcctgtcatctcagcactttgggaggccgaggcaggaggatcatgaggtcaggagatcgagaccatcctggctaacctggtgaaaccccgtctctactaaaaaatacaaaaaaaaaattatctgggcgtggtggcacctgcctgtagtcccagctactcgggagtctgaggcaggagaatggcatgaacctgggaggcggaggttgcagtgagccgagatcgtgccactgcactccagcctgggcgacagagcgagactccgtctcaaaacaaacaaacaaacaaaaattgtgtttttaacgtgtgggttttaaagcctccagcattgttctggccttactctgccggtaacacggtgtttcggccacagccttggaactgatcgcagcatcccggctccatccaggggtcacgggctttggggtgagaggaggccccc

SEQ ID NO: 4114 - DNA, 35067 bp, human; identical to SEQ ID NO: 2838

SEQ ID NO: 4115 - DNA, 22479 bp, human
gcctgcttttgcccgggtcctgagaacaggggctccccacactttttttttttttggttttgttttatttcgtttccgcgcgtctctttctactgcaaacagaaatgggagggtggacaggcgggtaggagcggatcagacgcccaggacgcagcagcccgagtccgcacagggtttgcgggaggtggtgaccgcgctggggacgccaggacgcgaatgaacctccggggcgcgctcggggcctgcgctcagagcttggtgagctcggttttggaactttccttttcttttccagaaagctttgccttctttcctttcttcgttccttccttccttccttcctctcttcctctttcttttctttctttctttctttctttctttctttctttcttttctttcttcctttcacttggcaagattggttttggagctttccttttcttttccagaaagctttgccttctttccttccttcgttctttccttccttccttcctctcttcctctttctttcttttctttctttctttctttctttctttctttctttctttctctcttcctttctttctttctttctttcttttctttctttcacttggcaagattgcttttggagctttccttttcttttccagaaagctttttccttccttccctccttccttccttctctccctccctcctttcctttcctccctctgttccttcctccctccctccctccttctctccctccctccctccttccctttctttcttctttctttctttctctttcttttttctttctctttcatttctttcctcttccttcccccatcctcccccttcatcgtccctcctcctcctccttctcctcctcctcctcctccttctccctcctcctcctccttctactccttttcctcctcttccctctgccatttgtctctttcccctttgcgtttttattcgcagtcgttgtttttgtccatccactaacttctctgaaacctgattcttttgggacgcttggcaaaaggcatttcatacagggaggcggtcacatacgctaacaagacacggtgaaaagtctcttctcatcggcttggtgtgctgctctcttctctctctcgctgtctctctctgtctgtctctctgtcccctgtctgtcgctatttttctctgtctatctctgtatctctgtctctctctttctctcctctgtctctctgtatctctgtccatctctgtctctctttctctctctcctctctctctttttctctgtctctgtctgtatctctatctctgtctctctttctctctgtcttcgttcctctctctctttttttctctcttcctctgtctctctttctatctctgtctctctctctcctctctctctgtctctttttctctgtctctgtctgtatctctgtctgtctctgtctctctttctctcctctctctgtgtctctgtctctgtctctctttctctcctctctttttctctgtctctgtatctctgtctatctctgtctctctttctctctctcctctctctctttctctgtctctgtctgtatctctatctctgtctctctttctctctgtcttcgttcctctctctctttttctctttctctgtatctctgtctatctctgtctctctttctctctctcctctctgtctctttttctctgtctctctctgtgtctctacctctgtctctctctctcctctctttttctctgtctctgtctgtatctctgtctatctctgtctctctctctcctctctctctttctctgtctctgtctgtatctctatctctgtctctctttctctctgtcttcgttcctctctctctttttctctttctctgtatctctatctctgtctctctttctctctctcctctctctctgtctctttttctctgtctctctctgtgtctctacctctgtctctctctctcctctctttttctctgtctctgtctgtatctctgtctatctctgtctctctctctcctctctctctttctctgtctctgtctgtatctctatctctgtctctctttctctctgtcttcgttcctctctctctttttctctttctctgtatctctgtctatctctgtctctctttctctctctcctctctctctgtctctttttctctgtctctctctgtgtctctacctctgtctctctctctcctctttttctctgtctctgtctgtatctctgtctgtctctgtctctctttctctcctctctctgtatctctgtctctgtctctctttctctcctctctctctttttctctgtctctgtatctctgtctatctctgtctctctttctctctctcatctctctctgtctctttttctctgtctctctctgtgtctctacctctgtctctctttctctcctctctttttctctgtctctgtatctctatctctgtctctctttctctctctcctctctctctttttctgtctctgtctctctgtctgtctctgtctctctttgtctctctcctctctgtctctttttctctgtctctctctgtgtctctacctgtgtctctctttcctctctctttttctctctctgtctgtatctctgtctacctctgtctctctctctctcctctctctctgtctctttttctctgtctttctgtctctctatctctgtgactctttccctctctcctctctctctctttttctctctctccctgtctcagggaagcatcagtaaaacctccaacaagcacccccttgtacacagcccaggccaagagaggtgcagaccctgctttctgcctgcagccgcctgctgtaaaatgtcaatgcaaaacatttcatacagtccacccactctgcagactggagctgcggcctctcggacagcgtcttgaattggcaacgaaaaacgtgtggggtagaaaaagctctcgtctggatttctaacatgttatcaagcactcaaacgctgggtgtttcctgcctgtctttaaagggaagggcagggagagaacgtaaaagctctggtcagagaagggaaaggtctttaggtgagaggggtgaggccgcctccgtgctcatcccacaggaagagttggagttttacagaaagatgagatctctttcgcgtagccagaaactcttaggaaaagcggggtgttggaaaggcagaaagtgtgccatgaatcggacgtgcgtgatttcaaagccacttgtctgcagtgagaattacaattggggcttcagttgaaaaagggcctttgctttttctccgaggccgaggggccttgaatagccacacagctcctgactggtgtccccatgctcattcctggaggctcggacaccctggtagagcggagtttcctactagacaaaggggtccagattgcggcccaagaaggaacctcaggtcggggaaagcctgggcctcacgggaccccccaggaaagcctggtccttggggttggagaagacagctgagctgggaggacggagggttttcggtagggagacagtgagcagctgtgagaggtttacggcgcagtccctggggacccagtttcccagcagaggcagagatggggaggcctttagaagcagaaaagttacccggcctctgaggacccagaaagttgctctaagccagagacccttctccgaatctccctctctgtctgtctctgcctctctccctctttctcttccccctccctgtctccctctctgtgtctctgcctctctttgtctctctctgtatctctatctgtgtctctctttttctctctccatctctctgtctctccgtttctctctttctctctccctctctctccctgtccgtgtcgctctttctctctctccatctcccagtctctccctttctctctctccatctctccctgtctctctctttctctgtctccatctctttctctgtctctccttgtctctctctttctctctctccatctctctctgtctctccctgtctgtttctctctctccatctgtctgtctctccctttctctctctctgtctctccctctctctccctgtctgtgtctctctttctctctctccatctctctctgtctctccctgtgtttctctctctccatctctctctgtctctccctgtctgtttctctctctccatctgtctgtctctctctttctctctctatctctccctctctctccctgtctgtgtctctctttctctctctccatctctctctgtctctccctgtgtttctctctctccatctctctctgtctctccctgtctgtttctctctctccatctgtctgtgtctctctttctctctctccatctctctctgtctctccctgtctgtttctctctctctatctgtctgtctctctctttttctctctctatctctccctctctctccctgtctgtgtctctctttctctctctccatctctctctgtctctccctgtgtttctctctctccatctctctctgtctctccctgtgtgtttctctatctccatctctctgtctctccctttctctctctctgtctctccctctctctccctgtctgtgtctctctttctctctctccatctctctctgtctctccctgtgtgtttctctctctccatctctctgtctctccctttctctctctctgtctctccctctctctccctgtctgtgtctctctttctctctctccatctctctctgtctctccctgtgtttctctctctccatctctctctgtctctccctgtctgtttctctctctccatctgtctgtgtctctctttctctctctctatctctccctctctctccctgtctgtgtctctctttctctctctccatctctctctgtctctccctgtgtttctctctctccatctctctccgtctctccctgtctgtctctttctctgtctccatctctctctgtctctccttgactctctttctctctgtctccatgtctctgtctctccctgtctgtgtctctctttctctctctccatctctctccgtctttccccctctgtctctttctctgtctccatccctctgtctctccctttctctctgtctttccttgtctctctctttctctctctctctccatctctctctctccctgtctctctctctccatctccccgtctctccgtttctctctctgcctctccctgtctgtctctctctttctgtgtcttacacacaccccaacccaccgtcactcatgtccccccactgctgtgccatctcacacaagttcacagctcagctgtcatcctgggtccccaggccccgccggggaggaagatgcgccgtggggttacgggaggaaggggactccgggcctcctggtgccccactttatttgcagaaggtccttggcaggaaccgtgacgcgtttggtttccaggacttggaaaacgaatttcaggtcgcgatggcgagcaccggcttcccctgaagcacattcaatagcgagaggcgggagggagcgagcaggagcatcccaccatgaaaaccaaaaacacaagtatttttttcacccggtaaataccccagacgccagggtgacagcgcggcgctaagggaggaggcctcgcgccggggtccgccgggatctggcgcgggcggaaagaatatagatctttacgaaccggatctcccggggacctgggcttctttctgcgggcgctggagacccgggaggcggccccggggatcctcggcctccgccgccgccgcctcccaagcgcccgcgtcccggtttggggacacccggccccttcttctcactttcggggattctccagccgcgttccatctcaccaactctccatccaagggcgcgccgccaccaacttggagctcatcttctcccaagatcgtgcgtccccggggcgcccggatccccccctcgccatctcaaccccggcgcgacccgggcgcttcctggaaagatccaggcgccgggctctgcgctcctcccgggagcgagggcggccggacgactgggaccctcctctctccagccgtgaactccttgtctctctgtctctctctgcaggaaaactggagtttgcttttcctccggccacggagagaacgcgggtaacctgtgtggggggctcgggcgcctgcgcccccctcctgcgcgcgcgctctcccttccaaaaatgggatctttcccccttcgcaccaaggtgtacggacgccaaacagtgatgaaatgagaagaaagccaattgccggcctggggggtgggggagacacagcgtctctgcgtgcgtccgccgcggagcccggagaccagtaattgcaccagacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaaggtaagttcctttgcgctccggctccaggggggccctcctggggttcggcgcctcctcgccacggagtcggccccgcgcgcccctcgctgtgcacatttgcagctcccgtctcgccagggtaaggcccgggccgtcaggctttgcctaagaaaggaaggaaggcaggagtggacccgaccggagacgcgggtggtgggtagcggggtgcggggggacccagggagggtcgcagcgggggccgcgcgcgtgggcaccgacacgggaaggtcccgggctggggtggatccgggtggctgtgcctgaagccgtagggcctgagatgtctttttcattttctttttctttcctttcctttttttgtttgtttgtttgtttgagacagagtctcgctctgtcccccaggctggagtgcagtggtgcgatctcggctcactgcaacctctgcctcctgggttcaagcgattctcctgcctcagcctccccagtagctgggattacaggcatgcaccaccacgcctggctaatttttgtgcttttagtaaagacggggattcaccatgttggccaggctggtctcgaactcctgacctcaggtgatccacccgcctcggcctcccaaagtgctgggatgacaggcgtgaggcaccgcgcccggcctgggtcctgacggcttaggatgtgtgtttctgtctctgcctgtctgccttgtatttacggtcacccagacgcacagaggagccgtctccacgcgccttcccagcgctcagcgcctgccgggcccccggagatcacgggaagactcgaggctgcgtggtaggagacgggaaggccccgggtcagctcggttctgtttcctttaaggaacccttcattattatttcattgttttcctttgaacgtcgaggcttgatcttggcgaaagctgttgggtccataaaaaccactcccgtgagcggaggtggccgggatctggatggggcgcgaggggccccggggaagctggcggcttcgcgggcgcgtcctaagtcaaggttgtcagagcgcagccggttgtgcgcggcccgggggagctcccctctggcccttcctcctgagacctcagtggtgggtcgtcccgtggtggaaatcggggagtaagaggctcagagagaggggctggccccggggatctctgtgcacacacgacaactgggcggcatacatcttaagaataaaatgggctggctgtgtcggggcacagctggagacggctatggacgcctgttatgttttcattacaaagacgcagagaatctagcctcggcttttgctgattcgcagagttgaggtgcgagggtgaatgccccaaaggtaattcttcctaagactctggggctacctgctctccggggccctgcatttggggtgtggagtggccccgggaaatagcccttgtattcgtaggaggcaccaggcagcttcccaaggccctgactttgtcgaagcagaaagctgtggctacggtttacaaagcagtccccggtttctgaccgtctaagaggcaggagcccagcctgcctttgacagtgagaggagttcctccctacacactgctgcgggcacccggcactgtaattcatacacagagagttggccttcctggacgcaaggctgggagccgcttgagggcctgcgtgtaatttaagagggttcgcagcgcccggcggccgcttctgtggggttgctttttggttgtccttcgcagacaccgttttgctcctctgaactctctcttctccccctggccgtggacccgggagagcaaagtgtcctccagacctttcgaaagtgagaggaaaataaagaccaggccaaagacccagggccacaggagaggagacagagagtccccgttacattttccccttggctgggtgcagaaagacccccgggccaggactgccacccaggctactatttattcatcagatccaagttaaatcgaggttggagggcaggggagagtctgaggttaccgtggaagcctggagtttttgggaacagcgtgtccccgccgagcctgggagcccgtgggttctgcaaagcctgcgggtgtttgaggactttgaagaccagtttgtcagttgggctcaattcctggggttcagacttagagaaatgaaggagggagagctggggtcgtctccaggaaacgattcacttggggggaaggaatggagtgttcttgcaggcacgtgtctgataggaggtgaaacagaatgtgaaatccacgttggagtaagcgtccagcgctgaatgtagctcggggtggggtgggagggccctggtgtggatcgtggaaggaagaaagacagaacagggtgctagtatttaccccgttccctgtagacaccctggatttgtcagctttgcaagcttcttggttgcagcggccttgcctgtgcccctttgagactgtttccagactaaacttccaaatgtcagccccttacccttgacagcaagggacatctcattagggcatcgcgtgcttctcatctgtgctcagcaggcccgagataggaacagaggggcgttggagatgccacttccaccagccctgggttgaaggggagcgagggagacaccttttacttaaacccctgagcttggtcagagaggctgaatgtctaaaatgaggaagaaaaggtttttcacctggaaacgcttgagggctgagtcttctgcccttctgactcccccagcaaatacagacaggtcaccaactactggagatgagaaagtgccatttttggcacactctggtggggtaggtgcccgaccgcgtgtgaaaaagtgggaaggagagatttctgcgcacgcggttcagcccccaggcgcggtggcgcattcaggtactcagacgcggttctgctgttctgctgagaaacaggcttcgggtaggggctcctagctccgccagatcgcggagggacccccagccctcctgcgctgcagcggtggggatagcgtctctccgtaggcctagaatctgcaacccgccccgggtcctccccgtgtccttcccgggcgtcccgccggggatcccacagttggcagctcttcctcaaattctttcccttaaaaataggatttgacaccccactctccttaaaaaaaaaaataagaaaaaaaggttaggttatgtcaacagaggtgaagtggataattgaggaaacgattctgagatgaggccaagaaaacaacgctcgtgcaaagcccaggtttttgggaaagcagcgagtatcctcctcggcttttgccttatggaccccacgcagtttttgcgtcaaagcgcattggttttcgagggccccctttccaccgcgggatgcacgaaggggttcgccacgttgcgcaaaacctccccggcctcagccctgtgccctccgctccccacgcagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtaggaacccgggggcgggggcggggggcccggagccatcgcctggtcctcgggagcgcacagcacgcgtacagccacctgcgcccgggccgccgccgtccccttcccggagcgcggggaggttgggtgagggacgggctggggttcctggacttttggagacgcctgaggcctgtaggatgggttcattgcgtttgtttttcaccaacagcaaacaaatatatatacatatatattatacaaataacaaataaatatatatgttatacagatgggtatattgtatatattatagatatttgttcgtccttggtgcaaagacacccggtgaacccatatattggctcctgactgccttcggttcccctgggattggttataggggcaacacatgcaaacaaaactttccctggattatacttaggagacgaagctacagatgcgtttgatccagagtgttttacaagatttttcatttaaaaaaaaatgtgtcttttggcccctgattcccctccgtcttcccgtgtggctgcattgaaaaggtttccttaggatgaaaggagaggggtgtcctctgtccctaggtggagagaaacagggtcttctctttcctccgttttttcacctaccgtttctatctccctcctcccctctccagccctgtcctctgctacaaaccaccccctcctccctccggctgtggggagcgcaggagcacgttgggcatctggatgagcggagactattagcggggcacgggggctccccgaggagcgcgcgaattcacgctgccccatgagaccaggcactggggggcggaggggccttgggtgtgcgcagagggacgggcgggcagagccttcctccgcattctaaacattcacttaaaggtatgagtttatttcaggggtgctgctgggagagcctccaaatggcttcttccagcccctgcctgacagttcagctcccctggaaggtcaactcctctagtcctttctcctggttctgggcaggacagaagtggggggagggagagagagagagagagagagagagagacggtcaggatccccggaccctggggaccccgtcaaaaataaatgaaattaagattgccgaccagagagagaaccgtgacaaagcaaacggcgttcaaagcaaagagacgaactgaaagcccgttcccgtaggactggttatgaggtcaacacattcaaacacagcttgctctcgattttgctgagcagaggaagatacagatgcatttgatccaaagtgtgttacatctttcattatatgtgtgtctctatatataaacatatataaatatataaacatacataaatgtatgtaaatatatataatctatatacatatataaatatataaacacatatataatatataaatctataaacatatataatatataaacataaatatataaacatatataatatataaatatattaacatatataaaatatgtataaatatatataaacatataaacatatataaatatataaacatatataaatatatacaaacatattgtatatatataaatatatataaaaacatatatatacatataaaaatatatataaacatatatacatataaagaaatatatataaacatatatacatataaaatatacatatataaacatatatatacataaaatatatatataaacatatatatacatataaaaatatatataaacatatatacatataaagaaatatatataaacatatatacatataaaatatacatatataaacatatatatacatataaagaaatatatataaacatatatacatataaaatatacatatataaacatatatatacataaaatatatatataaacatatatatacataaaatatatatataaacatatatatacatataaaaatatatatattaacatatatatacatataaaaatatatatatatttttggcccctgattcccttcggttcctgtgggatgggtgattgagtcaacacattcaaacacaacttttccatcgatgttgcttaggagatgaggatacagatgcgtttgatggagagggttttacgagctctttcatttaaaaatatatatatatatatatatatattttggctcctgattctcttccgtcttcccatgtggctgcattttaaaaggcttccctaagatcgttaggattaaatcaaccctccccaggcatctttaccgagggctgtggtccccaaagcgatacagcccaggagggagagaggctttggtgacttggaggaaggactgtgtccctccttagggcgtctgtggcctcagtgagggaaggaagctgcatcagacaggggtttcctcgctgtccacccctctggcagaagatggattgggctgccccgtataaattaatgaaaagattaaagtttcgctaaaggggacatcgagtttatgtgtcatctcctggtgtctgtgtgcctgggatctgcaatatatcccagcccttgatgtactgtttctataaaaataaattacttgtaatttaattccacactatttctttccgtagtctattaccgacgagagcacgttagttcagctgcggaaaattggttgtggggtgtgtgcggaccccgagaacgccctaaaataaagacaaatcggggacaagctgggggttatcgattgcaggggtcgcatgaaaatttaacgacggtaaataataataacaacaaacatgggaatgcaataaaagacataattctccatcgccgcggggggaaaggatcctatagtaaaggcgagtgcgctttgaggggtcataaaaatcaattagttccaacacccacgtcccgcgttgaggggacggggacgagcagggacagaaaaagaaaccatatttgaatcccatctctctgtgaattcttgggtcacatgcgtctcagtacagcccgtcccgtgctgtgaccggatagagtttcaatttactgtggaaatttgctgtaaataaattgagcatccgatagaagctgttgctgattaaccttttatttttagcgtggccctgcaaagtcgtatcacccagctgtcaggcttctaatcgaaagttatgagaccacggtgaggggcaggcggtaatttaattacaacaaatatctttgggtttatggcgcagagctaaattaaatgtcattattcactgtctgtaatggaaatcaaaaggaaatcgcattacggcatttgggaaagaaagcggggagtgctctttaatgaagaaataactgtcttaagcagtgtcacacacttcacttaccatattcgggcctaattggaatggatcgtgaatcactccaagactgatttattagcgcttcacgcagcggctaattcatcacttgtattcttcatcatttttttttttcctctcgccgtgttgaagggagagtgaatgaggctttccacgtttcaggaggattttcttttttgaaaaatgcccttccagaggcttttgggtggctggcttgctttctgggccctggaggagacaggcggagagtccaggtgggcatggagaggcacagtggcaggtcacctggatggtcagtggaggtggaggtctgaaggcgccagctttggaaattattggtgaatttcgatgtcagcaccaggcaggggcctttttggcgggggtgtgagggaggatgactttgctgggaaacaggatcaggttctccaggcgcactgcagcccggtaggacccactttggaaatgaaaagccagttccgaaagctgggctggaagcttccgtgttgggttcaagagcaagttcacgttgcgctgtgtagactcctggctgctcccaaactctgagggttttctgaggttcccttcataggggcaccggccctgggccatgcacagtgtgtaagggtggctgtgggccgagggacccagcacgtgttttgcccacaacagccggagtgactggttcactcaccgccttggcggaggacgcctgttctctggacgaatcatttctcttgggtggtgactgccttgtgggtcaaggtgcaggttttctgccacagaaaacctgttaggaggaattaagcgactaagactgtcagggaggtggtggtgggggagaggagggggtggtgtccagattaccaggcataggctaaactgcctgcactctccagctggtctgtctgtggaggaggggattgtcaatactgggagagcagaggaggctcgtaggaggtgagagggggtggaatttgcatgcaaatcttcacatgaggcctgtgtgaatttctccagcctcctgagggtcccctgcgctattgcactcaacttcttgatagtttaccccaagactcagaagtccttagaggggcagaatgcccccaccacaaagcctgctatccttgggcgtcctcatgacccttggtcatgaatgggaccctttcatgtatggggacccttggtaatatgaatgggacgccttcagctccccagggcttccgaggaggccgagaagggcaaagacacttccgaggaggccgagaagggcaaagacattttctgggcttggtgtgtcaagagctagattggagaaggggctggatttggaactctttagccatcagctcaccctctccgtttgtggctaaagtctgaaggtggaaacttcggttctcctacagggtctacaggagttggggggcggggcgcccacacagaacgctggaaagttcgacagtccacttccactggctcggaactcactttttcaccttaagttcatcagcggtaacgcataggtctcacttaggcagggcacggatgatttaacaatttctacttctaggtcaggtgcggtggctcacacctctaatcccagcactttgggaggcccaggagggtggatcgcttgaggtcaggagtttgagaccagcctggccaacatggtgaaaccccgtctctactaaaatacgaaaattagccaggcatggtggtgagcacctgtaattccagctactcgggaggctgaggcaggagaatcgcttgaacctgggaggtggacgttgcagtgaggtgagatcacaccactgcactccagcctggatgagagagcaagactctgtctcaaaaacaaaataaaacaaaaacaaaacaaaaatcaaaaaagaaaacccaatttccagttctaggccaggtgcagtggctcacgcctgtcatcccagcactttgggaggcccaggagggtggatcgcttgaggtcaggagttcgagaccagcctggccaacatggtgaaaccccatctctactaaaaatacaaacgttagctaggtgtggtggtgtgcgcctgtaatcccagctactcgggaagctgaggctggagaattgcttgaatctgggaggtggaggttgcagggaggcgagatagtgccactgcagtccagcctggaccagagagcaagactccgtctcaaaaacaaaagaaagcaaaaacaaaaaacaagagaccagcctggccaacatggtgaaaccgcgtctctactaaaatacaaaattagccgggcatggtggtgggcacctgtagtcccagctactcgggaggctgaggcaggagaatggcttgaacctgggaggtggagcttgcagtgagccgagatagtgccactgcactccagcctgggcgacagagcgagacttgatttcagaaccaccaccaccacaacaaaacaaaacaaaaaatccaaaaaaaccccaatttccagtactaggtagtcagtgatgcagggctggagacagaggggcggtaagtgtctgggcgcccaccatcagtcacctcccagctcccagaggtgcaaagtgcttggttcagcctcatgggaaggatgctccctggggaggctgggctgggttcacagggctcttcacatctctctctgcttctccccaaggtttggttccagaaccggagagccaagtgccgcaaacaagagaatcagatgcataaaggtgggtgtcgggactggggggacctgaagctgggggatcctgctccaggagggatggggtcgacgaggtgctggctacacccaggaccaccacactgacacctgctccctttggacacaggcgtcatcttgggcacagccaaccacctagacgcctgccgagtggcaccctacgtcaacatgggagccttacggatgcctttccaacaggtagctcactttttcttcctctgaagatccctagggacctgctgctcccttcccctttcccctatttgctgccgcatcctgacactcctagtccctccctgcccctgcagacttctcagctggcccttagaaaaaaagcctcttttccgaggaggcatttacaggcaccttggcacctatgaaatcaggctgggccaggcggggtggctcacacctgtcatcccagcactttgggaggctgaggagggtgcatcacctgagatcaggagttcaagaccagcctggccaacttaacgaaaccctgtctattaaaaatacaaaatgggtgtggtggctcacgcctgtcatcccagcactttgggaggccgaggcaggtggatcacctgaggtcaggaattcgagaccagcctgaccaacatgctgaaaccccgtctctactgaaaacacaaagcttagccgggcgtggtggtgcacacctgtgatcccaggtacttgggagggagaatcacttgaacctgggaggtggaggttgccgtgagccaatatcgcgccactgcactccactctgggtgacagagtgagactccaagactccatctcaaaaaaaaaaaaaaaaaaatcaggctgtaaaaatccacttttgggaaggtgaacacacacaagcccaaacagaaatctgacaaaaaccagaggggtgaaaagtccacacagtcaggcacccccacctggcttgctgcctggttaagaagggcgcagatgcctgtgcctggataccagagatgggacagacacccattcccttttcatcaccacccccgagtgcccgagggcctggggcgtctgcctggcccctggcccctggcttgggctctgcacctctgagctggagacaccctactcagctccccacttactttggagtgagcagcgcttgggtgcccagcgtggatttggggcttccagggagtcggggttcggtcgcggagcccaagcttcccaagggcgcccccgccctgccctggcttagtggtggggatgggatggggggaagcggggagctgcgtggaaggaggtgaagggtcacaggaggagagagcgcagcgcccacgtgcgccctgcctgaacgcgcagcgcagcgcccggctgcggtgccccttgccccttcggtccctaatttgggggtcgggagtgcatgcgcgggcggaacgggcttggggggggggctctggcagggcggacgcgtggcctcccttcttcaccgttttattccaaggggacaggctggggattgtatttgggcgcgtgtttggctgagggtgcagggacttggggggtggcggtggggagcgcggaaggtataaacgtataaatcataagtaaacaactcagaaatggaccccgagcgctggtcgccgctagctctccagctctccctggcccaggcccgaaggagaggggtccgcatccctccgcggttctcctctcctgggtacctggccttgaggtgggggaacgagcctacttcttgtaccgtcttttgccgacggcgggacccagtgaaattaggccgttggagcccgcaggcctgcctggctttgcgcaccggagtcttggggacctggtgtccccgggaaaaacttggggacctggtatccccgggagaggcttggggacctggtgtcccgggagaggcttgggtacctggtttctctggaagaggcttggacacctggtgtcctgggagggcctttgggacctggtgtcctgggagaggcttggagatctgttgtcctgggagaggcttggggacctggtgtccctggagaggcttggggacctggtgaccttggagaggcttggagacctggtgttctgggagaggcttggggacctggtgttctgggagaggcttggggacctggtgtctctggaagaggcttggacacctggtgacccgggagggccttggggatctggtgtcccgggagagccttggggacctggtgtcctgggagaggcttggggacctggtgaccttggagaggcttggggacctggtgtcctgaaagagccttggggatctggtgtcccaggagaggcttggggacctggtgtctctggaagaggcttggacacctggtgtcctggggagaggcttggggacctggtgtcctgggagaggcttggggacctggtgtcctgggagaggcttggagatctggtgagccgggagaggcttggggacctggtgtcccgggagaggcttggggacttggtgtcccgggagaggcttggacacctggtgtcccaggagaggcttggggacctggtgaccttggagaggcctggggacctggtgacccgggagagccttggggacctggtgtcctggggagagccttggggacctggtgaccttggagaggcttggggacctggtgtctcgggagtgccttggggacctagtgacccgggagaggcttggggacctggtgtcccgggagaggcttggggacctggtgtcctgggagagccttggggatctggtgtcctggggagaggctgggggacctggtgtctcgggagagagccttggggacctggtgacccgggagaggcttggacacctggtgtcccgggagaggcttggggacctggtgacccgggagagccttggggacctggtgtcctggggagaggctgggggacctggtgtctcgggagagagccttggggacctggtgacccgggagaggcttggacacctggtgtcccgggagaggcttgggagcctggtgtcccgggagagccttggggaccaggtgaccttggagaggcttggggacctggtgatcttggagaggcttggggacctggtgtctcgggagagccttggtgacctggggacccgggagaggcttggggacctggtgtccccgggagaggttacgggggctggttgggggagagaacgttgtgagccaaagtccctgaatccctgcgaagagagcgcatcgggagctccccctgagggcgttccatttgtggacccccctcccatgcgctttgcagggagctgttcggattcccctggcccggctcccgcggatgcatccagtggcagcgccaattctgggccagggggaaggaggaaaggcgggtgtggggtggtctccacggctggagaaggggcgacgctccctaggggagaagaggcacgttggaggtttccgggggcgcggggcggagcaggccccccagtccccatcctgcgccctcaccccgccgggtccgctcccgcaggtccaggctcagctgcagctggaaggcgtggcccacgcgcacccgcacctgcacccgcacctggcggcgcacgcgccctacctgatgttccccccgccgcccttcgggctgcccatcgcgtcgctggccgagtccgcctcggccgccgccgtggtcgccgccgccgccaaaagcaacagcaagaattccagcatcgccgacctgcggctcaaggcgcggaagcacgcggaggccctggggctctgacccgccgcgcagccccccgcgcgcccggactcccgggctccgcgcaccccgcctgcaccgcgcgtcctgcactcaaccccgcctggagctccttccgcggccaccgtgctccgggcaccccgggagctcctgcaagaggcctgaggagggaggctcccgggaccgtccacgcacgacccagccagaccctcgcggagatggtgcagaaggcggagcgggtgagcggccgtgcgtccagcccgggcctctccaaggctgcccgtgcgtcctgggaccctggagaagggtaaacccccgcctggctgcgtcttcctctgctataccctatgcatgcggttaactacacacgtttggaagatccttagagtctattgaaactgcaaagatcccggagctggtctccgatgaaaatgccatttcttcgttgccaacgattttctttactaccatgctccttccttcatcccgagaggctgcggaacgggtgtggatttgaatgtggacttcggaatcccaggaggcaggggccgggctctcctccaccgctcccccggagcctcccaggcagcaataaggaaatagttctctggctgaggctgaggacgtgaaccgcgggctttggaaagggaggggagggagacccgaacctcccacgttgggactcccacgttccggggacctgaatgaggaccgactttataacttttccagtgtttgattcccaaattgggtctggttttgttttggattggtatttttttttttttttttttttttttttttttttgctgtgttacaggattcagacgcaaaagacttgcataagagacggacgcgtggttgcaaggtgtcatactgatatgcagcattaactttactgacatggagtgaagtgcaatattataaatattatagattaaaaaaaaaatagccgtgcactcttgaccccgtcagcgtccaacgtggaaaaggcgttacctcttctcccagcgctggccgcctggccactgagggccctttgcaaaaatcacgggtgtagagatggccctgggcgcgctgggagtgtggttgtgtttctgaaggggataaaagagggcacggtggtgccaagatatcagtttggtacctgagctgtttctggttgggaagcgtaaaagccagggagagatccagagagttttcaagtttttgcagatgtaggtggttccagcttttctttctcccctactccatcttctgcgttcccccagttcttttatttctttgttttttatttttgagacagagacttgctttgtcgcccaggctggagtgcagtggcgcaatgtcagctcactgccacctccgcctcccgggttcaagcgatgctcctgcctcagcctcccgagtagctgggactacaggcacctgccaccacccccggctaattttttgtatttatagtagagacggggtttcaccgtgttggccaggctcgtctcgaactcctgacctcaggtgatctgcccgcctcggcctcccaacgtgcccccagttttataaacagcagatagcaacttgtcgtcacagctggcatgggctggacagttgcttgaaatgacctaaccaaaaacattcaagggttctgcccccagatttcgggagatccacgttccatgttctgattggttttctgggaacacagcaaggggtttggtgacctccgagaagatccatctgcatgattggcattagttaccacagcctgcccagagagaaactatcttctcccaacatttactaacatccactggtcaactctcttatttccataacacatttgcatctttctggattcaagcttggtggttttctttcctaacttctgatttagatacttctccctgaggtggggataaaagaaaaaaaaaaacaacttctttttttcttccgcataacactttctatcttgtcactgagctgaactgtagatccatttggacccgtctcatttgtatcttctgatattctttatacaaaccaaaagtccccttcaacattttttatgtcaaaatgttacaaccgctgtaaaatgacggagagagagagaaagaatcccagacattaacggtattagagagtttgcctcattcatccatttttcttaaaagctggaaattaaaaaaaaaaaagagagagagaggcttt

SEQ ID NO: 4116 - DNA, 28604 bp, human; identical to SEQ ID NO: 2839

SEQ ID NO: 4117 - DNA, 35067 bp, human; identical to SEQ ID NO: 2838

SEQ ID NO: 4118 - DNA, 28604 bp, human; identical to SEQ ID NO: 2839

SEQ ID NO: 4119 - DNA, 13737 bp, human; identical to SEQ ID NO: 2840

SEQ ID NO: 4120 - DNA, 16637 bp, human; identical to SEQ ID NO: 2841

SEQ ID NO: 4121 - DNA, 16722 bp, human; identical to SEQ ID NO: 2842

SEQ ID NO: 4122 - DNA, 16636 bp, human; identical to SEQ ID NO: 2843

SEQ ID NO: 4123 - DNA, 41089 bp, human; identical to SEQ ID NO: 2844

SEQ ID NO: 4124 - DNA, 41573 bp, human; identical to SEQ ID NO: 2845

SEQ ID NO: 4125 - DNA, 25577 bp, human; identical to SEQ ID NO: 2846

SEQ ID NO: 4126 - DNA, 41135 bp, human; identical to SEQ ID NO: 2847

SEQ ID NO: 4127 - DNA, 41122 bp, human; identical to SEQ ID NO: 2848

SEQ ID NO: 4128 - DNA, 41135 bp, human; identical to SEQ ID NO: 2847

SEQ ID NO: 4129 - DNA, 41089 bp, human; identical to SEQ ID NO: 2844

SEQ ID NO: 4130 - DNA, 41089 bp, human; identical to SEQ ID NO: 2844

SEQ ID NO: 4131 - DNA, 21597 bp, human; identical to SEQ ID NO: 2852

SEQ ID NO: 4132 - DNA, 31729 bp, human; identical to SEQ ID NO: 2853

SEQ ID NO: 4133 - DNA, 41135 bp, human; identical to SEQ ID NO: 2847

SEQ ID NO: 4134 - DNA, 37109 bp, human; identical to SEQ ID NO: 2855

SEQ ID NO: 4135 - DNA, 41090 bp, human; identical to SEQ ID NO: 2856

SEQ ID NO: 4136 - DNA, 41135 bp, human; identical to SEQ ID NO: 2847

SEQ ID NO: 4137 - DNA, 13385 bp, human; identical to SEQ ID NO: 2858

SEQ ID NO: 4138 - DNA, 41089 bp, human; identical to SEQ ID NO: 2844

SEQ ID NO: 4139 - DNA, 41573 bp, human; identical to SEQ ID NO: 2845

SEQ ID NO: 4140 - DNA, 25577 bp, human; identical to SEQ ID NO: 2846

SEQ ID NO: 4141 - DNA, 41135 bp, human; identical to SEQ ID NO: 2847

SEQ ID NO: 4142 - DNA, 41122 bp, human; identical to SEQ ID NO: 2848

SEQ ID NO: 4143 - DNA, 41135 bp, human; identical to SEQ ID NO: 2847

SEQ ID NO: 4144 - DNA, 41089 bp, human; identical to SEQ ID NO: 2844

SEQ ID NO: 4145 - DNA, 41089 bp, human; identical to SEQ ID NO: 2844

SEQ ID NO: 4146 - DNA, 21597 bp, human; identical to SEQ ID NO: 2852

SEQ ID NO: 4147 - DNA, 31729 bp, human; identical to SEQ ID NO: 2853

SEQ ID NO: 4148 - DNA, 41135 bp, human; identical to SEQ ID NO: 2847

SEQ ID NO: 4149 - DNA, 37109 bp, human; identical to SEQ ID NO: 2855

SEQ ID NO: 4150 - DNA, 41090 bp, human; identical to SEQ ID NO: 2856

SEQ ID NO: 4151 - DNA, 41135 bp, human; identical to SEQ ID NO: 2847

SEQ ID NO: 4152 - DNA, 13385 bp, human; identical to SEQ ID NO: 2858

SEQ ID NO: 4153 - DNA, 40699 bp, human; identical to SEQ ID NO: 2876

SEQ ID NO: 4154 - DNA, 46069 bp, human; identical to SEQ ID NO: 2877

SEQ ID NO: 4155 - DNA, 19535 bp, human; identical to SEQ ID NO: 2878

SEQ ID NO: 4156 - DNA, 11280 bp, human
agtgcggacgcccggctcccggcgtggacgccatggtgctgtgcccggtgattgggaagctgctgcacaagcgcgtggtgctggccagcgcctccccacgccgtcaggagatcctcagcaacgcggtacggcctgggcctgggcggggcaggggaccggggacggaggggctgaaccccggagggcccagcgactcaggaactctagggatagggatgggagagtgacccgagacccttagggatgggggaggggagagtgtcccgggacctccagggatagggttggggagagtgacccggaacctctagggatgggggaggggagagtaacccggaaccccctaggcatgggggtggggagtgacctgggtccccatagggatgggggaggggatcgtaacccgggacccctaggaatggggagggtagagtgacccaggaccgctagggatggggacagcagagtgaccccggagccccatggatggggatgaggagagtaacccgggacccccaggcatggggatggggagagtaacccgggacctccagggttggggatggggagagtaagccgagaccccccctagggatgggggtgggggagtaacccgggacccctagggatgggggagaggagagtaacccgggacccccaggcatggggatggggagagtaagccgagacccccaggaatggggttggggagaataacccgggacccctagggatggggttggggagagtgacccaggaccccctagggatgggggaggggagagtaacccgggacccccctaggggtgggggaggggagagaaacccgggacaccttagggatggggttggagagagtaacctgtaacctgggaccccctagcgatgggggtggggagagtaacccaggacgccctaggcatgtggttggggagagtgacccgggaccccctagggatggggagggaggagtgacccaggaccgctagggatggggacagcagagtgaccccggagccccatggatggggatggggagagtaacccgggacccccaggcatggggatggggagagtaacccgggacctccagggttggggatagggagagtaagccgagacccccctagggatgggggtggggagagtaacccgggacccctagggatgggggagaggagagtaacccgggacccctaggaatggggaggtcaagtgacccgggacccccctagggatgggggtggggagagtgacccgaaacccctaggcatggggttgcagggagtgacccagaaccccctaggaatggggatgggagagtaacctgggaccccctagggatgggggaggggagagtaagccgggatccccctagggatgggggtagggagagtaacccgggacccaaaaggatgagggaggggagagtgacctggaacccctaggcatggggttggggagagtgacccaggaccccctagggatgggggagggaagggtgacccgggacccccaaggaatggggaggggagagtgacccaggaccacctagggatggggaaggggagagtaacccaggaccccctagggatgggggtggggagagtaacccaggacgccctaggcatggggttggggagagtgacctgggacccccttagggatggggagggaggagtgtcccaggaccccctagggatggggagggaggagtgtcccaggaccccctaggaatggggaggggagagtgatccaggaccgcctagggatgggggaggggagagtgatccggaatccctaggtatgggggaggggagagtgacccaggaccccctaggaatggagaaagcagagtgacccgggacccctagggatgggggaggggagaataacccaggacccctagggatgggggaggggagagtgagccaggaccccctaggaatggggagggcagagtgacccgggacccatagggatgggggagggcagagtgacccgggacccctagggatgggggaggggagagtgatccagtaccgcctagggatgtgggtggggaaagtaacctgggacccctagggttgggggaggggagagtaacccgggaaccctagggatgggggaggggagagtaacccagaacccctagggatggggttggggagtgtgacccggaaccccctagggatgggggaggggagagtgacccagaacccctagggatgggggaggggagagtgacccagaacccctagggatgggggaggggagagtgacccagagcccctagggatgggggaggggagagtgacccaggatgccctagtgatgggggaggggagtgtgatccaggacctcctagggataagggaggggagagtaatccaagacccctaggaatgggggaggggagagtaacccgggaccccctaggggtgggggaggggagtgacctgggacccctagggattggggaggtgagtgactcaggacttctagggatggagtgggccctgtgactgatggttggactttgtagctggggtatgggaagtgtttcctggtgcccccatgaggatcttattccgggtggtaggacgcctaggtagtgggtgtctgcctctctctggagccctaatcacatggaggagacggtctagtgatgaagggatagttacttgtgatggggggtagttactggtgacaggcggatagttataggtgatgtgggatagttactggtaatggggtgatagttactggtgatgggatagttactggtgatgggggcatagttactggtgatggaaggatagttactggtgatgggggatagttactggtgatgggagatagttactggtgatggggcgtagttaccggtgatgagggatagttactggtgatgatggggcatatttactggtggtgggggttagttactggtgatggtgggatagttactgggtttgatgatggggcatagttattggtgatgggggtagttactggtgatgtggggatagttactggtgatgggaggatagttactgttgatgggagatagttactggtgatggggggatagttactggtgatgatggggcatagttactggtgatgggggatagttactggtgatggtggatagttactggtgatggggggtagttactgggtttgatgatggggcatagttactggtgatggggggtagttactggtgatgtgaggtagttactggtgatggcagagaagttactggtgatggtagggtagttactggttgcctatggatggtgcagtggggcaggagtctactcttggggactacggactggaggtctggtaccctgggaggggggacaccacatgcctggtcctagtgacggggatgagagtggtcagggtgcctcacagaaggcatgggtctccatgattgggggtgacagggcatagggcaggggtctatatgatctggggttgagatctgcagggcaggtccagggcttggtgactggtgccctgaagaccaggatgggcgtcagggccaggatctgggggcaccttcaagaggtgaggagcgctgaggagtgtagaagagtggaagaaagacgaaaaaagaaaagcagcttcacagtcaaagacgggtttattttggagaacaagcctgagcggggcttctggctgagttaggtcaggagtgttctctcttacagactaagggtatttaagggtttaggaaggggaatcttatcgcaggctcggaatgtttccctgtgaggcaaagttgactgaggtgttagaatgtctctggtctgaaggaggttatcttgggcttgggatgtttctggtcagaggcggtttatttcaggctttgactgtttctggtcatgctgacattagccattaggctgatgttttggggctggttttaggcagtttttaatcacgggaacttaaaatggcaatgcttgtccaagatggcggtgtgtgtccaagatggtggtgtgtgtcaaagatgaccatgcatgtccaagatggcagtgcttgtccaagatggtggtgcttatccaagatggcggtgtgtgtccaagatggtggtgcttatccaagatggtggtgtgtgtcccagatggtgtgtgtccaagatggtggtgcttctccaagatggcagtgtgtgtccaagatggtgtgtctccaagatggtggtgcttatccaagatggcggtgtgtgtccaagatggtggtgcttatccaagatggccgtgtgtgtccaagatggtgtgtgtccaagatggtggtgcttatccaagatggcagtgtgtgtccaagatggcggcatgtgtccaagatggtggtgcttatccaagatggcagtgtgtgtccaagatgttgtgtgtccaagatggtggtgcttttccaagatggtggtgtgtatccaagatggtggcgtgtccaagatggcggtgtgtccaagatggtggtgcttgtccaagatggtgttatgggtccaagatggcagtgtgtgtcccagatggtgtgtgtccaagatggtggtgcttatccaagatggcggtgtgtgtccaagatgttgtgtgtccaagatggtggtgcttatccaagatggcagtgtgtgtccaagatggtgtgtgtccaagatggtggtgcttatccaagatggcggtgtgtgtccaagatggtggtgcttatccaagatggcggtgtgtgtccaagatggtgtgtgtccaagatggtggtgcttatccaagatggctgtgtgtgtccaagatggtgtgtgtccaagatggtggttcttatccaagatggcggtgtgtgtccaagatggtgtgtgtccaagatggtggttcttatccaagatggcggtgtgtgtccaagatggtggtgcttttccaagatggtgttgtgtatccaagatggcggtgtgtccaagatggcggtgcttgtccaagatggtgttatgggtccaagatggcagtgtgtgtcccagatggtgtgtgtccaagatggtagtgcttatccaagatagctgtgtgtgtccaagatggtggtgcttatccaagatggcggtgtgtgtccaagatggtggtgtgtgtcaaagatggccatgcatgtccaagatggcagtgcttgtccaagatggtgtgtgtccaagatggtggtgcttctccaagatggcggtgtgtgtccaagatggtgtgtctccaagatggtggtgcttatccaagatggcggtgtgtgtccaagatggtgtgtctccaagatggtggtgcttatccaagatggccgtgtgtgtccaagatggtgtgtgtccaagatggtggtgcttctcccagatggcggtgtgtgtccaagatggtggtgcttctccaacatggccgtgtgtgtccaagatggtgtgtgtccaagatggtggtgcttatccaagatggcagtgtgtgtccaagatggtggtgcttctccaagatggccatgtgtgtccaagatgttgtgtgtccaagatggtggtgcttatccaagatggcggtgtgtgtccaagatggtgtaatgggtccaagatggcagtgtgtgtcgaagatggcaatgctcctgctctgtgaatccagaccctctagttataacaggacgaggggtggtgtgttctttctggccacttcctgctgagggaggtggttattacgggtcaccaaacacagccctggaggggaagaggttgatttgttcctggtagcactctttaggggccttccaagcagcacccgttgaaacatctagcttttagttcacagggctttaagaaagcagaacttgggtttcagaggttttcagttaggaaaaattggagaaaaagaaaaaggaaaagaatgcaaaacattatcttggagacatgtagccagaaaaattagaatttaattcaaaccgtagaaaagaataaaaactgaaaaccattaggcaagactagaatttcacgacaggggtaactatagtttttcaaacacgatttttctttttccagttttcccacttttattaaaagacaaattatgggctgggcatggtggctcatgcctgtaatcccagcagtttgggaggccgaggttggcggatcacgaggtcaggagatcgagaccatcctggctaacatggtgaaaccccgtctctactaaaattacaaaaaattagccgggcgtggtggcgggcgcctgcagtcccagctacttgggaggctgaggcaggagaatcgcttgaacctgggaggcagaggttgcagtgaaccgagatggcaccactgcactccagcctgggcgacagagcaagactccgtctcaaaaaaaaaaaaaaaaatgtcatgagatgtagggaccagccccacagggtcagtggatctctccctgtgtgcggaggcatgagagtgtagaaataaagacacaagacaaagagataaaagaaaaggcagctgggcccgggggaccactaccaccaagacgcggagactggtggtggtcccgaatgccaggctgcgctgatatttattggatacaagacaaaggagcagggtaaggagtgtgagccatctccaatgataggtaaggtcacgtgagtcacgtgtccactggacagggggcccttccctgcctggccgccgaggcagagagagagaggagaaggagagaaacagcttacgccattatttctgcttatcagacacttttagtactttcactaatttgctcctgctaactaaaggcagagccaggtgtacaggatggaacatgaaggcggactaggagcgtgtgaccactgaagcaaagcaccacagggagagggttaggcctccggataactgcgggcgggtctgactgatgtcaggtcctccacaggaggtggaggagcagagtcttctctaaacccccccagggaaagggagactccctttggtgaccccgtctgggcataacagaaggctcgcgctcgtcttctggtcgcacctcaccatgtcccctcagctcctatctctgtatggcctggcttttcctacattatgattctagagcaaggattattataagattggtataaagagtaattactaccaactaatgattaatgatattcatatataaccatatctaagatctatatctggtataactttctcgttttatattttatcatataccggaagagctcgtgtcctcggtctcttgcctcagcacctgggtgtcttgccgcccacaatgagaggtgcaacttgacatagggagggtagaagatagcctgagtatagggaacctcttgccatttcctggtgataaagttgtcaaggtccctgagaatttgcaagttaaaggtgctatgttcgggccatctgctgtcattatgtagtttgtattgatgccagactattgcaataaaaaattcaacactctggctttaggttcctctgtaagccaagtttggccaggttggaaaggagacatcccagagaggaggacataggaatgtcgggttgtttggcacccacgtgggctggtaaaaggaagccgagagtgtctgtttgtgttttaggcaaccccagacaaaagacagagacccagaatcctctttataaggaggacggccaagctgagaagatactgggcatccctcaagatcgcttctagcttagtgccgctggtcctccgaggactgggatggccgacctgacttttcctgggtaccaaaagtcagaggagggcagatcttaccagacggctggatttgtgtctgatgttggatgttcctgttggaattggcaaaggggctcccaaactggagccgcgcagggaagacagagagagagagagaagagggaagaagacggacgaagagagaggaagacgaagcaagggttagggagcgaaatacctgttgcagggggtcagaggtggatttctgagacctgagggttttgagaaccctccagcttgagcctctaagtcccctttacatgagttgtcttcctcacacaaattgcttggaaggtgaatggagagaaaagatgggaggggtggccagagaccctcacgatccaggagttagcccaggatgagctgctgctgcccacagcttcctgggttgcaagagaacctccactcccaacactcaaagagggagagagagaaaggacagggtcagagggccagaggctctaaaggatccaggagttagcccgggacaggctgcccctgcccactgcatcctgggttgcaaaagggcctctgtccgtaacacctgtcctgggtttcggcaccaaatgtaagagtttaagaaggaggaaacaaatatagaaagtgagcctgggcgcagaggctcacatctgtaatcccagcactttgggaggccgaggcgggcggatcacctgaggtcaggagttcgacaccagcctgaccaacatggtgaaaccccatctctattaaaaatacaaaaattagccgggtgtggtggcgcccacctgcaatcccagctactcgggagactgaggcaggagaatcgcttgatcctgggagatggagcttgcagtgagccgagatggcatcactgcccctccagcctgggcgacacagcgagactccgtttcaaaaaaaaaaaaaaaaatacaaaaagtggctcagcaaagggttttggaaaagggggcttctcgcaggctcggaatgtttctgtgtgagggaaaattgattgcggggttggactgtctctggtcggaggggaggtttctggtcacagaggggtttatcccacggctggaatgtttctggtcatgctgacattagccattaggctgatgtttgggggctggatttaggcagtttttaatcaagggaacttaaaatggaagtgtgtgtccaacatggcagtgtctgtccaagacgggggtgtctgtccaagatggcggtgtgtgtccatgatgggggtgtctgtccacgacggcggtgtctgtccacgatggtggtgtgtgtcctcgatggccaaaatggcggtgtgtgtccacgatggtgtctgtccacgatgggggtgtgtgtccacgatggccaagatggcagtgtgtgtccacgatgatgtctgtccacgatgggggtgtgtgtccacgatggccaagatggcagtgtgtgtccacgatggcggtgtgtgtccatgatggcggtgtgtgtccatgatggcggtgtctgtccacgatggcggtgtctgtccacgatggcggtgtctgtccaagatggcggtgtgtgtccatgatggcggtgtgtgtccaagatggaggtgtctgtccaagatggcggtgtgtgtccacaatgacactgtgtccatgatggccaagatggcggcatgtgtccacgatggtggtgtgtgtccaagatggcggtgtctgtccaagatggcggtgtgtgtccaagatggcggcgtgtgtccaagatggcggcgtgtgtccatgatggtggtgtgtgtccaagatggcggtgtctgtccaagatggcggtgtgtgtccaagatggcggtgtgtgtccaagatggcggtgtgtgtccatgatggcggtgtgtgtccaagacggcggcgtgtgtccacgacggcggtgtgtgtgcacgacgacggtgtgtgtcccagatggcagtgtgtgtccacgatggcggtgtgtgtccacgatggcggtgtgtgtccaagatggcggcgtgtgtccacgacggcggtgtgtgtccacgacgacggtgtgtgtcccagatggcagtgtgtgtccacgacgacggtgtgtgtccacgatggtggtatgcgtccaagatggtggtgtctctccaagatggcggtgtgtgtccaagatggcgatgcttttgctctgtcagaggggagatggtcagaggggagatgcggagttccctgcaccctggcagggtgtggcagccaggggctcccccactggaggcatttaccaccatcattcctgaccccacggtctctgcaggggtcactacctctaggccaggcctccccaggggcggtgttgtctcttcctgggtaccagggattgacgtagagccatcattgtctcccttcccacagccatcattgctggcgtttttcctgaatttcctgtgggcaggttgggttttgtactctgccccaaccttcaggtctctgggaatcctcggacactgttggctcgtgggttcaaggcccgagtcaatacctccctgctggcctctttgttcctggcttcttcctttgccaatctcttccctcgagagccaagaaggcccctggtcagtccctgaaggcccctggtcagtccgcggcccactaaccacacttagggaaagccctggtcagtccccggctccccagccacacttagggaaagcttggcggatggatgagctcacctgggacagggtcggggagtgtagcaaacgctatgtgcgtcctgcaaatcttgcatgtcccattcacttttcatagggtctttcattgacccttctgaccccttttctactgttgcagggtctcaggtttgaggtggtcccctccaagtttaaagagaagctggacaaagcctccttcgctactccgtatgggtacgccatggagaccgccaagcagaaggccctggaggtggccaaccggctgtaccaggcaaggggcccctgcccttcggcccttatgaaaattcctttgctgtgatgaggggatttgcgggtggtaaatatacatgacacaaataaacgtcattcaaaagatgcagttggtggcacagcttagctattgctatgttataatgtaatgcactattgcagtaacctaataataccattaatgatacagaattaatggagcttatctgttactgtgtgttataatattctcttgcaattgatacagtatcattgatgatatacaattaatgtagcttatctgttactatgtgttataataatttctcgcaattgatacagtatcatttatgatatacaattaatgtagcttatctattactatgtgttataatatcctcttgcaattgatatcatagtatcattgatgatacagaattaatgtagcttatctattactatgtgttataatattgtcacaattgatatcacagtatcatttatgatatagaattaatgtagattatctgttactatgtgttataatattctcttgcaattgatttcatagtatcatttatgatatagaattaatgtagcttatctattactatg

SEQ ID NO: 4157 - DNA, 50623 bp, human
atctccactcccctcccaccaggcacgaggacatccccatccccacgccactcgcaccgggtccgcggggaaccccctatctctaccttccccgacgcggctcccacaagacccccatctctgcgccgggcccctccacgtgcgggtaagaaccccccacccccacaactgcccacaaccgcagctgcggaaacccagcatttccactccccacgccgcgcctgcaaggaaccccaagtatccacgccagcctttcctccccgggaccccgcagctgcctgcgccattgcaggtcttggcgccgcaggcggggtggggaggggcggggcgagcgccgggggcggggacggggcccgggaggcggagctgggggcggtgcttcaccaagcggccggggcggtgcccgggggggaggcgggcgggggtgtggcctgggcgtggcctcacggggagctcaatggcggcgtggcatgggcgtggcctggcggagagggcaaggaggtgtggcctgggcgtggcctggcggagcggtcaatggcggcgtgacatgggcgtggcctggcggagagggcaatggaggtgtggcctgggcgtggcctgacggagagggcaatggaggcgtggtctgggcgtggtctcaggggagatcaatggggcgtgacatgggcgtggcctggtggagagggcaatggaggtgtggcctgggcgaggcctgacggagtgttcaatggaggcgtggcctgggcgcggtctcgcggggaggccactgaaggcgcggactgggcgtggcctcgcggaggcgggcgggggcgtggcctcgcggaggcgggactctggccgcctgttttttttgcagccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcggtacggcctgggcctgggcggggcaggggaccggggacggaggggctgaaccccggagggcccagcgactcaggaactctagggatagggatgggagagtgacccgagacccttagggatgggggaggggagagtgtcccgggacctccagggatagggttggggagagtgacccggaacctctagggatgggggaggggagagtaacccggaaccccctaggcatgggggtggggagtgacctgggtccccatagggatgggggaggggatcgtaacccgggacccctaggaatggggagggtagagtgacccaggaccgctagggatggggacagcagagtgaccccggagccccatggatggggatgaggagagtaacccgggacccccaggcatggggatggggagagtaacccgggacctccagggttggggatggggagagtaagccgagaccccccctagggatgggggtgggggagtaacccgggacccctagggatgggggagaggagagtaacccgggacccccaggcatggggatggggagagtaagccgagacccccaggaatggggttggggagaataacccgggacccctagggatggggttggggagagtgacccaggaccccctagggatgggggaggggagagtaacccgggacccccctaggggtgggggaggggagagaaacccgggacaccttagggatggggttggagagagtaacctgtaacctgggaccccctagcgatgggggtggggagagtaacccaggacgccctaggcatgtggttggggagagtgacccgggaccccctagggatggggagggaggagtgacccaggaccgctagggatggggacagcagagtgaccccggagccccatggatggggatggggagagtaacccgggacccccaggcatggggatggggagagtaacccgggacctccagggttggggatagggagagtaagccgagacccccctagggatgggggtggggagagtaacccgggacccctagggatgggggagaggagagtaacccgggacccctaggaatggggaggtcaagtgacccgggacccccctagggatgggggtggggagagtgacccgaaacccctaggcatggggttgcagggagtgacccagaaccccctaggaatggggatgggagagtaacctgggaccccctagggatgggggaggggagagtaagccgggatccccctagggatgggggtagggagagtaacccgggacccaaaaggatgagggaggggagagtgacctggaacccctaggcatggggttggggagagtgacccaggaccccctagggatgggggagggaagggtgacccgggacccccaaggaatggggaggggagagtgacccaggaccacctagggatggggaaggggagagtaacccaggaccccctagggatgggggtggggagagtaacccaggacgccctaggcatggggttggggagagtgacctgggacccccttagggatggggagggaggagtgtcccaggaccccctagggatggggagggaggagtgtcccaggaccccctaggaatggggaggggagagtgatccaggaccgcctagggatgggggaggggagagtgatccggaatccctaggtatgggggaggggagagtgacccaggaccccctaggaatggagaaagcagagtgacccgggacccctagggatgggggaggggagaataacccaggacccctagggatgggggaggggagagtgagccaggaccccctaggaatggggagggcagagtgacccgggacccatagggatgggggagggcagagtgacccgggacccctagggatgggggaggggagagtgatccagtaccgcctagggatgtgggtggggaaagtaacctgggacccctagggttgggggaggggagagtaacccgggaaccctagggatgggggaggggagagtaacccagaacccctagggatggggttggggagtgtgacccggaaccccctagggatgggggaggggagagtgacccagaacccctagggatgggggaggggagagtgacccagaacccctagggatgggggaggggagagtgacccagagcccctagggatgggggaggggagagtgacccaggatgccctagtgatgggggaggggagtgtgatccaggacctcctagggataagggaggggagagtaatccaagacccctaggaatgggggaggggagagtaacccgggaccccctaggggtgggggaggggagtgacctgggacccctagggattggggaggtgagtgactcaggacttctagggatggagtgggccctgtgactgatggttggactttgtagctggggtatgggaagtgtttcctggtgcccccatgaggatcttattccgggtggtaggacgcctaggtagtgggtgtctgcctctctctggagccctaatcacatggaggagacggtctagtgatgaagggatagttacttgtgatggggggtagttactggtgacaggcggatagttataggtgatgtgggatagttactggtaatggggtgatagttactggtgatgggatagttactggtgatgggggcatagttactggtgatggaaggatagttactggtgatgggggatagttactggtgatgggagatagttactggtgatggggcgtagttaccggtgatgagggatagttactggtgatgatggggcatatttactggtggtgggggttagttactggtgatggtgggatagttactgggtttgatgatggggcatagttattggtgatgggggtagttactggtgatgtggggatagttactggtgatgggaggatagttactgttgatgggagatagttactggtgatggggggatagttactggtgatgatggggcatagttactggtgatgggggatagttactggtgatggtggatagttactggtgatggggggtagttactgggtttgatgatggggcatagttactggtgatggggggtagttactggtgatgtgaggtagttactggtgatggcagagaagttactggtgatggtagggtagttactggttgcctatggatggtgcagtggggcaggagtctactcttggggactacggactggaggtctggtaccctgggaggggggacaccacatgcctggtcctagtgacggggatgagagtggtcagggtgcctcacagaaggcatgggtctccatgattgggggtgacagggcatagggcaggggtctatatgatctggggttgagatctgcagggcaggtccagggcttggtgactggtgccctgaagaccaggatgggcgtcagggccaggatctgggggcaccttcaagaggtgaggagcgctgaggagtgtagaagagtggaagaaagacgaaaaaagaaaagcagcttcacagtcaaagacgggtttattttggagaacaagcctgagcggggcttctggctgagttaggtcaggagtgttctctcttacagactaagggtatttaagggtttaggaaggggaatcttatcgcaggctcggaatgtttccctgtgaggcaaagttgactgaggtgttagaatgtctctggtctgaaggaggttatcttgggcttgggatgtttctggtcagaggcggtttatttcaggctttgactgtttctggtcatgctgacattagccattaggctgatgttttggggctggttttaggcagtttttaatcacgggaacttaaaatggcaatgcttgtccaagatggcggtgtgtgtccaagatggtggtgtgtgtcaaagatgaccatgcatgtccaagatggcagtgcttgtccaagatggtggtgcttatccaagatggcggtgtgtgtccaagatggtggtgcttatccaagatggtggtgtgtgtcccagatggtgtgtgtccaagatggtggtgcttctccaagatggcagtgtgtgtccaagatggtgtgtctccaagatggtggtgcttatccaagatggcggtgtgtgtccaagatggtggtgcttatccaagatggccgtgtgtgtccaagatggtgtgtgtccaagatggtggtgcttatccaagatggcagtgtgtgtccaagatggcggcatgtgtccaagatggtggtgcttatccaagatggcagtgtgtgtccaagatgttgtgtgtccaagatggtggtgcttttccaagatggtggtgtgtatccaagatggtggcgtgtccaagatggcggtgtgtccaagatggtggtgcttgtccaagatggtgttatgggtccaagatggcagtgtgtgtcccagatggtgtgtgtccaagatggtggtgcttatccaagatggcggtgtgtgtccaagatgttgtgtgtccaagatggtggtgcttatccaagatggcagtgtgtgtccaagatggtgtgtgtccaagatggtggtgcttatccaagatggcggtgtgtgtccaagatggtggtgcttatccaagatggcggtgtgtgtccaagatggtgtgtgtccaagatggtggtgcttatccaagatggctgtgtgtgtccaagatggtgtgtgtccaagatggtggttcttatccaagatggcggtgtgtgtccaagatggtgtgtgtccaagatggtggttcttatccaagatggcggtgtgtgtccaagatggtggtgcttttccaagatggtgttgtgtatccaagatggcggtgtgtccaagatggcggtgcttgtccaagatggtgttatgggtccaagatggcagtgtgtgtcccagatggtgtgtgtccaagatggtagtgcttatccaagatagctgtgtgtgtccaagatggtggtgcttatccaagatggcggtgtgtgtccaagatggtggtgtgtgtcaaagatggccatgcatgtccaagatggcagtgcttgtccaagatggtgtgtgtccaagatggtggtgcttctccaagatggcggtgtgtgtccaagatggtgtgtctccaagatggtggtgcttatccaagatggcggtgtgtgtccaagatggtgtgtctccaagatggtggtgcttatccaagatggccgtgtgtgtccaagatggtgtgtgtccaagatggtggtgcttctcccagatggcggtgtgtgtccaagatggtggtgcttctccaacatggccgtgtgtgtccaagatggtgtgtgtccaagatggtggtgcttatccaagatggcagtgtgtgtccaagatggtggtgcttctccaagatggccatgtgtgtccaagatgttgtgtgtccaagatggtggtgcttatccaagatggcggtgtgtgtccaagatggtgtaatgggtccaagatggcagtgtgtgtcgaagatggcaatgctcctgctctgtgaatccagaccctctagttataacaggacgaggggtggtgtgttctttctggccacttcctgctgagggaggtggttattacgggtcaccaaacacagccctggaggggaagaggttgatttgttcctggtagcactctttaggggccttccaagcagcacccgttgaaacatctagcttttagttcacagggctttaagaaagcagaacttgggtttcagaggttttcagttaggaaaaattggagaaaaagaaaaaggaaaagaatgcaaaacattatcttggagacatgtagccagaaaaattagaatttaattcaaaccgtagaaaagaataaaaactgaaaaccattaggcaagactagaatttcacgacaggggtaactatagtttttcaaacacgatttttctttttccagttttcccacttttattaaaagacaaattatgggctgggcatggtggctcatgcctgtaatcccagcagtttgggaggccgaggttggcggatcacgaggtcaggagatcgagaccatcctggctaacatggtgaaaccccgtctctactaaaattacaaaaaattagccgggcgtggtggcgggcgcctgcagtcccagctacttgggaggctgaggcaggagaatcgcttgaacctgggaggcagaggttgcagtgaaccgagatggcaccactgcactccagcctgggcgacagagcaagactccgtctcaaaaaaaaaaaaaaaaatgtcatgagatgtagggaccagccccacagggtcagtggatctctccctgtgtgcggaggcatgagagtgtagaaataaagacacaagacaaagagataaaagaaaaggcagctgggcccgggggaccactaccaccaagacgcggagactggtggtggtcccgaatgccaggctgcgctgatatttattggatacaagacaaaggagcagggtaaggagtgtgagccatctccaatgataggtaaggtcacgtgagtcacgtgtccactggacagggggcccttccctgcctggccgccgaggcagagagagagaggagaaggagagaaacagcttacgccattatttctgcttatcagacacttttagtactttcactaatttgctcctgctaactaaaggcagagccaggtgtacaggatggaacatgaaggcggactaggagcgtgtgaccactgaagcaaagcaccacagggagagggttaggcctccggataactgcgggcgggtctgactgatgtcaggtcctccacaggaggtggaggagcagagtcttctctaaacccccccagggaaagggagactccctttggtgaccccgtctgggcataacagaaggctcgcgctcgtcttctggtcgcacctcaccatgtcccctcagctcctatctctgtatggcctggcttttcctacattatgattctagagcaaggattattataagattggtataaagagtaattactaccaactaatgattaatgatattcatatataaccatatctaagatctatatctggtataactttctcgttttatattttatcatataccggaagagctcgtgtcctcggtctcttgcctcagcacctgggtgtcttgccgcccacaatgagaggtgcaacttgacatagggagggtagaagatagcctgagtatagggaacctcttgccatttcctggtgataaagttgtcaaggtccctgagaatttgcaagttaaaggtgctatgttcgggccatctgctgtcattatgtagtttgtattgatgccagactattgcaataaaaaattcaacactctggctttaggttcctctgtaagccaagtttggccaggttggaaaggagacatcccagagaggaggacataggaatgtcgggttgtttggcacccacgtgggctggtaaaaggaagccgagagtgtctgtttgtgttttaggcaaccccagacaaaagacagagacccagaatcctctttataaggaggacggccaagctgagaagatactgggcatccctcaagatcgcttctagcttagtgccgctggtcctccgaggactgggatggccgacctgacttttcctgggtaccaaaagtcagaggagggcagatcttaccagacggctggatttgtgtctgatgttggatgttcctgttggaattggcaaaggggctcccaaactggagccgcgcagggaagacagagagagagagagaagagggaagaagacggacgaagagagaggaagacgaagcaagggttagggagcgaaatacctgttgcagggggtcagaggtggatttctgagacctgagggttttgagaaccctccagcttgagcctctaagtcccctttacatgagttgtcttcctcacacaaattgcttggaaggtgaatggagagaaaagatgggaggggtggccagagaccctcacgatccaggagttagcccaggatgagctgctgctgcccacagcttcctgggttgcaagagaacctccactcccaacactcaaagagggagagagagaaaggacagggtcagagggccagaggctctaaaggatccaggagttagcccgggacaggctgcccctgcccactgcatcctgggttgcaaaagggcctctgtccgtaacacctgtcctgggtttcggcaccaaatgtaagagtttaagaaggaggaaacaaatatagaaagtgagcctgggcgcagaggctcacatctgtaatcccagcactttgggaggccgaggcgggcggatcacctgaggtcaggagttcgacaccagcctgaccaacatggtgaaaccccatctctattaaaaatacaaaaattagccgggtgtggtggcgcccacctgcaatcccagctactcgggagactgaggcaggagaatcgcttgatcctgggagatggagcttgcagtgagccgagatggcatcactgcccctccagcctgggcgacacagcgagactccgtttcaaaaaaaaaaaaaaaaatacaaaaagtggctcagcaaagggttttggaaaagggggcttctcgcaggctcggaatgtttctgtgtgagggaaaattgattgcggggttggactgtctctggtcggaggggaggtttctggtcacagaggggtttatcccacggctggaatgtttctggtcatgctgacattagccattaggctgatgtttgggggctggatttaggcagtttttaatcaagggaacttaaaatggaagtgtgtgtccaacatggcagtgtctgtccaagacgggggtgtctgtccaagatggcggtgtgtgtccatgatgggggtgtctgtccacgacggcggtgtctgtccacgatggtggtgtgtgtcctcgatggccaaaatggcggtgtgtgtccacgatggtgtctgtccacgatgggggtgtgtgtccacgatggccaagatggcagtgtgtgtccacgatgatgtctgtccacgatgggggtgtgtgtccacgatggccaagatggcagtgtgtgtccacgatggcggtgtgtgtccatgatggcggtgtgtgtccatgatggcggtgtctgtccacgatggcggtgtctgtccacgatggcggtgtctgtccaagatggcggtgtgtgtccatgatggcggtgtgtgtccaagatggaggtgtctgtccaagatggcggtgtgtgtccacaatgacactgtgtccatgatggccaagatggcggcatgtgtccacgatggtggtgtgtgtccaagatggcggtgtctgtccaagatggcggtgtgtgtccaagatggcggcgtgtgtccaagatggcggcgtgtgtccatgatggtggtgtgtgtccaagatggcggtgtctgtccaagatggcggtgtgtgtccaagatggcggtgtgtgtccaagatggcggtgtgtgtccatgatggcggtgtgtgtccaagacggcggcgtgtgtccacgacggcggtgtgtgtgcacgacgacggtgtgtgtcccagatggcagtgtgtgtccacgatggcggtgtgtgtccacgatggcggtgtgtgtccaagatggcggcgtgtgtccacgacggcggtgtgtgtccacgacgacggtgtgtgtcccagatggcagtgtgtgtccacgacgacggtgtgtgtccacgatggtggtatgcgtccaagatggtggtgtctctccaagatggcggtgtgtgtccaagatggcgatgcttttgctctgtcagaggggagatggtcagaggggagatgcggagttccctgcaccctggcagggtgtggcagccaggggctcccccactggaggcatttaccaccatcattcctgaccccacggtctctgcaggggtcactacctctaggccaggcctccccaggggcggtgttgtctcttcctgggtaccagggattgacgtagagccatcattgtctcccttcccacagccatcattgctggcgtttttcctgaatttcctgtgggcaggttgggttttgtactctgccccaaccttcaggtctctgggaatcctcggacactgttggctcgtgggttcaaggcccgagtcaatacctccctgctggcctctttgttcctggcttcttcctttgccaatctcttccctcgagagccaagaaggcccctggtcagtccctgaaggcccctggtcagtccgcggcccactaaccacacttagggaaagccctggtcagtccccggctccccagccacacttagggaaagcttggcggatggatgagctcacctgggacagggtcggggagtgtagcaaacgctatgtgcgtcctgcaaatcttgcatgtcccattcacttttcatagggtctttcattgacccttctgaccccttttctactgttgcagggtctcaggtttgaggtggtcccctccaagtttaaagagaagctggacaaagcctccttcgctactccgtatgggtacgccatggagaccgccaagcagaaggccctggaggtggccaaccggctgtaccaggcaaggggcccctgcccttcggcccttatgaaaattcctttgctgtgatgaggggatttgcgggtggtaaatatacatgacacaaataaacgtcattcaaaagatgcagttggtggcacagcttagctattgctatgttataatgtaatgcactattgcagtaacctaataataccattaatgatacagaattaatggagcttatctgttactgtgtgttataatattctcttgcaattgatacagtatcattgatgatatacaattaatgtagcttatctgttactatgtgttataataatttctcgcaattgatacagtatcatttatgatatacaattaatgtagcttatctattactatgtgttataatatcctcttgcaattgatatcatagtatcattgatgatacagaattaatgtagcttatctattactatgtgttataatattgtcacaattgatatcacagtatcatttatgatatagaattaatgtagattatctgttactatgtgttataatattctcttgcaattgatttcatagtatcatttatgatatagaattaatgtagcttatctattactatgtattataatctcttgtggccggtcgcggtggctcatacctataatcctagcactttgggaggccaaggcggacagatcacctgaggtcaggaattcgagaccagcctgaccaacagggtgaaaccccgtctctactaaacatacaaaaattagctgggcgtggtggcgggtgcctgtaatcccagctactcaggaggctgaggcaggagaattgcgtgaacctgggagacggaagttgcagtgagccgagatcatcccactgcactccaacttaggcaacagagcaagacttcgtctccaaaaaataaaaaattaaaacaaaaattatcttgcaatcaatataatagtctcgttgatgatatacaattaatgtagcttatctattactatgtgttataatattctcttgcaattaatataatagtatcatttatgatatagaattatgtagcttattaccatgccactaagtaatatcggattttaattaaaataatatcatttataatatagaattatgcagtttatctgttgctgtatgctacaatgcaatatacaattataattaatatactactatcatttaagatttaagattcatgtagcttgttactatgtttgaatataatattgcaattaatatagtaatatcagttacgatatagaattaacatccattactatgtgttgtgatacatagaattaatatgttactgtgtgatactatgtaatatactatgacaattaatataattgtatcataatgtagaattatgtcatttatctgttactatatgctcctatgtaatacatattattttagtagagatggggcttcaccatgttggccaggctggtctccaactcctgacctcaggtgatccacccgcctcggcctcccggagtgttgggattacaggcgtgagccaccgcaccccaccgtaatacactattataattaatacactactgtcatttaggatgtacaattaatgtagcttatcaattactatatgttatatatgactctaacataatgtcagtcacagtatataaaattaacatagctattactgtgtgttttaacttgctgttacaatgaatataatgctatcatttaggatatagagttaatgtagcttccctgctgctgtgtgttaccacacaatataccattactgttaatataagaaatacattcggggccgggtgcagtggctcacacctgtcatcccagcactttgggaggccgaggcgggcggatcacgaggtcaggagttcaagaccatcctggctcacacggtgaaaccccgtctgtactaaaaacacacacaaaatattggctgggcgcggtggcgggcgcctgtagtcccagctactcgggaggctgaggcgggagaatggcgtgaacccgggaggcggagcttgcagtgagccgaggtcgcgccactgccctccagcctgggcgacagagcgagactccatctcaaaaaaaaaaaaaaagaaagaaagaaatacattagaggtaaggctgttgtgagtcgtgctatcaagacaggagtattgattgtgggttttggcagtgcacagcttagggaggccagtgcggggctgagctaaggtcaaagctgcacacagatgtcctgtgactgcctgttgctctgaggctgaattttcaacctggatttgttttatcgtcctaagtacctttttctttttctttcttttccttgtttttttttttctttttttttttggagactgagtctcactctgtcacccaggctggagtgcaggtgcgcaaccttggctcactgcaacctccgcctcctaggttcaagcgattctgctgcctcagcctcctgagtagctgagattacaggtgcccgactgatattttgtatttttagtagagacggggtttcaccatgttggccaggctggtctcgaactcctgacctcaggagatgcgcccgcctcggcctcccagagtgctgggatgacaggcgtgagccaccgcgcccagccctaagtagctttttctgaaattacattgaacggatcaaaaaccttttggccttaattctgggtaactcagggaggtttggggcccctgaatcaaaccttacctgccgcccggaagaacaaaagcttacggaacaggcattgcgtttcccgtagtgcccgtgagatgctccgtgagtgcctgacccctgatcacgcagcccccgtgggccccggcctcacccacgttccagcccctgcagggcgaccaccggcgggacccacttgtgtccttgctcgtgaccttgagcacccccagccttcacttccaaagtcggcctggcttcgcccctgcggtgctctttcacgcccgtaccgacgggaaaacttctctgtgagacccacggcacgtcaccggtaaaccggaatctggttttcttacagaaagacctgcgggcccccgacgtggtcattggagcggacacgatcgtggtgagtgcggccagggtgcctcgtttctaatgtccgatgtggttttcctgtgcttggtgattctgcctcttgtggatgttgtacattccccttaagacagcagtggactcgcttccagaaactcccatcacaaactaccagcagatgaggggcctaagggcacgggaaggggccaggcgccgtggctcacccctgtcatcccagcattttgggaggccgaggtgggcggatcaccttaggtcatgggttcgagatcagcccgaccaacacggtaaaaccccatctctactaaaaatacaaaaattagccagacgtggtggctaattgatagtatcataagtgatactatatgatatcaattgcaagagaatattataacacatagtaacagataagctacattaattctatatcatcaatgatacagaatacagactccgcctgtaatcgcagctactcgggaggctgaggcaggggaatcgctcgaacccaggaggcggggttgcagtgagccgagatcgcgccactgcactccagcctgggtgacaagagcgagactccgtctcaaaaggcacaggaaggtacgcagttctagaggccagcaaccacaaatcacggtgtctgtagggtttcttccttccagaggtactgaggagaagttggtcttggtctttctccagctcctagaggctgttggcaacccattgtctcctttggctcatggccctgtggttcctatctgtgcctccatctccatgtggccttctcccctctgggtgtctgtggccaaatttccctcttcttttttttttttgagagagagtctcactgtgttgcccaggctggattacagtggcgtgatctcggctcaccgggacctccgcctcccgggttcaagcgattctcctgcctcctgagtagctgggatcacaggcacccgccaccacgcccggctgatttttgtatttttagtagagacggggtttcaccatgttggccaggctggtctcaaactcccgacctcaagtgatctgcccaccttagcctcccacagtgctgggatgacaggcgtgagccaccgcgcccggctgaaattttccccttcttttaacaacaccactcataaaatgcgcatcctaattctgtccaaccgcatcttaattacctaggcaaagacccatttctccttttttttttttttgagatggagtctcactctgtcgccaggctggactgtagtggcatgatctcagctcattgcaacctccgcctcccgggtttcaatgattctcctgcctcagcctcccgagtagcggggactacaggtgcgcgcgaccacgtgtggctaattttttgtatttttagtagagacggggtttcaccatgttggccaggatggtctcgatctcctgaccttgtgatccacccgcctcggcatcccaaagtgctaggattacaggcgtgagccaccacgcccggcccatgtcttttgttcataagccacccagtctatggtattctgtgatagcagcctgaaatggactaagacatctcataagaagaggagatgaggacacagacacacacagagggacgaccctgtgaggacacagggggaagacggcgtctccaagcccaggagagaggcctcaggaggaaccagccctgcccacacctggatctcagacttccagactccaggattatggaagaatcaatgtctgctgtttataagccacccagtctatagtattgttttagcagcctgaaatggactaagacacctcataagaagagcagataaggacacagacacacacagagggatgaccctgtgaggacacagggagaagacggcgtctacaagcctaggagagaggcctcaggaggaaccagccctgcccacacctggatctcagacctccagcctccagggctgtgggagaatcactgcctgttgtttataagccacccagtctgtggtattctgtgacagcagcctgagatggactaaagcatctcataagaagaggagatgaggacacagatacagagggacgagtctgtgaggacacagggagaagatggcatctccaagcccaggagagaggcttcaggaggaaccagccctgcccacacctggatctcgcccttccagtctccacgacgatgggagaatcaatgtctgtagtttaagccacctgggttgtaggactttgctatggtggcccagtcagactaatacatctactcttgtatgtacccaaaaggattcaaaacaggtgttccaccaaaaccttctacatgaatgttcacagcagcactattcacaacagctaaaaggcagaaacagctcaagtgtctgtcagtgggtaaatgggaaattacaacatggtccatccacacacagtggaatattatgcagccatgaacaggaatgaggctggccgggtgcggtggctcacccctgtcatcccagcactttgggaggccgaggcgggtggatcacaaggtcaggagatcgagaccatcctggccaacatggtgaaaccccgtctctactaaaaatacaaaaaattagccgggtgtggtggcgggcgcctgtagtcccagctactcgggaggctgaggcaggagaatggcgtgaacccgggaggcggagcttgcagtgagccgagatcgcgccactgcactccagcctgggtgatagagcgagactctgtctcaaaaaataaataaataaaaaataacaaaaattagccaggcatggtggtgtgcacctgtattcccagcaactcgggaggctgaggcaggagaatcacttgaaccccggaggcggaggttgcagtgagccaagaccgtgccactgcactccagcctgggcgacagagtgagactccatctcaagaaaaggaaaggaacgaggctgtgaaacaggctgcaacatggatgaatgttgaggacatcacggtcagtgacagaaaccagccccggaggaccacacgttgcaggattccatgactacaccacgtccgcaacaggcaaacgcacggtgaaagaaagaggatgggcggttaccaggatctggggaggcgcactggggagggacagctgcgtggggacagggtctccttctggagtgaagagaacatcctggaaccaggcaggtagtggtggtacaacatggcaactctggttagttgtttgaaatggcgactctcaggacgtgtcagcttcatttccataaaacaagtgacttctgcgaatgggaccgtgggacttgcacaggcctgacccagccggtgggaaccaactccctctgtcccttcctctcacagacagtcggggggctgattctggagaagccggtggacaagcaggacgcctacaggatgctgtcccggtaagcaccatgttggcctctgagccctctcgggttctgagccacagagtagctgtggtatctggccgggtgtcctggggagcagggtggatctctgtcagctctgccgtctgagctgtgctgtctgagctgtgctgtctgagctatgcagggaggcaggcactatccctccatgctcatccttgtctaggattctgcagcactgatcccagaatgtctcatgcccactgcagactgttggggtcatgagaagttggcagtgtcctgtccttcccactgggcatcctggacctgagcccgtagcctgggacgtcatccccatcccaggacgtggaagagatgcaccccctgcccgccataggcccagctgagagctgcctggcctggcgcctcccgtcagggccactgctggtgggatttgtgaccccttccctcggcctctccgtaaaggtttccctggagaccccacagcgggacgatcggggagaagatgctggggacggatccaggattaaggacgcctcgctgcctcccctggttttgagaaactcgctttgtagctcccacgggtcacagcatggtcacgtggtcacccgttgttgtcttacaggttgagtgggagagaacacagcgtgttcacaggtgtcgcgatcgtccactgctccagcaaaggtaaccgcggcccaggtttcggggtagccccagaggccgagacaaggacccgggacattctcgggacccttggcttgagggaggaggacggttgctcacccccacctgtggaggggtttgtgcctatgtcctgcttgggaaagttgtccgccgatttggaagtctgcaggacaaaggaaaacgtgtggttttatctttttctttttctttcttttttttttttttttgagatggagtctcgctctcttacccaggctggagggcagtggcacgatctcagctcactgcaacctccgcctcccaagttcaagtgatccttctgcctcagtagctgggattacaggtgcccaccaccatgcccggctaatttttgtatttttagtagagacggggtttcaccatgttggccaggctggtctcgaactcctgacctcaggtgatccacccgcctcagcctcccaaagtgctgggattacaggtgtgagctactgcacccggcctttctctttctttctttcttttttttttttttgagacagggtctccctctgtcacccaggctggagtgcagtggtgtgatcatagctcactgcagcctcgacctcctgagctccagcgatcctcccgcctcagcccctacagtcacagaaactacaggcacacgccaccacacctggctcatttttgtattttttatagaggtgcggtcttgctatgttgcccagactggtctcgaactcctgggctgaagaaatcctcccatctcagcctcccaaagtgctgggactgcaggtgttcaccatattgctgggactgcaggtgtgcaccacggtgcccggcccaggcagttgtatcaccatattgctgggttcttcctgcaccaacccattcccagcttgttggcggacaccaggaggcatcgtagaattcagtcagttctgacagtagccgtcggagttagcgcagatcccacaggtgaagggccgggtcccatgggacctccacgcacaatcccagccccatatccctggtcacacctgtagttttctcacccacctgccgctcactgctggctcctgcaagcacctgctcaggttgggtcatttgctcgaggggctcacagaactcgggacagcactttccttcccagcttggggttttgttatgaaggagcaggtcaggaagtgccagacagaagccaggcacagcgcagggtgctgggtgcaggatgtatggagcctccatgcccgccgtggcacagctctgccaacaccctgatgtgttcacccaccagaagctccctgaaccctgtccttctgggtctcttttttttttcttttttgtgacagagtctcgctttatcgcccaggctagagtgcacttgcgccatctcggctcactgcaagctccgcctcccgggttcacgcccttctcctgcctcagcctcccgagtagctgggacgacgggcccgccaccacgcccggctaattttttctattttttttttttttttttttttagtagagacggggtttcaccgtggtagccaggagggtctcgatctcctgaccttgtgatccgcccgcctcggcctcccaaagtgctgggatgacaggcgtgagccaccgcgcgcggtcccttctgggtctcttaaaaggccaggattaacgacatcatccgccactggggagcaaactccatctccagccccctccccctgttcccatgacaaccaaagcctgccctttccaaaaggcccctcattaacataaggtcccctgcggatgaaaggggcttgtcaccacatagcaaaacgcctgctttcgctcctgtcactcaacagattccccgggattcaggggctctgtgtccggaccctgaggcacagaccaaacatctgtttcttttattatttatttatttgagacagagtctcgctctgtcgcccaggctgcagtacagtggcgtgatcttggctcactgcaacctccgcctcccgggttcaagcgattctcctgcctcagcctcccgagtagctgggatgacaggtgcatgccaccacgcccggctaatttttgtatttttagtagagacggggtttcgccatgttggccaggctggtctcgaacccctggcctctggtgatccatccgcctcggccgcccaaactgctgtttcttttgttttttttagagacggagtctcgctctgtggcccaggctggaatgcaggggcgcgatctcggctcactgcaacctgcacctcccgggttcaagcgattctcctgcctcagcctcccgagtagctgggactacaggcacctactaccaggcctggctaattttttgtatttttagtagagacggggtttcaccgtgttagccaggatggtctcgaactcctgacctcgtgatccacccgcctcggcctcccaaggtgctgggatgacaggcgtgagccaccgcgcccggcccctttctcccttttcttgtccgaaatgaaccttattctcccatgaagcatccatatctgaactgtgcgctgcgctcgagtacacacctccacagcacagccacgcagctgtcagggcacggaggtgacaagctggcgtccacgctcacccccacggctgtgtccttgcagaccatcagctggacaccagggtctcggaattctacgaggaaacgaaggtgaagttctcggagctgtccgaggagctgctctgggaatacgtccacagcggggagcccatgtgagtctcgggggcggtggggggacgggggacacgtgtggaagcctggccaccctcacacgtggggtgtcccacccagcctttgggaaagaaggaggccccgctccgggggccgtgtggcacagggagagccgcccggctcagaagcacaaacccttcacgaccacactgacccatggaggctcaaagaggcaaactcccaggacagagaggggcagggtgggagccaacgctgggctgcggtggggactggggaggcgctgggcaggggtagaggagttcacgtggtgggaggaggagaccccagaggtctgtgcccaggacgctggctgcaattaacacgaataaactctgtgatccaaagtcaccctaagaggtgattctacctgtcgtcccgtccacagattggtgagcacgggaagtatgcgtgcaccaatcagcttcacttcatcacccaccatttgcgtttatatgtattatatttatctacatcatatgtcatataatgtctacataattatacattatataatgtaacatgatatatatttacaattatatataatttatgtattccacattatatattctattaattatatataatctacattatacaaattatataatatatatttataatatattgtattatatactataatagattatactgtaatatgtatactatattacatatagatattataatatagattatatattaacacttttgattgaaatttaatgatttttaatgattaattttaataagtagtgattaatattaatgtaatatataccatctattataatatatactgttataatagattatatgataggttatataactgttaaaatagattatataataggtagttataatcgattataattatatataaattatataatttatatttataattatttataattatatataaaatatataattttatatattttatatatttaattttatttatatataaatatataattacatatatttataattatatataaatataatttataattatatataattaattataaatgatatataattatatataattataaacaattatataaatataaattatatataattatatatataattataaaatgattatatattataaaatataattatatatttatataatatagaaatatatgaatatatggataatatgtaatatgtattaaatatgattaatatatgtaactgcatattaatacatattacataataatataaagtgtgattatatgtaaattatatattaattaaatatatgtaatacatattagttatatataatatataatgtattatgtgttatataaatatataattatataaaatatatttttatattataaaagtatataaatatataaatatatgtatataaatacatttgtataaaatatatgtttattttatatatttatataaataattttatttatttttttgagacacggtctcactctgtcacccaggctggagtgcagtggtacagtcatagctcactgcagcgtcagcctcttgagtcaaaatgatcctctcacctcagccccactagtggctgggtctgcagacgcataccaccacgcctggctaattttttctattttttgtagcaatggggtctcactatgttgcccaggctggtcttgaactcctgggctcaggcgatccttccaccaaagcctcctgagtaggtgggaccacaggacacgcaccaacacacgcggccgattttattgttagtttttgtagagatggagtctgcgtaatatatatgtatattaacctagaggattttacatcaattgaaataagcccggcagaagaagacacataccacaggatctcacttatatggaatataaaacagttgcacttggtcaaaggatacaagatttaaatcagggccaggcatggtggctcacgcctgtcatcccaatactttgggaggccgaggcaggcggatcacctgaggtcagaagttcaagaccagcctggatatggcaaatcccaatctctactaaaaatacaaaaattagcccggtgtggtggcaggtgcctgtaatcccagctacccaggaggctgagacaggagaatcgcttgaacccagcaggtggaggttgcagtgagccgagatcgcgccactgcactccagcctgggcaacagagcgagactccgtcttttaaaaaaaaaaaattaagtgagacgggagaagttcaaggctctttacagcctagtgactgtggtttacaggaacagtgtcttactggaaaattgccagcacactacatctgaagtcttctccccacacacacagaataggtacatgaggtgctcgatgggataattggcttgatttaatgatgtcacatgtatacatatatcaaaacatcccatttaacacatgaaattttttttgagacggagtcttcctccgtcacccaggctggagtgcagtggcgcgatcttggctcactgcaacctccaccttccagtttcaaacgattctcctgcctcagcttcccaagtagctgggactacaggcacccaccgccacgcctggcgaattttttatttttagtagagaaggggttttgccatgttggccaggctggtctcgaactcctgacctcaggtgatctgcctgcctcagcctcccgaagtgctgggagccaccgcgcccagcccaacacctgcactttcatacatactttaatgtttacatacatttaaagaaagacaggccgggcacagtagctcaagccaagacgggaggatcacttcatcccaggagttcgagaccagcctgggcaacagagtgaaaccccatctttataaaaaatgataaaactagctgagtgtgtccctgctacgtgggaggctgagattacagcatcatttgagcccagaattttgagggagcagagaaccaagaatgtaccactgcacttcagcctgagcaaccgagtgagaccctgtcttgaaaaaaaaaaatagataaaataagaaagagaaaagagggccagacgtggtggttcacacctgtaatcccagcactttggggggccgaggcaggcgcatcacctgaggtcaggagttcgagaccatcgtggccaacatggtgaaaccccgtctctactaaatacaaaaattagccgggtgtgttggcaggtgcctgtcatcccagctacccgggaggctgaggcaggagaatcgcttgaacccaggaggcggaggttgcagggagccgagatcgcgccactgcactccagcctgggcgacagagcgagactctgtctttaaaaaataaaaataaaaaataaaaaagtgagacaggaggaagaagttcaaggctctttacagcctgtgactgtggtttataggaacagtgtcttactggtaaattgccagcacactagatctgaagtcttctccccacacacacacacacaattcgtagatgagatgctgaatgggataattggcttgatttaatgatgacgcatgtatacatatgtcaaaacatcccatttaacacatgaaattttatttatttatttatttatttgagacggagtcttcctctgccgcccaggctggagtgcagtggcacgatctcggctcactgcaacctcctcctcctgggttcaagtgattctcctgtctcagcctcctgggtagctgggattacaggcgtgtgccaccacaccacacccggctaatttttgtatttttagtagagatggggtttcaccgtgttggccaggctggtcttgaacttctgacctcaagtaatccacccgtctcggcctcccaaagtgctgggattacagccgtgagccattgcgcccagccttgctgtgaaattgtttttctttttttttttttttttgagatgccaaaggcgcctgcccccacgcctggctaattttttgtattttttttagtagagacagggtttcactgtgttagccaggatggcctcgatctcccgacctcgtgatccacccacctccgcctcccagccgtgaaatgttcagacccaggaacttttctcctccttgtcacctcttaccttcccctgcccacccagggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaaggtacctgtgtctgtctcctcaggccacatttcacaaatgagcctacacactcggcttaaatcaaagggaatttacttctcactgtcctggaggctggcagtctgaggtcaggttgtctcagggccatgctttctccgaaggttctaggagagggtccttcctgcctctcccagctcctgacagctccaggcatccctgggcttgtggccgcatcactccagtctctgccacgtcctccacgtggcctcatccactgtgtctgtgtctcctcctctgtctcttagaaggacacctgtcattggacttggagtccacccttcttcgtgatgatttcctcttgagattcttaattacatctgccaagacccctttttaaaacaaggtcccattcacagattctggggatcaggatatggacagatctttcaggaggaccacagttcagtccactacagatgtatccagttccttctggaggccccaggggagggtccttcctgcctctcccagctcctgggggctccaggcatccctgggcttgtggccgtatcactccagtctctgcctttgtctccacgtggccttctcctctgtgtctgtgtctcttctgtctcttagaaggacacctgtcattggattttgaggtctccctaatccactgactccaactcatctgaagtcccctagcttacttacgtctgcaaagacccttttttctttttctcttttttttgtttttgtttttgtttttgagacagagtctggctctgtcatccaggctggagtgcagtggcatgatctcggctcactgcaacctctgcctcccgggttcaagcgattctcctgcctcagcctcctaactgtggtcctcctgaaagatctgttcatagcctgatccccagaatctgtgaatgggaccttgttttaaaaaggggtcttagcagatgtaattaagaatctcaagaggagatcctgagtagcctcaggagtagcctcctgattacaggcgcccaccaccaagcccggctaatttttgtacttttagtagagacagggtttcgctatgttggccaggatggtctcgaactcctgacctcagctgatccacccgcctcggcctcctaaagtgctgggattacaggcgtgagccagcgcgcccggcctgaggccccatctttcagctgttctgttcaggggcccctcacggtggcagcctagaagggatgcagccctcccaacaccaggggtccctcacagggcgtcctccgggaagcagaggtggggatgtcgggtgcaggagggacgcaggctttgggagacagggagacgggctgatgacacctcctgccattcatcatcaggagagagaacatgcagtgaataaggaataaaggtggttacagcacattccgtctgtgcctctaatttaccaagtggtgattattaaatcaccaccaggtggtttataaacaacagacattgattctcccacagtcctggaggctggaggtccaagatcaacgtgtgggcagggctggttcctcctgaggcctctctcctgggcttggagatgctgtcttctccctgtgtcctcacagggtcgtccctgtgtgtgtgtctgtgtcctcatctccttttcttatagggaccccagtcctattggattagggtccacccaaatgacctcattttacctgaatcacttctttaaaaccctgcctacaaatacagtcacatcctgagggactggggggattaggagttcaacatctgggttttgaactcagtccatatcggcagcatgttgatttttctcccatgggctagtttttctgcatgatattcgttgatgtgctttttccttgtgtacaccttgttttatagctggggacttgatcctataaatccccaccgttctctgtgaaagaaggctcaatggccaagttgtatacttccgacagcgttggcctccatcttttgagtctgtgggagtagaaagtactggacaagggacttaatgagtctctctgcacttgcttttaacagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggtgacaggacccagcgggttttgctctgaggatctttgcaggtggaagtcactgagggaaggtgacctggagcctgggcagagcgaggaaggaggcccacaccttctgtccctctgccctcaggaatgctgcttttcccgaaaggttgagaagcagagggtgaatgacagagagggaacagtggcagccgcgagcacataggagaagcgtgacctccttatgggctctagtctcaaaggggctgtatcagtccatgttctcctgagaaacagaacccaatacggtgtacacagacattgatttagttgcttatttatttttatagacaaataacgtagatggatgggtagacagatacatagatagatgataaatgcatagatacattgatatagattgacgatagagagatgacagatacatagatgatgggtagagttgatatataaatggatggatggatagatggatggatggatggtaggtggatagatgggaggaaggatggatggatggatggatggatggtaggtggatagatggatgggaggagggatggatggatggatggatggacagatggattgatcaatggatggatagatacatggatgggaaggtggatggattggtggatcagtggatgggtggatggatgggtgggtgggtggatggatagatggatggatggagaggtggatggataaatggaagggtgggtagatgggtgggtaagtggatggatgggtggatggatgagtgggtgagtggatagatggatggatgtgtgaatggaaggatgtgtggatggatgggtggatgactggatggataaaggtgggtagatggatggatggatcgatgaatcggtggatgagtgcatagatgggtgggtaagtggatggatgggtggatggataagtgggtgagtggatgggtggctggatggatggatggacggacagatggatggatggatggatgtgtggatggatgggtgagtggatagatgtgtggatagatggatgagtgggcgtgtggatgggtgggcgtgtgaatggatggatgagtggatggatgggtgcacggctgggtggatgattgggagtgtgggtgaatagacggatgggtgggtggacagatggatgggagggtggatgaacagatatatcagtggatcggtggttgggtagctgggtgggggaatggatggatgaatgggtaggtgggtggttggatgggtggatggatgagtgggcatgtggatgagtgcatgaatggatggacgggtgcatggctgggtggatgatggggagggtgggtgaacagatgggtgggtgggtgggtggatggatggatggatgagtgattggatgggtgggggaatgaatggataaatggatgtggatggatggatgcatgcatgggtggatggatcagtggatccatcagtggatgggtggatggatgggtaggtgggtgggtggatggatggatggatggacagatggatggatgagtgattggatgggtgggggaatgaatggataaatggatgtggatgtatggatgcatgcatgggtgcatggatcagtggatccatcagtggatgggtgaatagatggatgggtaggtggatggatggatgagtgggcatgtggatgggtgggcgtgtgaatggatggatgagtggatggatgggtgcatggctgggtggatgattgggagggtgggtgaatagatggatgggtgggtggacggatggatgggaggatggatggatagatgtatcagtggattgctggatgggtagctgggtgggggaatggatggatgagtgggtagatgggtggatcggtggattggatgggtgggggaatgcatagatgagtgatgaatgggtggatcagcagatgggtgggtggatgactagatgggtgggtgagtggataactggatgggtgggtgagtgggtggatggatggatggatgacaatgtgttttctgaattgaacagaactcttcagcatggtgctagaatagagagcacatgaccaagtccttgagtagcctgggaagggcaggacaacagatgacacctgggcagaggtggctgtgcttctgtgattaggagacaaagcatgccctggttgaggctccaaaggctgtgcccttaccacagagacatgtgactatatccttagaggctggaacatagaagccagaacatcttccccagccagagcagttcaggaccattctcccgtattgaaaataatgatgaataggccacgcctgtaatcccagcacttggggaggccaaggcaggcagatcacgagttcaggagatcaagaccatcctggctaacacggtgaaaccccgtctctactaaaaatacaaaaaattagccgggcacggtggcgggtgcctgtagtcccagctactcgggaggctgagggaggacaatggcatgaacccaggagacggagcttgcagtgagctgagatcgtgccactgcactccagcctgggggacagagtgagactccatctcaaaaaaaattaaaaaattaaaagaaagaaaataatgatgaatatggagaaaggcttttcatcaccggcaccatgcaagcttgttccaactccttttgacaacgctttgtgcagttgagtcctaggagcagttccacgtctgcagaggctgctcctgcttcaccataggtctcatcatttattcatgatgaaaataaatgtcatctatctgactatagcaaaccgtacactcagggtcagctcggtgggaaaacagtaacatttcatcattaacatgaacacagggctgtttcttacataggaggaccggagtggtgcgaggccatctgtttccatatacgggtctccaccaacaacttctccaccttccagcctcccattctgtgggagggggcatcctggaagggagcttggggactgggtctatggacagctgacctgggcatgaagtgggtggagaatgaagttccctgtatcatttggggctctccagggtaacagaacccctaggatataacctaggagatttatcttgaggacttacgtgattgtgtaggctggcaagtccaaaatccacagggcaggccaggaggctggaagctcaggcaggagctgctgctgccatcttcaagtggaatttctcctccaggaaagcccaatgtttgcttctggggttttcaatgagctggatgaggccaatgcacattttggggggttaatctccttaaagtcaaactgatggtagatgcaaacgccagctacagcacacctccacagccacatctagatgggtgtttgcctgcataactgggaacttgagcgtggccacgatcatgaagaaaggatcagcctcagtgggtaacagttacagcagttgacagctggggcgtggtggctgctgttttcctgcccagctgaccctgagtgtacagtttgctatagtcagatggatgatgtttattttaacatctcaatgatgcatcccctatggtcaggtttccttgagtgtacggtttgctatagtcagatgggtgatgtttattttaacatctcaatgatacatcccctacggtcaggtttccttgggttttctcgttaggaggtcacacgactgtccccatttctccaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggtagcataacacccccgcggacacctttccgtctagcgtgcattttgctaaaacactttgacacacagatcagtaggcaccttgaccagtctgtctccagtctgacagatcccaaaggcttggctcgttctgcctggagaacttagtgccgtggctcttgtgtcactcagccctggaacaggtgcaacttagacatcctccactgttatccagcagctgatgaaaatagaatttcctcctagaaacaggtttgaaggccatgctcaggggctcacacctgtcactcccagcactttgggaggccaagttgggaggatgatttgagcccgggagtttgagaccagcctgggcaacatagtgagacccccatctctacaaaaaattaacagttaggctgggcatggtggcatgagcctgtaatcccagctagtttgggaggccaaggtgggctgatcacctgaggtcaggagtgcgagaccaacctggccaacgtgctgaaaccccatctctactaaaaatacaaaaaaaaaattagctggggatgatggcgcgtgcctgtagtcccagctactcaagaggctgaggcaggagaatcacttgaacccgggatgtggtggttgcagtgagctgagatcacgccactgccctccagcctgggtgacagagcgaaactccatctcaaaaaaaaaaaaaaaaattaacgattagccaggtatgattaggcagctactttgggaggcccaggtgggtgggaagatcacttgaacctgggaggtcaaggctgcagtgtaagccgtgatggtgctgctgcactccagcccgggtgacagaacaagactctgtctgaaaaatagaaataggaaggagttggacaggctgccttaaatgaatgccctgtttcttctttgcttcaatggaactgacacttgcttatctgaggccgctgtttgcaaagcgctccctgcatcctctcgcccctccttcccctttccccgcccagaaccttcctgaggtggacgtgtgagatatggtggggtccgtggggcctgtgcagatgggtgggtctcggtctgcagggctgtgccagccaggcgtggggagtctgctgtgggctcggctggccgtggcctcatgcctccttggcagcgctggccgagcttctgtggcagtgagcacggagtcagggtgtgtgtgtgtgatgcagagatgagccccagggagccgggggcttcctgcagatgttggggagagacatacagacagggagacacagagagagagataggcagacagaaagatagagggagacagagacagacagagatggaggcagacagagacagggagatagagggagacagaaacagggagacagaaagacagagacagagatagagtgagacagacacggagatgggagacagatagtgagatagggagagagatggagagacagggagacttgagagacagagggaggcggagacagagatagggagacagaaacaaagatggagacagacagacacatagagggagatgggagacagagacagggaggcttggagagacagagatagaggcagatagagacagaaacaggagacagacatagagacagagacagagggagatagaaagaaacagagacaggagacagaaacagagagagagaaagaggaagacagagacacacagacggagacagagacagacagacagagaccaagggagaaagagtcagagagagaagccagtggtggagaagccgagaggcacggacaggggccctgagctggcgtgagcagccagcgtgggcatcgcagaggacagatccctgagccccatgattgccacccacgcaggggagggccggggagcccccgcgagatttagggagccaggatggagaccggctgtcctgctgggagcggggctcagaagcatcctcagctgggcttgcttgccctgcagggacgggatgtccaggcgaaccctggacacagcactgagccaggatgagcctgggctcctctgggacccggggtaggtgccactggggggacttggagaagctcggaggagcttctcctctgcacaccagaattctcggaggagccccctctgcacaccgcaccattgtggtgaaggctgagccggggcacctgcagagacattgtggcttctctcctggttttctccagtgaggtgtttgtgggccacccggagcctccagggtgaaaagctttattgtgaaaagcctactgcgaaagtcagacgcttggagttcaggctgtggtgtggaccaagtgattccaaggagatcgtccaccactttggggtcctctgtccccagccagcccagcccccacacagacaagagtagcccacacagctgtggcatgaagcccgctctgcagcccaggcgcggctgagcccccacgctctggagccctgcacttctccccccgacccccagggagaggctgggcgagccctcgccccgtgttctctggtgcccctaagcacctgctgtgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggtgggtggcccccccgccagggctctccttactttcgtttattaagccacaggtatcttccctgctcaggacacctaccaactgcctttttccattgacaaacctgataacgacctgaaccgggccaggctgagtcccagatcatgggtggatattcccaagttccaggaggaccccggggatgcctaaatgcccccctagaaactccggggccctctcttttggctgcggagctgaggcagagcaccttggaacccctggattcccctcagcaagtctgattatatcctgactcaccctccaccccaccccagccctggacagtgggtggagcagtagacacattcccaagggctgctgggggatcggggcctgggacgattctcacaccatcagcttacatttccccaacctctgaatgcctctcctccttgtggtccagagtggctgctgtagcaccagccatcgtgtctgcatccccatggcaggaaggagaagggaggagtacagcccccacccctgggcagaaaggatttccctgtaggtctgtgccccctacacgtggcccagagtggctgctgtagcaccggccattgtgtctacatccccacggcaggaaggagaagggagtacagccctccacccctgggctggaaggatttccctgcaggtctgtgcccccacactcacctgcttgtacagtcttgtctgggataccagcgagctccccaccactggctttcccttccagcatgggaatcaatgccatgcccttgaacattacttctgccccagttgagctttggagagtcgtcagagttccatagacgacccagccacagagcatgcatttgcttccccgcaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgagccctcctcctgttcaccctgctaaccttttccagactgcagcatctctttctagacagagggcatggctgtgtgtgcacctgtgtttctgcctgggcgtttccatggtgggtatgtgtgtgcaaatgggactgtctacggtgcttgtgtgtgtgtgtctctctgtgtgcatgtgtgtggtatgccctggagcatacctgtgacatggagcatgtctgtgcgtgagcatgtctgtgtgtgtgtgtgtctgcatccgcatgtgtgtgcacgtctctggtgtgtggttgcatatgtttctgtgagagtatgtgtgtgtgtctgtgtgggtatatgtgtgcatgtctgtgtgtgtgtgtctgcatctgtgtgcatgctgtgagccggtgggtgtctgtgtgcatatgactgtcgtgcttgtgtgtctgtgtgcatgtgtgtgtgtgtgcatgtctgtgtctgtatctgtgtgcatggtgtgtgtcttccgtgcatatgtaactgtgtgtgcacgtctgtgtagtatgtccttgtgtgtgtgtctgtgcatgagactgtgtgtccacgtgtctgcaagtctctgtggtgtgtggttgcatatgtttctgtgaggtgatgtgtgtgcatccgtgtggatatatgtgtgcatgtctgtgtatgtgcgtctgtgtgcccgtctgtgtctgcatttgtgtgtatgctgtgtgctggtaggtgtgtgtgtgtatgtgactgctgtggttgtgtgtccctgtgtgcatgtgtctgtgtgtacgtctgcatctgtgtgcatgctgtgggccggtggttgtgtgcatatgtgactgctgtggttgtgtgtctgtgtgcatgtgtctgggtgtgcttgtctgtgtgtctgcatctatgtgcatggtgtgtgtctgtgtggatatgtgagcatctgctgtgcttgtgtctgtgtctctgtgtgtttctgagtctgtgtgtgcacatctctgtgtggtatgtccttgcatgcgtgtctgtacgtcagaatgtctctgtgtctgagtccgtgtgtgtgtgtgcacctctgtggtgtgtatgtctctgagggtatgtgtgtctgcgtgtctgtggatatatgtgtacatgtctgtgtgtgcatgtctgtgtgcccatctgtatctgtgtgcatggtgtgtgtgcatgtcactgctgtgcttgtgtgtacgtctgtgtgtgcatgtgtctgtgtgtgcatgactgactgtgtgtggtatgtccttgtgtgtgcgtgcgtaagaatgtgtctctgtgtctgcatctgcgtttgtgtgtgtgcaactctctgtggtgtgtgcttgcatatgtgtgagggtatgtgtgtttctgtgcgtctgtgtgggtatatgtgtgtatgtctgtgtgtctgcgtctgtgtgcctgttggggtatctctgtgtgtccgtgcgtgtgcccatctgtgcatgtctgcatccgtgtgtgtgtgcctgtcgctgtatctgtatgtccatgtgtgtctgcgtgtccatctgtgcatgtctatgtttatgtgcgtgtgcctgtctgttggtgtatctgtatgtccgtgtgtgtgtgtgcccatctgtgcatgtctgcgtctgtgtgtgcctgtcactgtatctgtatgtccgtgtgtgtgtgtgtccagctgtgcatgtctgcgtctgtgtgcgtgcctgtctgttggtgtatctgtgtgtccgtgcgtgtctgtctgtgcccatctgtgcatgtctgcgtctgtgtgtgcctgttgctgtgcatgtctgcgtctgtgtgtgcctgtcgctatatctgtatgtccatgtgtgtgtgcccatctgtgcatgtctgcgtctgtgtgtgcctgttggtgtatcactgtgtgtccgtgcgtgagtgtgcccatctgtgcatgtctgtctctgtgcgcgtgtgcctgtcactgtatctgtgtccgtgtgtgtgtgtgtgcctgtcttgctgtatctgtgtgtccatgtgtgtacctgtcagtgtatctgtgtcctgcatgtgtccgtgtgtgcatgtcttgtggcgtgtgcttgcatgtgtgcctttgtgtctgcatttctgtgcatctggatgggtatatgtgtgtgtgcctgtgtctgtgtctgtgcgtccgtgggtctgcctgtgcgtgtctctctgcgggtccacacagacacgagggcatctccaaacaggtggacaaggctgggcacagtagctcacgcctgtaatcccagcactctgggaggctgaggcgggcggatcccctgtggtcaggagttcgagaccagcctggccaacatggcgaaaccccatctctactaaaaatacaaaaattagccgggcgtggtggcgggcgcctgtaatcccagctactcaggaggctgaggcaggaaaatcgcttgaacctgggaggcggaggttgcagtgagctgagatctcaccactgcactccagcctgggcaacaagagcgaaactccatctcaaaaaaaaaaagacaatgataataataatgataaataaaaataaacaggtggacgactgtgtgaagttatcatcagtgcaagtagccgagacgtgaggggagtggagatggggaacagccgagatcagcattcatgggcatccacggtgccgaggtcacggaaggaactgacccgagagccgtcacagtgtggccttaggttagacttgaaggagaacttccaggtggcagctgctgaggccaggacggattgacaggagacgcctggaatcccagccctctgggaggctgaggcgggtggatcacctgaggtcaggagtttgagaccagccagagcaacatggtgaaaccccatctctactaaaattacagaaattagccaggcatggtggcgggtgcctataatcccacctattcaggaggctgaggcaggagaatcgcttgaacccgggaggcggagcttgccgtgagccgagatcgcgccactgcactccagcctgggcaacacagcaaaactccatctcaaaaaaaataaaaaaataaaaaaagagacagctgacgtgctgtaactcagcaccatccgacagcggccaggcctgtgggcacaggtgctggggacctccacaaccctcccccagaggttcctggatgcttttctcgtttttaaaaaaacaaaacgcaaccaccctacagctcctcctgcaggacatcatgatagctgtgcttctgatttgccagatctgcagagacagaaatgctgaaatttatttatgtttgaatggtgtctcgctctgtcacccaggctggagtgcagtggcgtgatcttagctcactgcaacctccacttcctgggttcaagggatcctcccacctcagcctcccgagtagctggggtgacaagtgcccgccaccacgcctggctaacttttgtatttttagtacagatggggtttcaccatgttggccaggctggtctcgaactcctcacctcaggtcatccacccgtcttggcctcccaaagtgctgggattacaccccgcccggccggaaatgctaaagtttaaaatcatgagccctgaaagagcaccttctcctcgcagctgggggaaaacagctctggagacttcccaccgcacactctcccgccccttctttcccctcatgcaactcacagcttgctatttatcctctccctgtcctgcagaccggaggtctgagatcaaggcatctcagggctgtgctccctctggaggctctaggggaggatccttcctgcctctcccagctcctgggggctccgggtgtccctgggcttgtagccgcatcactccagtctctgcctccatctccacgtggccttctcctctgtgtgtctcctcttctgtctcttagaaggacacctgccattgcatttagggcccaccctactccaggatgatcccatctccagatccttaattacatctgcaaagaaactttatccaaatgaggtcccattcccaggttctggggcttaggacttggacagatcttttggacgtcaccacccaacccattgcagttgtgtttgattctttctgagaggctctaggggaggatccttcccgcctcttccagctcctgggggctccaggcgtccctgggcttgtggccgcatcactccagtctctgcctccgtctccacgtggccttctcctctgtgtctgtctcctcttctgtctcttagaaggacacctgtcattggatttaggggacaccctactccaggatgatctcattttgaaattctttactcaatgacatccatagagaccctatttccagataaggtcccattcccagcgactgagggtcagcacctgaatatatcttttaaggggacaccattcactgcactacagcagaccatctttttatttcagcaattacagaggggcgtgcagctacatgcgccccccgcaacaggcaaccctcctggggcgcctgaatcaggggatcaccagagaaggccctgccattgcccactcaccggcagtgcggccccgactctccctggcacacgcccatgtgcgccgactctgcctgcctcgcccaggtgctgcccctgaattccctgcttttttcctcccttgccttcttgtcgcccaggctggagtgcgatggcgcgatctcggctcactgcaacctccacctcccaggttcaagcgattctcctgcctcagcctcccgcgtagctgggatgacaggcgcccgccacccctgtccagctaatttgcatttttagtagagatggggtttcgccgtgttgcccaggctggtctcgaactcctgagctcagacaatctgcccacctcaggctcccaaaatgctgagattacaggtgtgagccactgtccccagcgttttctcagcccgagtcaaaccgcacgggcgtgacatcactaaccagctcctcatggagctctgttcaagtccccacggggatgtacttcaggaagacccattcccgcccacacccctctcttctctgtccctgatttaggatgcgggtggccgtcccaggatctgtccggggaggactgcttcttccatacctgacggacgtatctcgttttgtctttaaaccaggtgactttttcagggaccccctccccagcgctgagctgtacgtcctgtgccggatcctgcatgactggccagacgacaaagtccacaagttactcagcagggtcgccgagagctgcaagccaggtgagagcccatcgtcaggttagctgtttttgttaagacgtagtattttgggttcaagttttacaaggaggccgggcgcggtggctcacgcctgtcatcccagcgctttgggaggccgaggcgggcggatcacctgaggtcaggagtttcagaccagcctggccaacgtggtgaaaccccatcgctactaaaaatacaaaaattagccaggcgtggtggctcatgcctataatcccagcactttgggaggctgaggcaggtggatcacccggggtgagcagttcgagaccagcctggccaacatggtgaaaccccgtctctactaaaaatacaaaaattagccaggtgtggtagtgcgcacctgtaatcccaggtacttcagaggctgaggcaggagaatcacttgaacccgggagctggagactgcagtgagccgagatcgcgccactgcactccagcctgggcgacggagtgagattcggtgtcaaaaaagaacaaccacaacaaaaaaagaattggcttatgtgactttggaggttggcaggtccagcgtctgggtgagaggcccgctaaattgtggagggtaaatctgctgtatttaaagttggccagtgtggccaggtgtggtggctcacgcctgtcatccccgcacttcgggaggccgaggcgggcggatcacctgaggtcgggggtttgagaccagcctggccaacatggtgaaaccccgtctctattaaaaacaaacacaaaaaataagccgggcttgatagcgggtgcctgtaatcccagctactcaggaggctgaggcaggagaatcgcttgaacctggagacggaggttgcagtgagccgagactgcgccaccgcactccagcctgggtaacagagcgagactccatctcaaaaaaaaaaaaaaaaaaaaaaaagaaaatcctaaagagaaaatatatttactattcgtgaagttgaagtggctcatgataaaagtcttcattcttgaggaggtcttcacactgaggaggctgcagaggaggaagccgtgggctggtgttgctgtctcaggggtggccgaggcagagggaaatccacgcatgagtggactctgcagctggatctaatctgtgtgtttctacgcagacacacgtgcacacacacacagcacgcaccatctcggctcaaagccttcacatcaggtttctcccccgtccacccaggctgctcctggagcccagtggggctgctggaaaccctggctccaggggttcgggccagggctgcatattgggtttccacagttgaaccagctggccctgagggaatctgacgggcactcagcctccctcaagagttcagcgttgttgctccagtgagaattcctggaatatttgcagacaacggttaattatcttcacagagccagggcctggcacctgcgcgttgaaacaggactccccataggctcaaatggtcaagagacttccattcttctctccctctgtctctccttctttctctctttctctgtgtatctctcttcttttttttttttgagacggagtctcgctctgtcgcccaggctggagtgcagtggcacgatcttggctctccgtaacctccacccccagggttcaagtgattctcctgcctcagcctcccgagtagctggattactggcacataccaccacgcccggctaattttttatttttaatagagacagggtttctccatgttggtcaggctggtctcgaactcccaacctcgggtgatccacccagctgggactcccaaagtgttgggattacaggcgtgagccacctcgcccggctctattatattttttgagacgaggtctcactctgctgcccaggctggtgtgcagtggagcagtcacaggtcactgcagccttgacctcctaggctcaagctgtcctcccacctcagcctcccgagtagctggaagtacaggcatgcatcatgcatcaccatgcccagctaattttttaagaagttttttctgagaccgggcacggtggctcacacctgtaatcccagcactttgggaggccaaagcgggcagatctcgaggtcaggagttcgagaccagcctaagccacgtggtgaaaccccgcctctactaaaaatacaaaaattagtccggcgtagtggtgcacgcctctaattctagctactcaggaggctgagagaggacatcacttgaacctgggaggcgaaggttgcagtgagcagagatcgcgccactgcactccagcctgggcaacacagcaagactccgtctcagaaaaaaaaaaaaaagttttttgtggagataggagtccccctctgtcacccaggctggagtgcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagtgcagtgttgtcatcatagttcactgcagccttgacctcctgggctcaagcgatcctcctgcctcagcctcccgagtatttgggagtagcagcatttggctggagtgcagtgttgccatcatagttcactgcagccttgacctcctgcactcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggactgcagtgttgtcatcatagttcactgcagccttgacctcctgggctcaagcgatcctcctgcctcagcctcccgagtatttgggagtagcagcatttggctggagtgcagtgttgccatcatagttcactgcagccttgacctcctgcactcaagcgatcctcctgcctcagcctcccgagtatttgggagtagcagcatttggctggagggcagtgttgtcatcatagttcactgcagccttgacctcctgggctcaagcgatcctcctgcctcagcctcccgagtatttgggagtagcagcatttggctggagggcagtgttgccatcatagttcactgcagccttgacctcctgcactcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggactgcagtgttgtcatcatagttcactgcagccttgacctcctgcactcaagcgatcctcctgcctcagcctcccgagtatttgggagtagcagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgcactcaagcgatcctcctgcctcagcctcccgagtatttgggagtaccagcatttggctggagggcagtgttgccatcatagttcactgcagccttgacctcctgcgctcaagcgatcctcctgcctcagcctcccgagtatttgggagtaccagcatttgttatcatgccctgttagggttttttaaattttgtagagatgggatcttgcgatgttgcccaggctacccttcctgggctcaagcgatcctcctgcctcagcctcccaaaatgctggggttaaagacatgagccactgcacccggcctctgtctctctttctctctcttctccctcttcctctctgtctcctcctctctgtgtctttttaggtatctcatctatcatcatcaatctctgtttctcttctctcctccttcctcctttatcttctctgtctcttcctccctctctccaccctgtctctgtctctctttatacatctatcatccttttttaaaaaaaataaaatagagacagggtctcactatgttgctcaggttggtttcaaactcctgggctcaaaccatcctcccacctctgcctcccaaagtgctgcgattacaggtgtgagccactgcgtctggccttctaacaatgctccgtcacctgtcatctgtctatcatttattatctatccatccatccatcatctacctacccatcatctaccatatattcacccatccatccatctcatccatgcatccatctatccatctattcatctatctacctatcatctaccatctattcacccatccatccatctcatgaatgcatccatctatatccatccattcatctacctacctgcccatcacctaccatcaatacacccatccatctcatccatctatccatccattcatctacctgcccatcatgtaccatctattcagccatccatccatctcatccatgcatccatctatccatccatccatctacctacctacccatcatctaccatctattcacccagccatccatctcatccatgcatccatctatatacatccattcatctatctacctacccatcatctaccatcagttcacccatccatccatccatctacccatcatctaccatcagttcacccatccatctcatccatgcatgcatccatccatccatccatctacctacccatcatctaccatctattcacccatccatccaatccatgcatctatccatccattcatctacctacccatcatctactatctattcacccatccatctcatccatgcatccatctattcatctatctatgtacccatcatctaccatctattcacccatccatccatctgttccatgcacccatctatccatccattcatctacctacccatcatctattatctattcacccatccatccatctcatgcatgcatccatgtatctatccattcatctacctacctacccatcatctaccatctattcactaatccatccatctcatgcatgcatccatctatccatccattcatctacctacttaaccatcatctactatctattcacccatccatccatcacatccatgcatccatctacctacctacctatctattcacccatacatccatctcatccatgccatctatccatccatccatccacctacctacccatcatctaccatctattcaagcatccatcacatccatacatccatctatccatccactcatctatctacgtacccatcatctaccatctattcacccatccctccatccatctcatccatgcatccatctatccatccattcatctacctacctacccatcatctaccatctattcacctatccatccatctcatccatgaatccatccatccatctacctacctacccatcatctaccatctattcacccaaccatccatctcatccatgcacccatctattcatcttcctacctacccatcatctaccatctattcacccatccatccatctcatccatccattcatctatctacccatcatctaccatctattcagccatccatccatctcatccatgcatccatctatacatccatctacctacctacctacccatttattcacccatccatccatctcatccatgcctccatctatccatccacctacctacccatcgtctaccatctattcacccatccatcacatccatacatccatctatccatccattcatctatctacgtacccatcatctaccatctactcatccattcatccatccatccactcatctacctacccatcatctaccatctattcacccatccatctcatccatgcatccatctatccatccatccatctacctatgtacccatcagctaccatctattcacccaaccatccatctcatccatgcatccatctattcatcttcctacctacccatcatctaccatctattcacccatccatccatctcatccatacatccatatatccatccattcatctatctacctgcccatcatgtaccatctattcacccatccatccatctcatccatgcatccatctatccatccattcatctatctacctacccatcatctaccatctattcacccatccatccatctcatgcatgcatccatctatccatccatccgtctacctacctacccatcatctatacacccatccatctcatgcatgcatccatctatctatccactcatctacctacctaaccatcatctactatctattcacccatccatccatcacatccatgcatccatctatacatccatctatctacctacctacctattcacccatccatccatctcatccatgcctccatctatccatccacctaacgatccatcatctaccatctattcacccatccatcacatccatctatccatccactcatctatctacgtacccatcatctaccatctgttcacccatccatccatctatccatccattcatctatctacgtacccatcatctaccatctattcacccaaccatccatctcatccatgcacccatctattcatctacctacctacgcataatctaccatctgttcactcatccatccatctcatccatgcatccatctatccatccattcatctatctacgtacccatcatctaccatctattcatccattcatccatctatccatccactcatctacctacccatcatctaccatctattcacccatccatccctctcatccatgcatccatctatccatccatacatctacctacgtacccatcagctaccatctattcacccaaccatccatctcatccatgcatccaactattcatcttcctacctatccatcagctaccatctattcacccatccatccatctcatccatacatccatatatccatccattcatctatctacctgtccatcatgtaccatctattcacccatccatccatctcatccatgcatccatctgtccatccattcatctacctacccatcatctaccatctattcacccatccatccatctcatccatgcatccatctatccgtccattcgtctacctacctacccatcatctatcatctatacacccatccatccatctcatgcatgcatccatctatccatccattcatctacctacttacctaaccatcatctactatctattcacccatccatccatccatctatacatccatctatctacctacctacccatctattcacccatccatccatctcatccatgcctgcatccatccatccatccatccacctacctacccatcatctaccatctattcacccatccatctcatccatgcattcatctatccatccattcatctatctatgtacccatgatctaccatctattcacccatccatccatccatctcatccatgcatccatctatccatccattcatctacctacctacccatcatctaccatctattcacccatccatctcatccatgcatccatctatccatccatctacctacgtacccatcatctaccatctattcacccaaccatccatctcatccatgcacccatctattcatcttcctacctacccatcatgtaccatctattcacccatccatccatctcgtccatgcatccatctatccatccgtctacctgcccatcatgtaccatctattcacccatccatccatcacatccatgcatccatctgtccatccactcatctacctacctacccatcatctaccatctattcacccatccatccatctcatacatgcatccatctatccatccatccatgtacctccccatcacttaccatctgttcatccatccatccttctcatccatgcgtccacctatccatacatctttctacctacctacccacccatcatctaccatctgttcatccatgcatccaggagaaccggaaaaggcccaggtgatgcatccatctatccatccatctttcgatcaaatctccttctccctgtctgtccgccctgcatcaagtctctgtctctctcccctcccctacctgtgtgggccccctggccaagggttctcagcagcctctgctcaccgttctgagctcctgttgcctgctgtgtcccctgtgtcctgctgaaggatccccgcctggctggccaggactccagctctctgctgtctccctcaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcct

SEQ ID NO: 4158 - DNA, 49736 bp, human
agaagtgcggacgcccggctcccggcgtggacgccatggtgctgtgcccggtgattgggaagctgctgcacaagcgcgtggtgctggccagcgcctccccacgccgtcaggagatcctcagcaacgcggtacggcctgggcctgggcggggcaggggaccggggacggaggggctgaaccccggagggcccagcgactcaggaactctagggatagggatgggagagtgacccgagacccttagggatgggggaggggagagtgtcccgggacctccagggatagggttggggagagtgacccggaacctctagggatgggggaggggagagtaacccggaaccccctaggcatgggggtggggagtgacctgggtccccatagggatgggggaggggatcgtaacccgggacccctaggaatggggagggtagagtgacccaggaccgctagggatggggacagcagagtgaccccggagccccatggatggggatgaggagagtaacccgggacccccaggcatggggatggggagagtaacccgggacctccagggttggggatggggagagtaagccgagaccccccctagggatgggggtgggggagtaacccgggacccctagggatgggggagaggagagtaacccgggacccccaggcatggggatggggagagtaagccgagacccccaggaatggggttggggagaataacccgggacccctagggatggggttggggagagtgacccaggaccccctagggatgggggaggggagagtaacccgggacccccctaggggtgggggaggggagagaaacccgggacaccttagggatggggttggagagagtaacctgtaacctgggaccccctagcgatgggggtggggagagtaacccaggacgccctaggcatgtggttggggagagtgacccgggaccccctagggatggggagggaggagtgacccaggaccgctagggatggggacagcagagtgaccccggagccccatggatggggatggggagagtaacccgggacccccaggcatggggatggggagagtaacccgggacctccagggttggggatagggagagtaagccgagacccccctagggatgggggtggggagagtaacccgggacccctagggatgggggagaggagagtaacccgggacccctaggaatggggaggtcaagtgacccgggacccccctagggatgggggtggggagagtgacccgaaacccctaggcatggggttgcagggagtgacccagaaccccctaggaatggggatgggagagtaacctgggaccccctagggatgggggaggggagagtaagccgggatccccctagggatgggggtagggagagtaacccgggacccaaaaggatgagggaggggagagtgacctggaacccctaggcatggggttggggagagtgacccaggaccccctagggatgggggagggaagggtgacccgggacccccaaggaatggggaggggagagtgacccaggaccacctagggatggggaaggggagagtaacccaggaccccctagggatgggggtggggagagtaacccaggacgccctaggcatggggttggggagagtgacctgggacccccttagggatggggagggaggagtgtcccaggaccccctagggatggggagggaggagtgtcccaggaccccctaggaatggggaggggagagtgatccaggaccgcctagggatgggggaggggagagtgatccggaatccctaggtatgggggaggggagagtgacccaggaccccctaggaatggagaaagcagagtgacccgggacccctagggatgggggaggggagaataacccaggacccctagggatgggggaggggagagtgagccaggaccccctaggaatggggagggcagagtgacccgggacccatagggatgggggagggcagagtgacccgggacccctagggatgggggaggggagagtgatccagtaccgcctagggatgtgggtggggaaagtaacctgggacccctagggttgggggaggggagagtaacccgggaaccctagggatgggggaggggagagtaacccagaacccctagggatggggttggggagtgtgacccggaaccccctagggatgggggaggggagagtgacccagaacccctagggatgggggaggggagagtgacccagaacccctagggatgggggaggggagagtgacccagagcccctagggatgggggaggggagagtgacccaggatgccctagtgatgggggaggggagtgtgatccaggacctcctagggataagggaggggagagtaatccaagacccctaggaatgggggaggggagagtaacccgggaccccctaggggtgggggaggggagtgacctgggacccctagggattggggaggtgagtgactcaggacttctagggatggagtgggccctgtgactgatggttggactttgtagctggggtatgggaagtgtttcctggtgcccccatgaggatcttattccgggtggtaggacgcctaggtagtgggtgtctgcctctctctggagccctaatcacatggaggagacggtctagtgatgaagggatagttacttgtgatggggggtagttactggtgacaggcggatagttataggtgatgtgggatagttactggtaatggggtgatagttactggtgatgggatagttactggtgatgggggcatagttactggtgatggaaggatagttactggtgatgggggatagttactggtgatgggagatagttactggtgatggggcgtagttaccggtgatgagggatagttactggtgatgatggggcatatttactggtggtgggggttagttactggtgatggtgggatagttactgggtttgatgatggggcatagttattggtgatgggggtagttactggtgatgtggggatagttactggtgatgggaggatagttactgttgatgggagatagttactggtgatggggggatagttactggtgatgatggggcatagttactggtgatgggggatagttactggtgatggtggatagttactggtgatggggggtagttactgggtttgatgatggggcatagttactggtgatggggggtagttactggtgatgtgaggtagttactggtgatggcagagaagttactggtgatggtagggtagttactggttgcctatggatggtgcagtggggcaggagtctactcttggggactacggactggaggtctggtaccctgggaggggggacaccacatgcctggtcctagtgacggggatgagagtggtcagggtgcctcacagaaggcatgggtctccatgattgggggtgacagggcatagggcaggggtctatatgatctggggttgagatctgcagggcaggtccagggcttggtgactggtgccctgaagaccaggatgggcgtcagggccaggatctgggggcaccttcaagaggtgaggagcgctgaggagtgtagaagagtggaagaaagacgaaaaaagaaaagcagcttcacagtcaaagacgggtttattttggagaacaagcctgagcggggcttctggctgagttaggtcaggagtgttctctcttacagactaagggtatttaagggtttaggaaggggaatcttatcgcaggctcggaatgtttccctgtgaggcaaagttgactgaggtgttagaatgtctctggtctgaaggaggttatcttgggcttgggatgtttctggtcagaggcggtttatttcaggctttgactgtttctggtcatgctgacattagccattaggctgatgttttggggctggttttaggcagtttttaatcacgggaacttaaaatggcaatgcttgtccaagatggcggtgtgtgtccaagatggtggtgtgtgtcaaagatgaccatgcatgtccaagatggcagtgcttgtccaagatggtggtgcttatccaagatggcggtgtgtgtccaagatggtggtgcttatccaagatggtggtgtgtgtcccagatggtgtgtgtccaagatggtggtgcttctccaagatggcagtgtgtgtccaagatggtgtgtctccaagatggtggtgcttatccaagatggcggtgtgtgtccaagatggtggtgcttatccaagatggccgtgtgtgtccaagatggtgtgtgtccaagatggtggtgcttatccaagatggcagtgtgtgtccaagatggcggcatgtgtccaagatggtggtgcttatccaagatggcagtgtgtgtccaagatgttgtgtgtccaagatggtggtgcttttccaagatggtggtgtgtatccaagatggtggcgtgtccaagatggcggtgtgtccaagatggtggtgcttgtccaagatggtgttatgggtccaagatggcagtgtgtgtcccagatggtgtgtgtccaagatggtggtgcttatccaagatggcggtgtgtgtccaagatgttgtgtgtccaagatggtggtgcttatccaagatggcagtgtgtgtccaagatggtgtgtgtccaagatggtggtgcttatccaagatggcggtgtgtgtccaagatggtggtgcttatccaagatggcggtgtgtgtccaagatggtgtgtgtccaagatggtggtgcttatccaagatggctgtgtgtgtccaagatggtgtgtgtccaagatggtggttcttatccaagatggcggtgtgtgtccaagatggtgtgtgtccaagatggtggttcttatccaagatggcggtgtgtgtccaagatggtggtgcttttccaagatggtgttgtgtatccaagatggcggtgtgtccaagatggcggtgcttgtccaagatggtgttatgggtccaagatggcagtgtgtgtcccagatggtgtgtgtccaagatggtagtgcttatccaagatagctgtgtgtgtccaagatggtggtgcttatccaagatggcggtgtgtgtccaagatggtggtgtgtgtcaaagatggccatgcatgtccaagatggcagtgcttgtccaagatggtgtgtgtccaagatggtggtgcttctccaagatggcggtgtgtgtccaagatggtgtgtctccaagatggtggtgcttatccaagatggcggtgtgtgtccaagatggtgtgtctccaagatggtggtgcttatccaagatggccgtgtgtgtccaagatggtgtgtgtccaagatggtggtgcttctcccagatggcggtgtgtgtccaagatggtggtgcttctccaacatggccgtgtgtgtccaagatggtgtgtgtccaagatggtggtgcttatccaagatggcagtgtgtgtccaagatggtggtgcttctccaagatggccatgtgtgtccaagatgttgtgtgtccaagatggtggtgcttatccaagatggcggtgtgtgtccaagatggtgtaatgggtccaagatggcagtgtgtgtcgaagatggcaatgctcctgctctgtgaatccagaccctctagttataacaggacgaggggtggtgtgttctttctggccacttcctgctgagggaggtggttattacgggtcaccaaacacagccctggaggggaagaggttgatttgttcctggtagcactctttaggggccttccaagcagcacccgttgaaacatctagcttttagttcacagggctttaagaaagcagaacttgggtttcagaggttttcagttaggaaaaattggagaaaaagaaaaaggaaaagaatgcaaaacattatcttggagacatgtagccagaaaaattagaatttaattcaaaccgtagaaaagaataaaaactgaaaaccattaggcaagactagaatttcacgacaggggtaactatagtttttcaaacacgatttttctttttccagttttcccacttttattaaaagacaaattatgggctgggcatggtggctcatgcctgtaatcccagcagtttgggaggccgaggttggcggatcacgaggtcaggagatcgagaccatcctggctaacatggtgaaaccccgtctctactaaaattacaaaaaattagccgggcgtggtggcgggcgcctgcagtcccagctacttgggaggctgaggcaggagaatcgcttgaacctgggaggcagaggttgcagtgaaccgagatggcaccactgcactccagcctgggcgacagagcaagactccgtctcaaaaaaaaaaaaaaaaatgtcatgagatgtagggaccagccccacagggtcagtggatctctccctgtgtgcggaggcatgagagtgtagaaataaagacacaagacaaagagataaaagaaaaggcagctgggcccgggggaccactaccaccaagacgcggagactggtggtggtcccgaatgccaggctgcgctgatatttattggatacaagacaaaggagcagggtaaggagtgtgagccatctccaatgataggtaaggtcacgtgagtcacgtgtccactggacagggggcccttccctgcctggccgccgaggcagagagagagaggagaaggagagaaacagcttacgccattatttctgcttatcagacacttttagtactttcactaatttgctcctgctaactaaaggcagagccaggtgtacaggatggaacatgaaggcggactaggagcgtgtgaccactgaagcaaagcaccacagggagagggttaggcctccggataactgcgggcgggtctgactgatgtcaggtcctccacaggaggtggaggagcagagtcttctctaaacccccccagggaaagggagactccctttggtgaccccgtctgggcataacagaaggctcgcgctcgtcttctggtcgcacctcaccatgtcccctcagctcctatctctgtatggcctggcttttcctacattatgattctagagcaaggattattataagattggtataaagagtaattactaccaactaatgattaatgatattcatatataaccatatctaagatctatatctggtataactttctcgttttatattttatcatataccggaagagctcgtgtcctcggtctcttgcctcagcacctgggtgtcttgccgcccacaatgagaggtgcaacttgacatagggagggtagaagatagcctgagtatagggaacctcttgccatttcctggtgataaagttgtcaaggtccctgagaatttgcaagttaaaggtgctatgttcgggccatctgctgtcattatgtagtttgtattgatgccagactattgcaataaaaaattcaacactctggctttaggttcctctgtaagccaagtttggccaggttggaaaggagacatcccagagaggaggacataggaatgtcgggttgtttggcacccacgtgggctggtaaaaggaagccgagagtgtctgtttgtgttttaggcaaccccagacaaaagacagagacccagaatcctctttataaggaggacggccaagctgagaagatactgggcatccctcaagatcgcttctagcttagtgccgctggtcctccgaggactgggatggccgacctgacttttcctgggtaccaaaagtcagaggagggcagatcttaccagacggctggatttgtgtctgatgttggatgttcctgttggaattggcaaaggggctcccaaactggagccgcgcagggaagacagagagagagagagaagagggaagaagacggacgaagagagaggaagacgaagcaagggttagggagcgaaatacctgttgcagggggtcagaggtggatttctgagacctgagggttttgagaaccctccagcttgagcctctaagtcccctttacatgagttgtcttcctcacacaaattgcttggaaggtgaatggagagaaaagatgggaggggtggccagagaccctcacgatccaggagttagcccaggatgagctgctgctgcccacagcttcctgggttgcaagagaacctccactcccaacactcaaagagggagagagagaaaggacagggtcagagggccagaggctctaaaggatccaggagttagcccgggacaggctgcccctgcccactgcatcctgggttgcaaaagggcctctgtccgtaacacctgtcctgggtttcggcaccaaatgtaagagtttaagaaggaggaaacaaatatagaaagtgagcctgggcgcagaggctcacatctgtaatcccagcactttgggaggccgaggcgggcggatcacctgaggtcaggagttcgacaccagcctgaccaacatggtgaaaccccatctctattaaaaatacaaaaattagccgggtgtggtggcgcccacctgcaatcccagctactcgggagactgaggcaggagaatcgcttgatcctgggagatggagcttgcagtgagccgagatggcatcactgcccctccagcctgggcgacacagcgagactccgtttcaaaaaaaaaaaaaaaaatacaaaaagtggctcagcaaagggttttggaaaagggggcttctcgcaggctcggaatgtttctgtgtgagggaaaattgattgcggggttggactgtctctggtcggaggggaggtttctggtcacagaggggtttatcccacggctggaatgtttctggtcatgctgacattagccattaggctgatgtttgggggctggatttaggcagtttttaatcaagggaacttaaaatggaagtgtgtgtccaacatggcagtgtctgtccaagacgggggtgtctgtccaagatggcggtgtgtgtccatgatgggggtgtctgtccacgacggcggtgtctgtccacgatggtggtgtgtgtcctcgatggccaaaatggcggtgtgtgtccacgatggtgtctgtccacgatgggggtgtgtgtccacgatggccaagatggcagtgtgtgtccacgatgatgtctgtccacgatgggggtgtgtgtccacgatggccaagatggcagtgtgtgtccacgatggcggtgtgtgtccatgatggcggtgtgtgtccatgatggcggtgtctgtccacgatggcggtgtctgtccacgatggcggtgtctgtccaagatggcggtgtgtgtccatgatggcggtgtgtgtccaagatggaggtgtctgtccaagatggcggtgtgtgtccacaatgacactgtgtccatgatggccaagatggcggcatgtgtccacgatggtggtgtgtgtccaagatggcggtgtctgtccaagatggcggtgtgtgtccaagatggcggcgtgtgtccaagatggcggcgtgtgtccatgatggtggtgtgtgtccaagatggcggtgtctgtccaagatggcggtgtgtgtccaagatggcggtgtgtgtccaagatggcggtgtgtgtccatgatggcggtgtgtgtccaagacggcggcgtgtgtccacgacggcggtgtgtgtgcacgacgacggtgtgtgtcccagatggcagtgtgtgtccacgatggcggtgtgtgtccacgatggcggtgtgtgtccaagatggcggcgtgtgtccacgacggcggtgtgtgtccacgacgacggtgtgtgtcccagatggcagtgtgtgtccacgacgacggtgtgtgtccacgatggtggtatgcgtccaagatggtggtgtctctccaagatggcggtgtgtgtccaagatggcgatgcttttgctctgtcagaggggagatggtcagaggggagatgcggagttccctgcaccctggcagggtgtggcagccaggggctcccccactggaggcatttaccaccatcattcctgaccccacggtctctgcaggggtcactacctctaggccaggcctccccaggggcggtgttgtctcttcctgggtaccagggattgacgtagagccatcattgtctcccttcccacagccatcattgctggcgtttttcctgaatttcctgtgggcaggttgggttttgtactctgccccaaccttcaggtctctgggaatcctcggacactgttggctcgtgggttcaaggcccgagtcaatacctccctgctggcctctttgttcctggcttcttcctttgccaatctcttccctcgagagccaagaaggcccctggtcagtccctgaaggcccctggtcagtccgcggcccactaaccacacttagggaaagccctggtcagtccccggctccccagccacacttagggaaagcttggcggatggatgagctcacctgggacagggtcggggagtgtagcaaacgctatgtgcgtcctgcaaatcttgcatgtcccattcacttttcatagggtctttcattgacccttctgaccccttttctactgttgcagggtctcaggtttgaggtggtcccctccaagtttaaagagaagctggacaaagcctccttcgctactccgtatgggtacgccatggagaccgccaagcagaaggccctggaggtggccaaccggctgtaccaggcaaggggcccctgcccttcggcccttatgaaaattcctttgctgtgatgaggggatttgcgggtggtaaatatacatgacacaaataaacgtcattcaaaagatgcagttggtggcacagcttagctattgctatgttataatgtaatgcactattgcagtaacctaataataccattaatgatacagaattaatggagcttatctgttactgtgtgttataatattctcttgcaattgatacagtatcattgatgatatacaattaatgtagcttatctgttactatgtgttataataatttctcgcaattgatacagtatcatttatgatatacaattaatgtagcttatctattactatgtgttataatatcctcttgcaattgatatcatagtatcattgatgatacagaattaatgtagcttatctattactatgtgttataatattgtcacaattgatatcacagtatcatttatgatatagaattaatgtagattatctgttactatgtgttataatattctcttgcaattgatttcatagtatcatttatgatatagaattaatgtagcttatctattactatgtattataatctcttgtggccggtcgcggtggctcatacctataatcctagcactttgggaggccaaggcggacagatcacctgaggtcaggaattcgagaccagcctgaccaacagggtgaaaccccgtctctactaaacatacaaaaattagctgggcgtggtggcgggtgcctgtaatcccagctactcaggaggctgaggcaggagaattgcgtgaacctgggagacggaagttgcagtgagccgagatcatcccactgcactccaacttaggcaacagagcaagacttcgtctccaaaaaataaaaaattaaaacaaaaattatcttgcaatcaatataatagtctcgttgatgatatacaattaatgtagcttatctattactatgtgttataatattctcttgcaattaatataatagtatcatttatgatatagaattatgtagcttattaccatgccactaagtaatatcggattttaattaaaataatatcatttataatatagaattatgcagtttatctgttgctgtatgctacaatgcaatatacaattataattaatatactactatcatttaagatttaagattcatgtagcttgttactatgtttgaatataatattgcaattaatatagtaatatcagttacgatatagaattaacatccattactatgtgttgtgatacatagaattaatatgttactgtgtgatactatgtaatatactatgacaattaatataattgtatcataatgtagaattatgtcatttatctgttactatatgctcctatgtaatacatattattttagtagagatggggcttcaccatgttggccaggctggtctccaactcctgacctcaggtgatccacccgcctcggcctcccggagtgttgggattacaggcgtgagccaccgcaccccaccgtaatacactattataattaatacactactgtcatttaggatgtacaattaatgtagcttatcaattactatatgttatatatgactctaacataatgtcagtcacagtatataaaattaacatagctattactgtgtgttttaacttgctgttacaatgaatataatgctatcatttaggatatagagttaatgtagcttccctgctgctgtgtgttaccacacaatataccattactgttaatataagaaatacattcggggccgggtgcagtggctcacacctgtcatcccagcactttgggaggccgaggcgggcggatcacgaggtcaggagttcaagaccatcctggctcacacggtgaaaccccgtctgtactaaaaacacacacaaaatattggctgggcgcggtggcgggcgcctgtagtcccagctactcgggaggctgaggcgggagaatggcgtgaacccgggaggcggagcttgcagtgagccgaggtcgcgccactgccctccagcctgggcgacagagcgagactccatctcaaaaaaaaaaaaaaagaaagaaagaaatacattagaggtaaggctgttgtgagtcgtgctatcaagacaggagtattgattgtgggttttggcagtgcacagcttagggaggccagtgcggggctgagctaaggtcaaagctgcacacagatgtcctgtgactgcctgttgctctgaggctgaattttcaacctggatttgttttatcgtcctaagtacctttttctttttctttcttttccttgtttttttttttctttttttttttggagactgagtctcactctgtcacccaggctggagtgcaggtgcgcaaccttggctcactgcaacctccgcctcctaggttcaagcgattctgctgcctcagcctcctgagtagctgagattacaggtgcccgactgatattttgtatttttagtagagacggggtttcaccatgttggccaggctggtctcgaactcctgacctcaggagatgcgcccgcctcggcctcccagagtgctgggatgacaggcgtgagccaccgcgcccagccctaagtagctttttctgaaattacattgaacggatcaaaaaccttttggccttaattctgggtaactcagggaggtttggggcccctgaatcaaaccttacctgccgcccggaagaacaaaagcttacggaacaggcattgcgtttcccgtagtgcccgtgagatgctccgtgagtgcctgacccctgatcacgcagcccccgtgggccccggcctcacccacgttccagcccctgcagggcgaccaccggcgggacccacttgtgtccttgctcgtgaccttgagcacccccagccttcacttccaaagtcggcctggcttcgcccctgcggtgctctttcacgcccgtaccgacgggaaaacttctctgtgagacccacggcacgtcaccggtaaaccggaatctggttttcttacagaaagacctgcgggcccccgacgtggtcattggagcggacacgatcgtggtgagtgcggccagggtgcctcgtttctaatgtccgatgtggttttcctgtgcttggtgattctgcctcttgtggatgttgtacattccccttaagacagcagtggactcgcttccagaaactcccatcacaaactaccagcagatgaggggcctaagggcacgggaaggggccaggcgccgtggctcacccctgtcatcccagcattttgggaggccgaggtgggcggatcaccttaggtcatgggttcgagatcagcccgaccaacacggtaaaaccccatctctactaaaaatacaaaaattagccagacgtggtggctaattgatagtatcataagtgatactatatgatatcaattgcaagagaatattataacacatagtaacagataagctacattaattctatatcatcaatgatacagaatacagactccgcctgtaatcgcagctactcgggaggctgaggcaggggaatcgctcgaacccaggaggcggggttgcagtgagccgagatcgcgccactgcactccagcctgggtgacaagagcgagactccgtctcaaaaggcacaggaaggtacgcagttctagaggccagcaaccacaaatcacggtgtctgtagggtttcttccttccagaggtactgaggagaagttggtcttggtctttctccagctcctagaggctgttggcaacccattgtctcctttggctcatggccctgtggttcctatctgtgcctccatctccatgtggccttctcccctctgggtgtctgtggccaaatttccctcttcttttttttttttgagagagagtctcactgtgttgcccaggctggattacagtggcgtgatctcggctcaccgggacctccgcctcccgggttcaagcgattctcctgcctcctgagtagctgggatcacaggcacccgccaccacgcccggctgatttttgtatttttagtagagacggggtttcaccatgttggccaggctggtctcaaactcccgacctcaagtgatctgcccaccttagcctcccacagtgctgggatgacaggcgtgagccaccgcgcccggctgaaattttccccttcttttaacaacaccactcataaaatgcgcatcctaattctgtccaaccgcatcttaattacctaggcaaagacccatttctccttttttttttttttgagatggagtctcactctgtcgccaggctggactgtagtggcatgatctcagctcattgcaacctccgcctcccgggtttcaatgattctcctgcctcagcctcccgagtagcggggactacaggtgcgcgcgaccacgtgtggctaattttttgtatttttagtagagacggggtttcaccatgttggccaggatggtctcgatctcctgaccttgtgatccacccgcctcggcatcccaaagtgctaggattacaggcgtgagccaccacgcccggcccatgtcttttgttcataagccacccagtctatggtattctgtgatagcagcctgaaatggactaagacatctcataagaagaggagatgaggacacagacacacacagagggacgaccctgtgaggacacagggggaagacggcgtctccaagcccaggagagaggcctcaggaggaaccagccctgcccacacctggatctcagacttccagactccaggattatggaagaatcaatgtctgctgtttataagccacccagtctatagtattgttttagcagcctgaaatggactaagacacctcataagaagagcagataaggacacagacacacacagagggatgaccctgtgaggacacagggagaagacggcgtctacaagcctaggagagaggcctcaggaggaaccagccctgcccacacctggatctcagacctccagcctccagggctgtgggagaatcactgcctgttgtttataagccacccagtctgtggtattctgtgacagcagcctgagatggactaaagcatctcataagaagaggagatgaggacacagatacagagggacgagtctgtgaggacacagggagaagatggcatctccaagcccaggagagaggcttcaggaggaaccagccctgcccacacctggatctcgcccttccagtctccacgacgatgggagaatcaatgtctgtagtttaagccacctgggttgtaggactttgctatggtggcccagtcagactaatacatctactcttgtatgtacccaaaaggattcaaaacaggtgttccaccaaaaccttctacatgaatgttcacagcagcactattcacaacagctaaaaggcagaaacagctcaagtgtctgtcagtgggtaaatgggaaattacaacatggtccatccacacacagtggaatattatgcagccatgaacaggaatgaggctggccgggtgcggtggctcacccctgtcatcccagcactttgggaggccgaggcgggtggatcacaaggtcaggagatcgagaccatcctggccaacatggtgaaaccccgtctctactaaaaatacaaaaaattagccgggtgtggtggcgggcgcctgtagtcccagctactcgggaggctgaggcaggagaatggcgtgaacccgggaggcggagcttgcagtgagccgagatcgcgccactgcactccagcctgggtgatagagcgagactctgtctcaaaaaataaataaataaaaaataacaaaaattagccaggcatggtggtgtgcacctgtattcccagcaactcgggaggctgaggcaggagaatcacttgaaccccggaggcggaggttgcagtgagccaagaccgtgccactgcactccagcctgggcgacagagtgagactccatctcaagaaaaggaaaggaacgaggctgtgaaacaggctgcaacatggatgaatgttgaggacatcacggtcagtgacagaaaccagccccggaggaccacacgttgcaggattccatgactacaccacgtccgcaacaggcaaacgcacggtgaaagaaagaggatgggcggttaccaggatctggggaggcgcactggggagggacagctgcgtggggacagggtctccttctggagtgaagagaacatcctggaaccaggcaggtagtggtggtacaacatggcaactctggttagttgtttgaaatggcgactctcaggacgtgtcagcttcatttccataaaacaagtgacttctgcgaatgggaccgtgggacttgcacaggcctgacccagccggtgggaaccaactccctctgtcccttcctctcacagacagtcggggggctgattctggagaagccggtggacaagcaggacgcctacaggatgctgtcccggtaagcaccatgttggcctctgagccctctcgggttctgagccacagagtagctgtggtatctggccgggtgtcctggggagcagggtggatctctgtcagctctgccgtctgagctgtgctgtctgagctgtgctgtctgagctatgcagggaggcaggcactatccctccatgctcatccttgtctaggattctgcagcactgatcccagaatgtctcatgcccactgcagactgttggggtcatgagaagttggcagtgtcctgtccttcccactgggcatcctggacctgagcccgtagcctgggacgtcatccccatcccaggacgtggaagagatgcaccccctgcccgccataggcccagctgagagctgcctggcctggcgcctcccgtcagggccactgctggtgggatttgtgaccccttccctcggcctctccgtaaaggtttccctggagaccccacagcgggacgatcggggagaagatgctggggacggatccaggattaaggacgcctcgctgcctcccctggttttgagaaactcgctttgtagctcccacgggtcacagcatggtcacgtggtcacccgttgttgtcttacaggttgagtgggagagaacacagcgtgttcacaggtgtcgcgatcgtccactgctccagcaaaggtaaccgcggcccaggtttcggggtagccccagaggccgagacaaggacccgggacattctcgggacccttggcttgagggaggaggacggttgctcacccccacctgtggaggggtttgtgcctatgtcctgcttgggaaagttgtccgccgatttggaagtctgcaggacaaaggaaaacgtgtggttttatctttttctttttctttcttttttttttttttttgagatggagtctcgctctcttacccaggctggagggcagtggcacgatctcagctcactgcaacctccgcctcccaagttcaagtgatccttctgcctcagtagctgggattacaggtgcccaccaccatgcccggctaatttttgtatttttagtagagacggggtttcaccatgttggccaggctggtctcgaactcctgacctcaggtgatccacccgcctcagcctcccaaagtgctgggattacaggtgtgagctactgcacccggcctttctctttctttctttcttttttttttttttgagacagggtctccctctgtcacccaggctggagtgcagtggtgtgatcatagctcactgcagcctcgacctcctgagctccagcgatcctcccgcctcagcccctacagtcacagaaactacaggcacacgccaccacacctggctcatttttgtattttttatagaggtgcggtcttgctatgttgcccagactggtctcgaactcctgggctgaagaaatcctcccatctcagcctcccaaagtgctgggactgcaggtgttcaccatattgctgggactgcaggtgtgcaccacggtgcccggcccaggcagttgtatcaccatattgctgggttcttcctgcaccaacccattcccagcttgttggcggacaccaggaggcatcgtagaattcagtcagttctgacagtagccgtcggagttagcgcagatcccacaggtgaagggccgggtcccatgggacctccacgcacaatcccagccccatatccctggtcacacctgtagttttctcacccacctgccgctcactgctggctcctgcaagcacctgctcaggttgggtcatttgctcgaggggctcacagaactcgggacagcactttccttcccagcttggggttttgttatgaaggagcaggtcaggaagtgccagacagaagccaggcacagcgcagggtgctgggtgcaggatgtatggagcctccatgcccgccgtggcacagctctgccaacaccctgatgtgttcacccaccagaagctccctgaaccctgtccttctgggtctcttttttttttcttttttgtgacagagtctcgctttatcgcccaggctagagtgcacttgcgccatctcggctcactgcaagctccgcctcccgggttcacgcccttctcctgcctcagcctcccgagtagctgggacgacgggcccgccaccacgcccggctaattttttctattttttttttttttttttttttagtagagacggggtttcaccgtggtagccaggagggtctcgatctcctgaccttgtgatccgcccgcctcggcctcccaaagtgctgggatgacaggcgtgagccaccgcgcgcggtcccttctgggtctcttaaaaggccaggattaacgacatcatccgccactggggagcaaactccatctccagccccctccccctgttcccatgacaaccaaagcctgccctttccaaaaggcccctcattaacataaggtcccctgcggatgaaaggggcttgtcaccacatagcaaaacgcctgctttcgctcctgtcactcaacagattccccgggattcaggggctctgtgtccggaccctgaggcacagaccaaacatctgtttcttttattatttatttatttgagacagagtctcgctctgtcgcccaggctgcagtacagtggcgtgatcttggctcactgcaacctccgcctcccgggttcaagcgattctcctgcctcagcctcccgagtagctgggatgacaggtgcatgccaccacgcccggctaatttttgtatttttagtagagacggggtttcgccatgttggccaggctggtctcgaacccctggcctctggtgatccatccgcctcggccgcccaaactgctgtttcttttgttttttttagagacggagtctcgctctgtggcccaggctggaatgcaggggcgcgatctcggctcactgcaacctgcacctcccgggttcaagcgattctcctgcctcagcctcccgagtagctgggactacaggcacctactaccaggcctggctaattttttgtatttttagtagagacggggtttcaccgtgttagccaggatggtctcgaactcctgacctcgtgatccacccgcctcggcctcccaaggtgctgggatgacaggcgtgagccaccgcgcccggcccctttctcccttttcttgtccgaaatgaaccttattctcccatgaagcatccatatctgaactgtgcgctgcgctcgagtacacacctccacagcacagccacgcagctgtcagggcacggaggtgacaagctggcgtccacgctcacccccacggctgtgtccttgcagaccatcagctggacaccagggtctcggaattctacgaggaaacgaaggtgaagttctcggagctgtccgaggagctgctctgggaatacgtccacagcggggagcccatgtgagtctcgggggcggtggggggacgggggacacgtgtggaagcctggccaccctcacacgtggggtgtcccacccagcctttgggaaagaaggaggccccgctccgggggccgtgtggcacagggagagccgcccggctcagaagcacaaacccttcacgaccacactgacccatggaggctcaaagaggcaaactcccaggacagagaggggcagggtgggagccaacgctgggctgcggtggggactggggaggcgctgggcaggggtagaggagttcacgtggtgggaggaggagaccccagaggtctgtgcccaggacgctggctgcaattaacacgaataaactctgtgatccaaagtcaccctaagaggtgattctacctgtcgtcccgtccacagattggtgagcacgggaagtatgcgtgcaccaatcagcttcacttcatcacccaccatttgcgtttatatgtattatatttatctacatcatatgtcatataatgtctacataattatacattatataatgtaacatgatatatatttacaattatatataatttatgtattccacattatatattctattaattatatataatctacattatacaaattatataatatatatttataatatattgtattatatactataatagattatactgtaatatgtatactatattacatatagatattataatatagattatatattaacacttttgattgaaatttaatgatttttaatgattaattttaataagtagtgattaatattaatgtaatatataccatctattataatatatactgttataatagattatatgataggttatataactgttaaaatagattatataataggtagttataatcgattataattatatataaattatataatttatatttataattatttataattatatataaaatatataattttatatattttatatatttaattttatttatatataaatatataattacatatatttataattatatataaatataatttataattatatataattaattataaatgatatataattatatataattataaacaattatataaatataaattatatataattatatatataattataaaatgattatatattataaaatataattatatatttatataatatagaaatatatgaatatatggataatatgtaatatgtattaaatatgattaatatatgtaactgcatattaatacatattacataataatataaagtgtgattatatgtaaattatatattaattaaatatatgtaatacatattagttatatataatatataatgtattatgtgttatataaatatataattatataaaatatatttttatattataaaagtatataaatatataaatatatgtatataaatacatttgtataaaatatatgtttattttatatatttatataaataattttatttatttttttgagacacggtctcactctgtcacccaggctggagtgcagtggtacagtcatagctcactgcagcgtcagcctcttgagtcaaaatgatcctctcacctcagccccactagtggctgggtctgcagacgcataccaccacgcctggctaattttttctattttttgtagcaatggggtctcactatgttgcccaggctggtcttgaactcctgggctcaggcgatccttccaccaaagcctcctgagtaggtgggaccacaggacacgcaccaacacacgcggccgattttattgttagtttttgtagagatggagtctgcgtaatatatatgtatattaacctagaggattttacatcaattgaaataagcccggcagaagaagacacataccacaggatctcacttatatggaatataaaacagttgcacttggtcaaaggatacaagatttaaatcagggccaggcatggtggctcacgcctgtcatcccaatactttgggaggccgaggcaggcggatcacctgaggtcagaagttcaagaccagcctggatatggcaaatcccaatctctactaaaaatacaaaaattagcccggtgtggtggcaggtgcctgtaatcccagctacccaggaggctgagacaggagaatcgcttgaacccagcaggtggaggttgcagtgagccgagatcgcgccactgcactccagcctgggcaacagagcgagactccgtcttttaaaaaaaaaaaattaagtgagacgggagaagttcaaggctctttacagcctagtgactgtggtttacaggaacagtgtcttactggaaaattgccagcacactacatctgaagtcttctccccacacacacagaataggtacatgaggtgctcgatgggataattggcttgatttaatgatgtcacatgtatacatatatcaaaacatcccatttaacacatgaaattttttttgagacggagtcttcctccgtcacccaggctggagtgcagtggcgcgatcttggctcactgcaacctccaccttccagtttcaaacgattctcctgcctcagcttcccaagtagctgggactacaggcacccaccgccacgcctggcgaattttttatttttagtagagaaggggttttgccatgttggccaggctggtctcgaactcctgacctcaggtgatctgcctgcctcagcctcccgaagtgctgggagccaccgcgcccagcccaacacctgcactttcatacatactttaatgtttacatacatttaaagaaagacaggccgggcacagtagctcaagccaagacgggaggatcacttcatcccaggagttcgagaccagcctgggcaacagagtgaaaccccatctttataaaaaatgataaaactagctgagtgtgtccctgctacgtgggaggctgagattacagcatcatttgagcccagaattttgagggagcagagaaccaagaatgtaccactgcacttcagcctgagcaaccgagtgagaccctgtcttgaaaaaaaaaaatagataaaataagaaagagaaaagagggccagacgtggtggttcacacctgtaatcccagcactttggggggccgaggcaggcgcatcacctgaggtcaggagttcgagaccatcgtggccaacatggtgaaaccccgtctctactaaatacaaaaattagccgggtgtgttggcaggtgcctgtcatcccagctacccgggaggctgaggcaggagaatcgcttgaacccaggaggcggaggttgcagggagccgagatcgcgccactgcactccagcctgggcgacagagcgagactctgtctttaaaaaataaaaataaaaaataaaaaagtgagacaggaggaagaagttcaaggctctttacagcctgtgactgtggtttataggaacagtgtcttactggtaaattgccagcacactagatctgaagtcttctccccacacacacacacacaattcgtagatgagatgctgaatgggataattggcttgatttaatgatgacgcatgtatacatatgtcaaaacatcccatttaacacatgaaattttatttatttatttatttatttgagacggagtcttcctctgccgcccaggctggagtgcagtggcacgatctcggctcactgcaacctcctcctcctgggttcaagtgattctcctgtctcagcctcctgggtagctgggattacaggcgtgtgccaccacaccacacccggctaatttttgtatttttagtagagatggggtttcaccgtgttggccaggctggtcttgaacttctgacctcaagtaatccacccgtctcggcctcccaaagtgctgggattacagccgtgagccattgcgcccagccttgctgtgaaattgtttttctttttttttttttttttgagatgccaaaggcgcctgcccccacgcctggctaattttttgtattttttttagtagagacagggtttcactgtgttagccaggatggcctcgatctcccgacctcgtgatccacccacctccgcctcccagccgtgaaatgttcagacccaggaacttttctcctccttgtcacctcttaccttcccctgcccacccagggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaaggtacctgtgtctgtctcctcaggccacatttcacaaatgagcctacacactcggcttaaatcaaagggaatttacttctcactgtcctggaggctggcagtctgaggtcaggttgtctcagggccatgctttctccgaaggttctaggagagggtccttcctgcctctcccagctcctgacagctccaggcatccctgggcttgtggccgcatcactccagtctctgccacgtcctccacgtggcctcatccactgtgtctgtgtctcctcctctgtctcttagaaggacacctgtcattggacttggagtccacccttcttcgtgatgatttcctcttgagattcttaattacatctgccaagacccctttttaaaacaaggtcccattcacagattctggggatcaggatatggacagatctttcaggaggaccacagttcagtccactacagatgtatccagttccttctggaggccccaggggagggtccttcctgcctctcccagctcctgggggctccaggcatccctgggcttgtggccgtatcactccagtctctgcctttgtctccacgtggccttctcctctgtgtctgtgtctcttctgtctcttagaaggacacctgtcattggattttgaggtctccctaatccactgactccaactcatctgaagtcccctagcttacttacgtctgcaaagacccttttttctttttctcttttttttgtttttgtttttgtttttgagacagagtctggctctgtcatccaggctggagtgcagtggcatgatctcggctcactgcaacctctgcctcccgggttcaagcgattctcctgcctcagcctcctaactgtggtcctcctgaaagatctgttcatagcctgatccccagaatctgtgaatgggaccttgttttaaaaaggggtcttagcagatgtaattaagaatctcaagaggagatcctgagtagcctcaggagtagcctcctgattacaggcgcccaccaccaagcccggctaatttttgtacttttagtagagacagggtttcgctatgttggccaggatggtctcgaactcctgacctcagctgatccacccgcctcggcctcctaaagtgctgggattacaggcgtgagccagcgcgcccggcctgaggccccatctttcagctgttctgttcaggggcccctcacggtggcagcctagaagggatgcagccctcccaacaccaggggtccctcacagggcgtcctccgggaagcagaggtggggatgtcgggtgcaggagggacgcaggctttgggagacagggagacgggctgatgacacctcctgccattcatcatcaggagagagaacatgcagtgaataaggaataaaggtggttacagcacattccgtctgtgcctctaatttaccaagtggtgattattaaatcaccaccaggtggtttataaacaacagacattgattctcccacagtcctggaggctggaggtccaagatcaacgtgtgggcagggctggttcctcctgaggcctctctcctgggcttggagatgctgtcttctccctgtgtcctcacagggtcgtccctgtgtgtgtgtctgtgtcctcatctccttttcttatagggaccccagtcctattggattagggtccacccaaatgacctcattttacctgaatcacttctttaaaaccctgcctacaaatacagtcacatcctgagggactggggggattaggagttcaacatctgggttttgaactcagtccatatcggcagcatgttgatttttctcccatgggctagtttttctgcatgatattcgttgatgtgctttttccttgtgtacaccttgttttatagctggggacttgatcctataaatccccaccgttctctgtgaaagaaggctcaatggccaagttgtatacttccgacagcgttggcctccatcttttgagtctgtgggagtagaaagtactggacaagggacttaatgagtctctctgcacttgcttttaacagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggtgacaggacccagcgggttttgctctgaggatctttgcaggtggaagtcactgagggaaggtgacctggagcctgggcagagcgaggaaggaggcccacaccttctgtccctctgccctcaggaatgctgcttttcccgaaaggttgagaagcagagggtgaatgacagagagggaacagtggcagccgcgagcacataggagaagcgtgacctccttatgggctctagtctcaaaggggctgtatcagtccatgttctcctgagaaacagaacccaatacggtgtacacagacattgatttagttgcttatttatttttatagacaaataacgtagatggatgggtagacagatacatagatagatgataaatgcatagatacattgatatagattgacgatagagagatgacagatacatagatgatgggtagagttgatatataaatggatggatggatagatggatggatggatggtaggtggatagatgggaggaaggatggatggatggatggatggatggtaggtggatagatggatgggaggagggatggatggatggatggatggacagatggattgatcaatggatggatagatacatggatgggaaggtggatggattggtggatcagtggatgggtggatggatgggtgggtgggtggatggatagatggatggatggagaggtggatggataaatggaagggtgggtagatgggtgggtaagtggatggatgggtggatggatgagtgggtgagtggatagatggatggatgtgtgaatggaaggatgtgtggatggatgggtggatgactggatggataaaggtgggtagatggatggatggatcgatgaatcggtggatgagtgcatagatgggtgggtaagtggatggatgggtggatggataagtgggtgagtggatgggtggctggatggatggatggacggacagatggatggatggatggatgtgtggatggatgggtgagtggatagatgtgtggatagatggatgagtgggcgtgtggatgggtgggcgtgtgaatggatggatgagtggatggatgggtgcacggctgggtggatgattgggagtgtgggtgaatagacggatgggtgggtggacagatggatgggagggtggatgaacagatatatcagtggatcggtggttgggtagctgggtgggggaatggatggatgaatgggtaggtgggtggttggatgggtggatggatgagtgggcatgtggatgagtgcatgaatggatggacgggtgcatggctgggtggatgatggggagggtgggtgaacagatgggtgggtgggtgggtggatggatggatggatgagtgattggatgggtgggggaatgaatggataaatggatgtggatggatggatgcatgcatgggtggatggatcagtggatccatcagtggatgggtggatggatgggtaggtgggtgggtggatggatggatggatggacagatggatggatgagtgattggatgggtgggggaatgaatggataaatggatgtggatgtatggatgcatgcatgggtgcatggatcagtggatccatcagtggatgggtgaatagatggatgggtaggtggatggatggatgagtgggcatgtggatgggtgggcgtgtgaatggatggatgagtggatggatgggtgcatggctgggtggatgattgggagggtgggtgaatagatggatgggtgggtggacggatggatgggaggatggatggatagatgtatcagtggattgctggatgggtagctgggtgggggaatggatggatgagtgggtagatgggtggatcggtggattggatgggtgggggaatgcatagatgagtgatgaatgggtggatcagcagatgggtgggtggatgactagatgggtgggtgagtggataactggatgggtgggtgagtgggtggatggatggatggatgacaatgtgttttctgaattgaacagaactcttcagcatggtgctagaatagagagcacatgaccaagtccttgagtagcctgggaagggcaggacaacagatgacacctgggcagaggtggctgtgcttctgtgattaggagacaaagcatgccctggttgaggctccaaaggctgtgcccttaccacagagacatgtgactatatccttagaggctggaacatagaagccagaacatcttccccagccagagcagttcaggaccattctcccgtattgaaaataatgatgaataggccacgcctgtaatcccagcacttggggaggccaaggcaggcagatcacgagttcaggagatcaagaccatcctggctaacacggtgaaaccccgtctctactaaaaatacaaaaaattagccgggcacggtggcgggtgcctgtagtcccagctactcgggaggctgagggaggacaatggcatgaacccaggagacggagcttgcagtgagctgagatcgtgccactgcactccagcctgggggacagagtgagactccatctcaaaaaaaattaaaaaattaaaagaaagaaaataatgatgaatatggagaaaggcttttcatcaccggcaccatgcaagcttgttccaactccttttgacaacgctttgtgcagttgagtcctaggagcagttccacgtctgcagaggctgctcctgcttcaccataggtctcatcatttattcatgatgaaaataaatgtcatctatctgactatagcaaaccgtacactcagggtcagctcggtgggaaaacagtaacatttcatcattaacatgaacacagggctgtttcttacataggaggaccggagtggtgcgaggccatctgtttccatatacgggtctccaccaacaacttctccaccttccagcctcccattctgtgggagggggcatcctggaagggagcttggggactgggtctatggacagctgacctgggcatgaagtgggtggagaatgaagttccctgtatcatttggggctctccagggtaacagaacccctaggatataacctaggagatttatcttgaggacttacgtgattgtgtaggctggcaagtccaaaatccacagggcaggccaggaggctggaagctcaggcaggagctgctgctgccatcttcaagtggaatttctcctccaggaaagcccaatgtttgcttctggggttttcaatgagctggatgaggccaatgcacattttggggggttaatctccttaaagtcaaactgatggtagatgcaaacgccagctacagcacacctccacagccacatctagatgggtgtttgcctgcataactgggaacttgagcgtggccacgatcatgaagaaaggatcagcctcagtgggtaacagttacagcagttgacagctggggcgtggtggctgctgttttcctgcccagctgaccctgagtgtacagtttgctatagtcagatggatgatgtttattttaacatctcaatgatgcatcccctatggtcaggtttccttgagtgtacggtttgctatagtcagatgggtgatgtttattttaacatctcaatgatacatcccctacggtcaggtttccttgggttttctcgttaggaggtcacacgactgtccccatttctccaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggtagcataacacccccgcggacacctttccgtctagcgtgcattttgctaaaacactttgacacacagatcagtaggcaccttgaccagtctgtctccagtctgacagatcccaaaggcttggctcgttctgcctggagaacttagtgccgtggctcttgtgtcactcagccctggaacaggtgcaacttagacatcctccactgttatccagcagctgatgaaaatagaatttcctcctagaaacaggtttgaaggccatgctcaggggctcacacctgtcactcccagcactttgggaggccaagttgggaggatgatttgagcccgggagtttgagaccagcctgggcaacatagtgagacccccatctctacaaaaaattaacagttaggctgggcatggtggcatgagcctgtaatcccagctagtttgggaggccaaggtgggctgatcacctgaggtcaggagtgcgagaccaacctggccaacgtgctgaaaccccatctctactaaaaatacaaaaaaaaaattagctggggatgatggcgcgtgcctgtagtcccagctactcaagaggctgaggcaggagaatcacttgaacccgggatgtggtggttgcagtgagctgagatcacgccactgccctccagcctgggtgacagagcgaaactccatctcaaaaaaaaaaaaaaaaattaacgattagccaggtatgattaggcagctactttgggaggcccaggtgggtgggaagatcacttgaacctgggaggtcaaggctgcagtgtaagccgtgatggtgctgctgcactccagcccgggtgacagaacaagactctgtctgaaaaatagaaataggaaggagttggacaggctgccttaaatgaatgccctgtttcttctttgcttcaatggaactgacacttgcttatctgaggccgctgtttgcaaagcgctccctgcatcctctcgcccctccttcccctttccccgcccagaaccttcctgaggtggacgtgtgagatatggtggggtccgtggggcctgtgcagatgggtgggtctcggtctgcagggctgtgccagccaggcgtggggagtctgctgtgggctcggctggccgtggcctcatgcctccttggcagcgctggccgagcttctgtggcagtgagcacggagtcagggtgtgtgtgtgtgatgcagagatgagccccagggagccgggggcttcctgcagatgttggggagagacatacagacagggagacacagagagagagataggcagacagaaagatagagggagacagagacagacagagatggaggcagacagagacagggagatagagggagacagaaacagggagacagaaagacagagacagagatagagtgagacagacacggagatgggagacagatagtgagatagggagagagatggagagacagggagacttgagagacagagggaggcggagacagagatagggagacagaaacaaagatggagacagacagacacatagagggagatgggagacagagacagggaggcttggagagacagagatagaggcagatagagacagaaacaggagacagacatagagacagagacagagggagatagaaagaaacagagacaggagacagaaacagagagagagaaagaggaagacagagacacacagacggagacagagacagacagacagagaccaagggagaaagagtcagagagagaagccagtggtggagaagccgagaggcacggacaggggccctgagctggcgtgagcagccagcgtgggcatcgcagaggacagatccctgagccccatgattgccacccacgcaggggagggccggggagcccccgcgagatttagggagccaggatggagaccggctgtcctgctgggagcggggctcagaagcatcctcagctgggcttgcttgccctgcagggacgggatgtccaggcgaaccctggacacagcactgagccaggatgagcctgggctcctctgggacccggggtaggtgccactggggggacttggagaagctcggaggagcttctcctctgcacaccagaattctcggaggagccccctctgcacaccgcaccattgtggtgaaggctgagccggggcacctgcagagacattgtggcttctctcctggttttctccagtgaggtgtttgtgggccacccggagcctccagggtgaaaagctttattgtgaaaagcctactgcgaaagtcagacgcttggagttcaggctgtggtgtggaccaagtgattccaaggagatcgtccaccactttggggtcctctgtccccagccagcccagcccccacacagacaagagtagcccacacagctgtggcatgaagcccgctctgcagcccaggcgcggctgagcccccacgctctggagccctgcacttctccccccgacccccagggagaggctgggcgagccctcgccccgtgttctctggtgcccctaagcacctgctgtgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggtgggtggcccccccgccagggctctccttactttcgtttattaagccacaggtatcttccctgctcaggacacctaccaactgcctttttccattgacaaacctgataacgacctgaaccgggccaggctgagtcccagatcatgggtggatattcccaagttccaggaggaccccggggatgcctaaatgcccccctagaaactccggggccctctcttttggctgcggagctgaggcagagcaccttggaacccctggattcccctcagcaagtctgattatatcctgactcaccctccaccccaccccagccctggacagtgggtggagcagtagacacattcccaagggctgctgggggatcggggcctgggacgattctcacaccatcagcttacatttccccaacctctgaatgcctctcctccttgtggtccagagtggctgctgtagcaccagccatcgtgtctgcatccccatggcaggaaggagaagggaggagtacagcccccacccctgggcagaaaggatttccctgtaggtctgtgccccctacacgtggcccagagtggctgctgtagcaccggccattgtgtctacatccccacggcaggaaggagaagggagtacagccctccacccctgggctggaaggatttccctgcaggtctgtgcccccacactcacctgcttgtacagtcttgtctgggataccagcgagctccccaccactggctttcccttccagcatgggaatcaatgccatgcccttgaacattacttctgccccagttgagctttggagagtcgtcagagttccatagacgacccagccacagagcatgcatttgcttccccgcaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgagccctcctcctgttcaccctgctaaccttttccagactgcagcatctctttctagacagagggcatggctgtgtgtgcacctgtgtttctgcctgggcgtttccatggtgggtatgtgtgtgcaaatgggactgtctacggtgcttgtgtgtgtgtgtctctctgtgtgcatgtgtgtggtatgccctggagcatacctgtgacatggagcatgtctgtgcgtgagcatgtctgtgtgtgtgtgtgtctgcatccgcatgtgtgtgcacgtctctggtgtgtggttgcatatgtttctgtgagagtatgtgtgtgtgtctgtgtgggtatatgtgtgcatgtctgtgtgtgtgtgtctgcatctgtgtgcatgctgtgagccggtgggtgtctgtgtgcatatgactgtcgtgcttgtgtgtctgtgtgcatgtgtgtgtgtgtgcatgtctgtgtctgtatctgtgtgcatggtgtgtgtcttccgtgcatatgtaactgtgtgtgcacgtctgtgtagtatgtccttgtgtgtgtgtctgtgcatgagactgtgtgtccacgtgtctgcaagtctctgtggtgtgtggttgcatatgtttctgtgaggtgatgtgtgtgcatccgtgtggatatatgtgtgcatgtctgtgtatgtgcgtctgtgtgcccgtctgtgtctgcatttgtgtgtatgctgtgtgctggtaggtgtgtgtgtgtatgtgactgctgtggttgtgtgtccctgtgtgcatgtgtctgtgtgtacgtctgcatctgtgtgcatgctgtgggccggtggttgtgtgcatatgtgactgctgtggttgtgtgtctgtgtgcatgtgtctgggtgtgcttgtctgtgtgtctgcatctatgtgcatggtgtgtgtctgtgtggatatgtgagcatctgctgtgcttgtgtctgtgtctctgtgtgtttctgagtctgtgtgtgcacatctctgtgtggtatgtccttgcatgcgtgtctgtacgtcagaatgtctctgtgtctgagtccgtgtgtgtgtgtgcacctctgtggtgtgtatgtctctgagggtatgtgtgtctgcgtgtctgtggatatatgtgtacatgtctgtgtgtgcatgtctgtgtgcccatctgtatctgtgtgcatggtgtgtgtgcatgtcactgctgtgcttgtgtgtacgtctgtgtgtgcatgtgtctgtgtgtgcatgactgactgtgtgtggtatgtccttgtgtgtgcgtgcgtaagaatgtgtctctgtgtctgcatctgcgtttgtgtgtgtgcaactctctgtggtgtgtgcttgcatatgtgtgagggtatgtgtgtttctgtgcgtctgtgtgggtatatgtgtgtatgtctgtgtgtctgcgtctgtgtgcctgttggggtatctctgtgtgtccgtgcgtgtgcccatctgtgcatgtctgcatccgtgtgtgtgtgcctgtcgctgtatctgtatgtccatgtgtgtctgcgtgtccatctgtgcatgtctatgtttatgtgcgtgtgcctgtctgttggtgtatctgtatgtccgtgtgtgtgtgtgcccatctgtgcatgtctgcgtctgtgtgtgcctgtcactgtatctgtatgtccgtgtgtgtgtgtgtccagctgtgcatgtctgcgtctgtgtgcgtgcctgtctgttggtgtatctgtgtgtccgtgcgtgtctgtctgtgcccatctgtgcatgtctgcgtctgtgtgtgcctgttgctgtgcatgtctgcgtctgtgtgtgcctgtcgctatatctgtatgtccatgtgtgtgtgcccatctgtgcatgtctgcgtctgtgtgtgcctgttggtgtatcactgtgtgtccgtgcgtgagtgtgcccatctgtgcatgtctgtctctgtgcgcgtgtgcctgtcactgtatctgtgtccgtgtgtgtgtgtgtgcctgtcttgctgtatctgtgtgtccatgtgtgtacctgtcagtgtatctgtgtcctgcatgtgtccgtgtgtgcatgtcttgtggcgtgtgcttgcatgtgtgcctttgtgtctgcatttctgtgcatctggatgggtatatgtgtgtgtgcctgtgtctgtgtctgtgcgtccgtgggtctgcctgtgcgtgtctctctgcgggtccacacagacacgagggcatctccaaacaggtggacaaggctgggcacagtagctcacgcctgtaatcccagcactctgggaggctgaggcgggcggatcccctgtggtcaggagttcgagaccagcctggccaacatggcgaaaccccatctctactaaaaatacaaaaattagccgggcgtggtggcgggcgcctgtaatcccagctactcaggaggctgaggcaggaaaatcgcttgaacctgggaggcggaggttgcagtgagctgagatctcaccactgcactccagcctgggcaacaagagcgaaactccatctcaaaaaaaaaaagacaatgataataataatgataaataaaaataaacaggtggacgactgtgtgaagttatcatcagtgcaagtagccgagacgtgaggggagtggagatggggaacagccgagatcagcattcatgggcatccacggtgccgaggtcacggaaggaactgacccgagagccgtcacagtgtggccttaggttagacttgaaggagaacttccaggtggcagctgctgaggccaggacggattgacaggagacgcctggaatcccagccctctgggaggctgaggcgggtggatcacctgaggtcaggagtttgagaccagccagagcaacatggtgaaaccccatctctactaaaattacagaaattagccaggcatggtggcgggtgcctataatcccacctattcaggaggctgaggcaggagaatcgcttgaacccgggaggcggagcttgccgtgagccgagatcgcgccactgcactccagcctgggcaacacagcaaaactccatctcaaaaaaaataaaaaaataaaaaaagagacagctgacgtgctgtaactcagcaccatccgacagcggccaggcctgtgggcacaggtgctggggacctccacaaccctcccccagaggttcctggatgcttttctcgtttttaaaaaaacaaaacgcaaccaccctacagctcctcctgcaggacatcatgatagctgtgcttctgatttgccagatctgcagagacagaaatgctgaaatttatttatgtttgaatggtgtctcgctctgtcacccaggctggagtgcagtggcgtgatcttagctcactgcaacctccacttcctgggttcaagggatcctcccacctcagcctcccgagtagctggggtgacaagtgcccgccaccacgcctggctaacttttgtatttttagtacagatggggtttcaccatgttggccaggctggtctcgaactcctcacctcaggtcatccacccgtcttggcctcccaaagtgctgggattacaccccgcccggccggaaatgctaaagtttaaaatcatgagccctgaaagagcaccttctcctcgcagctgggggaaaacagctctggagacttcccaccgcacactctcccgccccttctttcccctcatgcaactcacagcttgctatttatcctctccctgtcctgcagaccggaggtctgagatcaaggcatctcagggctgtgctccctctggaggctctaggggaggatccttcctgcctctcccagctcctgggggctccgggtgtccctgggcttgtagccgcatcactccagtctctgcctccatctccacgtggccttctcctctgtgtgtctcctcttctgtctcttagaaggacacctgccattgcatttagggcccaccctactccaggatgatcccatctccagatccttaattacatctgcaaagaaactttatccaaatgaggtcccattcccaggttctggggcttaggacttggacagatcttttggacgtcaccacccaacccattgcagttgtgtttgattctttctgagaggctctaggggaggatccttcccgcctcttccagctcctgggggctccaggcgtccctgggcttgtggccgcatcactccagtctctgcctccgtctccacgtggccttctcctctgtgtctgtctcctcttctgtctcttagaaggacacctgtcattggatttaggggacaccctactccaggatgatctcattttgaaattctttactcaatgacatccatagagaccctatttccagataaggtcccattcccagcgactgagggtcagcacctgaatatatcttttaaggggacaccattcactgcactacagcagaccatctttttatttcagcaattacagaggggcgtgcagctacatgcgccccccgcaacaggcaaccctcctggggcgcctgaatcaggggatcaccagagaaggccctgccattgcccactcaccggcagtgcggccccgactctccctggcacacgcccatgtgcgccgactctgcctgcctcgcccaggtgctgcccctgaattccctgcttttttcctcccttgccttcttgtcgcccaggctggagtgcgatggcgcgatctcggctcactgcaacctccacctcccaggttcaagcgattctcctgcctcagcctcccgcgtagctgggatgacaggcgcccgccacccctgtccagctaatttgcatttttagtagagatggggtttcgccgtgttgcccaggctggtctcgaactcctgagctcagacaatctgcccacctcaggctcccaaaatgctgagattacaggtgtgagccactgtccccagcgttttctcagcccgagtcaaaccgcacgggcgtgacatcactaaccagctcctcatggagctctgttcaagtccccacggggatgtacttcaggaagacccattcccgcccacacccctctcttctctgtccctgatttaggatgcgggtggccgtcccaggatctgtccggggaggactgcttcttccatacctgacggacgtatctcgttttgtctttaaaccaggtgactttttcagggaccccctccccagcgctgagctgtacgtcctgtgccggatcctgcatgactggccagacgacaaagtccacaagttactcagcagggtcgccgagagctgcaagccaggtgagagcccatcgtcaggttagctgtttttgttaagacgtagtattttgggttcaagttttacaaggaggccgggcgcggtggctcacgcctgtcatcccagcgctttgggaggccgaggcgggcggatcacctgaggtcaggagtttcagaccagcctggccaacgtggtgaaaccccatcgctactaaaaatacaaaaattagccaggcgtggtggctcatgcctataatcccagcactttgggaggctgaggcaggtggatcacccggggtgagcagttcgagaccagcctggccaacatggtgaaaccccgtctctactaaaaatacaaaaattagccaggtgtggtagtgcgcacctgtaatcccaggtacttcagaggctgaggcaggagaatcacttgaacccgggagctggagactgcagtgagccgagatcgcgccactgcactccagcctgggcgacggagtgagattcggtgtcaaaaaagaacaaccacaacaaaaaaagaattggcttatgtgactttggaggttggcaggtccagcgtctgggtgagaggcccgctaaattgtggagggtaaatctgctgtatttaaagttggccagtgtggccaggtgtggtggctcacgcctgtcatccccgcacttcgggaggccgaggcgggcggatcacctgaggtcgggggtttgagaccagcctggccaacatggtgaaaccccgtctctattaaaaacaaacacaaaaaataagccgggcttgatagcgggtgcctgtaatcccagctactcaggaggctgaggcaggagaatcgcttgaacctggagacggaggttgcagtgagccgagactgcgccaccgcactccagcctgggtaacagagcgagactccatctcaaaaaaaaaaaaaaaaaaaaaaaagaaaatcctaaagagaaaatatatttactattcgtgaagttgaagtggctcatgataaaagtcttcattcttgaggaggtcttcacactgaggaggctgcagaggaggaagccgtgggctggtgttgctgtctcaggggtggccgaggcagagggaaatccacgcatgagtggactctgcagctggatctaatctgtgtgtttctacgcagacacacgtgcacacacacacagcacgcaccatctcggctcaaagccttcacatcaggtttctcccccgtccacccaggctgctcctggagcccagtggggctgctggaaaccctggctccaggggttcgggccagggctgcatattgggtttccacagttgaaccagctggccctgagggaatctgacgggcactcagcctccctcaagagttcagcgttgttgctccagtgagaattcctggaatatttgcagacaacggttaattatcttcacagagccagggcctggcacctgcgcgttgaaacaggactccccataggctcaaatggtcaagagacttccattcttctctccctctgtctctccttctttctctctttctctgtgtatctctcttcttttttttttttgagacggagtctcgctctgtcgcccaggctggagtgcagtggcacgatcttggctctccgtaacctccacccccagggttcaagtgattctcctgcctcagcctcccgagtagctggattactggcacataccaccacgcccggctaattttttatttttaatagagacagggtttctccatgttggtcaggctggtctcgaactcccaacctcgggtgatccacccagctgggactcccaaagtgttgggattacaggcgtgagccacctcgcccggctctattatattttttgagacgaggtctcactctgctgcccaggctggtgtgcagtggagcagtcacaggtcactgcagccttgacctcctaggctcaagctgtcctcccacctcagcctcccgagtagctggaagtacaggcatgcatcatgcatcaccatgcccagctaattttttaagaagttttttctgagaccgggcacggtggctcacacctgtaatcccagcactttgggaggccaaagcgggcagatctcgaggtcaggagttcgagaccagcctaagccacgtggtgaaaccccgcctctactaaaaatacaaaaattagtccggcgtagtggtgcacgcctctaattctagctactcaggaggctgagagaggacatcacttgaacctgggaggcgaaggttgcagtgagcagagatcgcgccactgcactccagcctgggcaacacagcaagactccgtctcagaaaaaaaaaaaaaagttttttgtggagataggagtccccctctgtcacccaggctggagtgcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagtgcagtgttgtcatcatagttcactgcagccttgacctcctgggctcaagcgatcctcctgcctcagcctcccgagtatttgggagtagcagcatttggctggagtgcagtgttgccatcatagttcactgcagccttgacctcctgcactcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggactgcagtgttgtcatcatagttcactgcagccttgacctcctgggctcaagcgatcctcctgcctcagcctcccgagtatttgggagtagcagcatttggctggagtgcagtgttgccatcatagttcactgcagccttgacctcctgcactcaagcgatcctcctgcctcagcctcccgagtatttgggagtagcagcatttggctggagggcagtgttgtcatcatagttcactgcagccttgacctcctgggctcaagcgatcctcctgcctcagcctcccgagtatttgggagtagcagcatttggctggagggcagtgttgccatcatagttcactgcagccttgacctcctgcactcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggactgcagtgttgtcatcatagttcactgcagccttgacctcctgcactcaagcgatcctcctgcctcagcctcccgagtatttgggagtagcagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgcactcaagcgatcctcctgcctcagcctcccgagtatttgggagtaccagcatttggctggagggcagtgttgccatcatagttcactgcagccttgacctcctgcgctcaagcgatcctcctgcctcagcctcccgagtatttgggagtaccagcatttgttatcatgccctgttagggttttttaaattttgtagagatgggatcttgcgatgttgcccaggctacccttcctgggctcaagcgatcctcctgcctcagcctcccaaaatgctggggttaaagacatgagccactgcacccggcctctgtctctctttctctctcttctccctcttcctctctgtctcctcctctctgtgtctttttaggtatctcatctatcatcatcaatctctgtttctcttctctcctccttcctcctttatcttctctgtctcttcctccctctctccaccctgtctctgtctctctttatacatctatcatccttttttaaaaaaaataaaatagagacagggtctcactatgttgctcaggttggtttcaaactcctgggctcaaaccatcctcccacctctgcctcccaaagtgctgcgattacaggtgtgagccactgcgtctggccttctaacaatgctccgtcacctgtcatctgtctatcatttattatctatccatccatccatcatctacctacccatcatctaccatatattcacccatccatccatctcatccatgcatccatctatccatctattcatctatctacctatcatctaccatctattcacccatccatccatctcatgaatgcatccatctatatccatccattcatctacctacctgcccatcacctaccatcaatacacccatccatctcatccatctatccatccattcatctacctgcccatcatgtaccatctattcagccatccatccatctcatccatgcatccatctatccatccatccatctacctacctacccatcatctaccatctattcacccagccatccatctcatccatgcatccatctatatacatccattcatctatctacctacccatcatctaccatcagttcacccatccatccatccatctacccatcatctaccatcagttcacccatccatctcatccatgcatgcatccatccatccatccatctacctacccatcatctaccatctattcacccatccatccaatccatgcatctatccatccattcatctacctacccatcatctactatctattcacccatccatctcatccatgcatccatctattcatctatctatgtacccatcatctaccatctattcacccatccatccatctgttccatgcacccatctatccatccattcatctacctacccatcatctattatctattcacccatccatccatctcatgcatgcatccatgtatctatccattcatctacctacctacccatcatctaccatctattcactaatccatccatctcatgcatgcatccatctatccatccattcatctacctacttaaccatcatctactatctattcacccatccatccatcacatccatgcatccatctacctacctacctatctattcacccatacatccatctcatccatgccatctatccatccatccatccacctacctacccatcatctaccatctattcaagcatccatcacatccatacatccatctatccatccactcatctatctacgtacccatcatctaccatctattcacccatccctccatccatctcatccatgcatccatctatccatccattcatctacctacctacccatcatctaccatctattcacctatccatccatctcatccatgaatccatccatccatctacctacctacccatcatctaccatctattcacccaaccatccatctcatccatgcacccatctattcatcttcctacctacccatcatctaccatctattcacccatccatccatctcatccatccattcatctatctacccatcatctaccatctattcagccatccatccatctcatccatgcatccatctatacatccatctacctacctacctacccatttattcacccatccatccatctcatccatgcctccatctatccatccacctacctacccatcgtctaccatctattcacccatccatcacatccatacatccatctatccatccattcatctatctacgtacccatcatctaccatctactcatccattcatccatccatccactcatctacctacccatcatctaccatctattcacccatccatctcatccatgcatccatctatccatccatccatctacctatgtacccatcagctaccatctattcacccaaccatccatctcatccatgcatccatctattcatcttcctacctacccatcatctaccatctattcacccatccatccatctcatccatacatccatatatccatccattcatctatctacctgcccatcatgtaccatctattcacccatccatccatctcatccatgcatccatctatccatccattcatctatctacctacccatcatctaccatctattcacccatccatccatctcatgcatgcatccatctatccatccatccgtctacctacctacccatcatctatacacccatccatctcatgcatgcatccatctatctatccactcatctacctacctaaccatcatctactatctattcacccatccatccatcacatccatgcatccatctatacatccatctatctacctacctacctattcacccatccatccatctcatccatgcctccatctatccatccacctaacgatccatcatctaccatctattcacccatccatcacatccatctatccatccactcatctatctacgtacccatcatctaccatctgttcacccatccatccatctatccatccattcatctatctacgtacccatcatctaccatctattcacccaaccatccatctcatccatgcacccatctattcatctacctacctacgcataatctaccatctgttcactcatccatccatctcatccatgcatccatctatccatccattcatctatctacgtacccatcatctaccatctattcatccattcatccatctatccatccactcatctacctacccatcatctaccatctattcacccatccatccctctcatccatgcatccatctatccatccatacatctacctacgtacccatcagctaccatctattcacccaaccatccatctcatccatgcatccaactattcatcttcctacctatccatcagctaccatctattcacccatccatccatctcatccatacatccatatatccatccattcatctatctacctgtccatcatgtaccatctattcacccatccatccatctcatccatgcatccatctgtccatccattcatctacctacccatcatctaccatctattcacccatccatccatctcatccatgcatccatctatccgtccattcgtctacctacctacccatcatctatcatctatacacccatccatccatctcatgcatgcatccatctatccatccattcatctacctacttacctaaccatcatctactatctattcacccatccatccatccatctatacatccatctatctacctacctacccatctattcacccatccatccatctcatccatgcctgcatccatccatccatccatccacctacctacccatcatctaccatctattcacccatccatctcatccatgcattcatctatccatccattcatctatctatgtacccatgatctaccatctattcacccatccatccatccatctcatccatgcatccatctatccatccattcatctacctacctacccatcatctaccatctattcacccatccatctcatccatgcatccatctatccatccatctacctacgtacccatcatctaccatctattcacccaaccatccatctcatccatgcacccatctattcatcttcctacctacccatcatgtaccatctattcacccatccatccatctcgtccatgcatccatctatccatccgtctacctgcccatcatgtaccatctattcacccatccatccatcacatccatgcatccatctgtccatccactcatctacctacctacccatcatctaccatctattcacccatccatccatctcatacatgcatccatctatccatccatccatgtacctccccatcacttaccatctgttcatccatccatccttctcatccatgcgtccacctatccatacatctttctacctacctacccacccatcatctaccatctgttcatccatgcatccaggagaaccggaaaaggcccaggtgatgcatccatctatccatccatctttcgatcaaatctccttctccctgtctgtccgccctgcatcaagtctctgtctctctcccctcccctacctgtgtgggccccctggccaagggttctcagcagcctctgctcaccgttctgagctcctgttgcctgctgtgtcccctgtgtcctgctgaaggatccccgcctggctggccaggactccagctctctgctgtctccctcaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcct

SEQ ID NO: 4159 - DNA, 49788 bp, human
ctggccgcctgttttttttgcagccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcggtacggcctgggcctgggcggggcaggggaccggggacggaggggctgaaccccggagggcccagcgactcaggaactctagggatagggatgggagagtgacccgagacccttagggatgggggaggggagagtgtcccgggacctccagggatagggttggggagagtgacccggaacctctagggatgggggaggggagagtaacccggaaccccctaggcatgggggtggggagtgacctgggtccccatagggatgggggaggggatcgtaacccgggacccctaggaatggggagggtagagtgacccaggaccgctagggatggggacagcagagtgaccccggagccccatggatggggatgaggagagtaacccgggacccccaggcatggggatggggagagtaacccgggacctccagggttggggatggggagagtaagccgagaccccccctagggatgggggtgggggagtaacccgggacccctagggatgggggagaggagagtaacccgggacccccaggcatggggatggggagagtaagccgagacccccaggaatggggttggggagaataacccgggacccctagggatggggttggggagagtgacccaggaccccctagggatgggggaggggagagtaacccgggacccccctaggggtgggggaggggagagaaacccgggacaccttagggatggggttggagagagtaacctgtaacctgggaccccctagcgatgggggtggggagagtaacccaggacgccctaggcatgtggttggggagagtgacccgggaccccctagggatggggagggaggagtgacccaggaccgctagggatggggacagcagagtgaccccggagccccatggatggggatggggagagtaacccgggacccccaggcatggggatggggagagtaacccgggacctccagggttggggatagggagagtaagccgagacccccctagggatgggggtggggagagtaacccgggacccctagggatgggggagaggagagtaacccgggacccctaggaatggggaggtcaagtgacccgggacccccctagggatgggggtggggagagtgacccgaaacccctaggcatggggttgcagggagtgacccagaaccccctaggaatggggatgggagagtaacctgggaccccctagggatgggggaggggagagtaagccgggatccccctagggatgggggtagggagagtaacccgggacccaaaaggatgagggaggggagagtgacctggaacccctaggcatggggttggggagagtgacccaggaccccctagggatgggggagggaagggtgacccgggacccccaaggaatggggaggggagagtgacccaggaccacctagggatggggaaggggagagtaacccaggaccccctagggatgggggtggggagagtaacccaggacgccctaggcatggggttggggagagtgacctgggacccccttagggatggggagggaggagtgtcccaggaccccctagggatggggagggaggagtgtcccaggaccccctaggaatggggaggggagagtgatccaggaccgcctagggatgggggaggggagagtgatccggaatccctaggtatgggggaggggagagtgacccaggaccccctaggaatggagaaagcagagtgacccgggacccctagggatgggggaggggagaataacccaggacccctagggatgggggaggggagagtgagccaggaccccctaggaatggggagggcagagtgacccgggacccatagggatgggggagggcagagtgacccgggacccctagggatgggggaggggagagtgatccagtaccgcctagggatgtgggtggggaaagtaacctgggacccctagggttgggggaggggagagtaacccgggaaccctagggatgggggaggggagagtaacccagaacccctagggatggggttggggagtgtgacccggaaccccctagggatgggggaggggagagtgacccagaacccctagggatgggggaggggagagtgacccagaacccctagggatgggggaggggagagtgacccagagcccctagggatgggggaggggagagtgacccaggatgccctagtgatgggggaggggagtgtgatccaggacctcctagggataagggaggggagagtaatccaagacccctaggaatgggggaggggagagtaacccgggaccccctaggggtgggggaggggagtgacctgggacccctagggattggggaggtgagtgactcaggacttctagggatggagtgggccctgtgactgatggttggactttgtagctggggtatgggaagtgtttcctggtgcccccatgaggatcttattccgggtggtaggacgcctaggtagtgggtgtctgcctctctctggagccctaatcacatggaggagacggtctagtgatgaagggatagttacttgtgatggggggtagttactggtgacaggcggatagttataggtgatgtgggatagttactggtaatggggtgatagttactggtgatgggatagttactggtgatgggggcatagttactggtgatggaaggatagttactggtgatgggggatagttactggtgatgggagatagttactggtgatggggcgtagttaccggtgatgagggatagttactggtgatgatggggcatatttactggtggtgggggttagttactggtgatggtgggatagttactgggtttgatgatggggcatagttattggtgatgggggtagttactggtgatgtggggatagttactggtgatgggaggatagttactgttgatgggagatagttactggtgatggggggatagttactggtgatgatggggcatagttactggtgatgggggatagttactggtgatggtggatagttactggtgatggggggtagttactgggtttgatgatggggcatagttactggtgatggggggtagttactggtgatgtgaggtagttactggtgatggcagagaagttactggtgatggtagggtagttactggttgcctatggatggtgcagtggggcaggagtctactcttggggactacggactggaggtctggtaccctgggaggggggacaccacatgcctggtcctagtgacggggatgagagtggtcagggtgcctcacagaaggcatgggtctccatgattgggggtgacagggcatagggcaggggtctatatgatctggggttgagatctgcagggcaggtccagggcttggtgactggtgccctgaagaccaggatgggcgtcagggccaggatctgggggcaccttcaagaggtgaggagcgctgaggagtgtagaagagtggaagaaagacgaaaaaagaaaagcagcttcacagtcaaagacgggtttattttggagaacaagcctgagcggggcttctggctgagttaggtcaggagtgttctctcttacagactaagggtatttaagggtttaggaaggggaatcttatcgcaggctcggaatgtttccctgtgaggcaaagttgactgaggtgttagaatgtctctggtctgaaggaggttatcttgggcttgggatgtttctggtcagaggcggtttatttcaggctttgactgtttctggtcatgctgacattagccattaggctgatgttttggggctggttttaggcagtttttaatcacgggaacttaaaatggcaatgcttgtccaagatggcggtgtgtgtccaagatggtggtgtgtgtcaaagatgaccatgcatgtccaagatggcagtgcttgtccaagatggtggtgcttatccaagatggcggtgtgtgtccaagatggtggtgcttatccaagatggtggtgtgtgtcccagatggtgtgtgtccaagatggtggtgcttctccaagatggcagtgtgtgtccaagatggtgtgtctccaagatggtggtgcttatccaagatggcggtgtgtgtccaagatggtggtgcttatccaagatggccgtgtgtgtccaagatggtgtgtgtccaagatggtggtgcttatccaagatggcagtgtgtgtccaagatggcggcatgtgtccaagatggtggtgcttatccaagatggcagtgtgtgtccaagatgttgtgtgtccaagatggtggtgcttttccaagatggtggtgtgtatccaagatggtggcgtgtccaagatggcggtgtgtccaagatggtggtgcttgtccaagatggtgttatgggtccaagatggcagtgtgtgtcccagatggtgtgtgtccaagatggtggtgcttatccaagatggcggtgtgtgtccaagatgttgtgtgtccaagatggtggtgcttatccaagatggcagtgtgtgtccaagatggtgtgtgtccaagatggtggtgcttatccaagatggcggtgtgtgtccaagatggtggtgcttatccaagatggcggtgtgtgtccaagatggtgtgtgtccaagatggtggtgcttatccaagatggctgtgtgtgtccaagatggtgtgtgtccaagatggtggttcttatccaagatggcggtgtgtgtccaagatggtgtgtgtccaagatggtggttcttatccaagatggcggtgtgtgtccaagatggtggtgcttttccaagatggtgttgtgtatccaagatggcggtgtgtccaagatggcggtgcttgtccaagatggtgttatgggtccaagatggcagtgtgtgtcccagatggtgtgtgtccaagatggtagtgcttatccaagatagctgtgtgtgtccaagatggtggtgcttatccaagatggcggtgtgtgtccaagatggtggtgtgtgtcaaagatggccatgcatgtccaagatggcagtgcttgtccaagatggtgtgtgtccaagatggtggtgcttctccaagatggcggtgtgtgtccaagatggtgtgtctccaagatggtggtgcttatccaagatggcggtgtgtgtccaagatggtgtgtctccaagatggtggtgcttatccaagatggccgtgtgtgtccaagatggtgtgtgtccaagatggtggtgcttctcccagatggcggtgtgtgtccaagatggtggtgcttctccaacatggccgtgtgtgtccaagatggtgtgtgtccaagatggtggtgcttatccaagatggcagtgtgtgtccaagatggtggtgcttctccaagatggccatgtgtgtccaagatgttgtgtgtccaagatggtggtgcttatccaagatggcggtgtgtgtccaagatggtgtaatgggtccaagatggcagtgtgtgtcgaagatggcaatgctcctgctctgtgaatccagaccctctagttataacaggacgaggggtggtgtgttctttctggccacttcctgctgagggaggtggttattacgggtcaccaaacacagccctggaggggaagaggttgatttgttcctggtagcactctttaggggccttccaagcagcacccgttgaaacatctagcttttagttcacagggctttaagaaagcagaacttgggtttcagaggttttcagttaggaaaaattggagaaaaagaaaaaggaaaagaatgcaaaacattatcttggagacatgtagccagaaaaattagaatttaattcaaaccgtagaaaagaataaaaactgaaaaccattaggcaagactagaatttcacgacaggggtaactatagtttttcaaacacgatttttctttttccagttttcccacttttattaaaagacaaattatgggctgggcatggtggctcatgcctgtaatcccagcagtttgggaggccgaggttggcggatcacgaggtcaggagatcgagaccatcctggctaacatggtgaaaccccgtctctactaaaattacaaaaaattagccgggcgtggtggcgggcgcctgcagtcccagctacttgggaggctgaggcaggagaatcgcttgaacctgggaggcagaggttgcagtgaaccgagatggcaccactgcactccagcctgggcgacagagcaagactccgtctcaaaaaaaaaaaaaaaaatgtcatgagatgtagggaccagccccacagggtcagtggatctctccctgtgtgcggaggcatgagagtgtagaaataaagacacaagacaaagagataaaagaaaaggcagctgggcccgggggaccactaccaccaagacgcggagactggtggtggtcccgaatgccaggctgcgctgatatttattggatacaagacaaaggagcagggtaaggagtgtgagccatctccaatgataggtaaggtcacgtgagtcacgtgtccactggacagggggcccttccctgcctggccgccgaggcagagagagagaggagaaggagagaaacagcttacgccattatttctgcttatcagacacttttagtactttcactaatttgctcctgctaactaaaggcagagccaggtgtacaggatggaacatgaaggcggactaggagcgtgtgaccactgaagcaaagcaccacagggagagggttaggcctccggataactgcgggcgggtctgactgatgtcaggtcctccacaggaggtggaggagcagagtcttctctaaacccccccagggaaagggagactccctttggtgaccccgtctgggcataacagaaggctcgcgctcgtcttctggtcgcacctcaccatgtcccctcagctcctatctctgtatggcctggcttttcctacattatgattctagagcaaggattattataagattggtataaagagtaattactaccaactaatgattaatgatattcatatataaccatatctaagatctatatctggtataactttctcgttttatattttatcatataccggaagagctcgtgtcctcggtctcttgcctcagcacctgggtgtcttgccgcccacaatgagaggtgcaacttgacatagggagggtagaagatagcctgagtatagggaacctcttgccatttcctggtgataaagttgtcaaggtccctgagaatttgcaagttaaaggtgctatgttcgggccatctgctgtcattatgtagtttgtattgatgccagactattgcaataaaaaattcaacactctggctttaggttcctctgtaagccaagtttggccaggttggaaaggagacatcccagagaggaggacataggaatgtcgggttgtttggcacccacgtgggctggtaaaaggaagccgagagtgtctgtttgtgttttaggcaaccccagacaaaagacagagacccagaatcctctttataaggaggacggccaagctgagaagatactgggcatccctcaagatcgcttctagcttagtgccgctggtcctccgaggactgggatggccgacctgacttttcctgggtaccaaaagtcagaggagggcagatcttaccagacggctggatttgtgtctgatgttggatgttcctgttggaattggcaaaggggctcccaaactggagccgcgcagggaagacagagagagagagagaagagggaagaagacggacgaagagagaggaagacgaagcaagggttagggagcgaaatacctgttgcagggggtcagaggtggatttctgagacctgagggttttgagaaccctccagcttgagcctctaagtcccctttacatgagttgtcttcctcacacaaattgcttggaaggtgaatggagagaaaagatgggaggggtggccagagaccctcacgatccaggagttagcccaggatgagctgctgctgcccacagcttcctgggttgcaagagaacctccactcccaacactcaaagagggagagagagaaaggacagggtcagagggccagaggctctaaaggatccaggagttagcccgggacaggctgcccctgcccactgcatcctgggttgcaaaagggcctctgtccgtaacacctgtcctgggtttcggcaccaaatgtaagagtttaagaaggaggaaacaaatatagaaagtgagcctgggcgcagaggctcacatctgtaatcccagcactttgggaggccgaggcgggcggatcacctgaggtcaggagttcgacaccagcctgaccaacatggtgaaaccccatctctattaaaaatacaaaaattagccgggtgtggtggcgcccacctgcaatcccagctactcgggagactgaggcaggagaatcgcttgatcctgggagatggagcttgcagtgagccgagatggcatcactgcccctccagcctgggcgacacagcgagactccgtttcaaaaaaaaaaaaaaaaatacaaaaagtggctcagcaaagggttttggaaaagggggcttctcgcaggctcggaatgtttctgtgtgagggaaaattgattgcggggttggactgtctctggtcggaggggaggtttctggtcacagaggggtttatcccacggctggaatgtttctggtcatgctgacattagccattaggctgatgtttgggggctggatttaggcagtttttaatcaagggaacttaaaatggaagtgtgtgtccaacatggcagtgtctgtccaagacgggggtgtctgtccaagatggcggtgtgtgtccatgatgggggtgtctgtccacgacggcggtgtctgtccacgatggtggtgtgtgtcctcgatggccaaaatggcggtgtgtgtccacgatggtgtctgtccacgatgggggtgtgtgtccacgatggccaagatggcagtgtgtgtccacgatgatgtctgtccacgatgggggtgtgtgtccacgatggccaagatggcagtgtgtgtccacgatggcggtgtgtgtccatgatggcggtgtgtgtccatgatggcggtgtctgtccacgatggcggtgtctgtccacgatggcggtgtctgtccaagatggcggtgtgtgtccatgatggcggtgtgtgtccaagatggaggtgtctgtccaagatggcggtgtgtgtccacaatgacactgtgtccatgatggccaagatggcggcatgtgtccacgatggtggtgtgtgtccaagatggcggtgtctgtccaagatggcggtgtgtgtccaagatggcggcgtgtgtccaagatggcggcgtgtgtccatgatggtggtgtgtgtccaagatggcggtgtctgtccaagatggcggtgtgtgtccaagatggcggtgtgtgtccaagatggcggtgtgtgtccatgatggcggtgtgtgtccaagacggcggcgtgtgtccacgacggcggtgtgtgtgcacgacgacggtgtgtgtcccagatggcagtgtgtgtccacgatggcggtgtgtgtccacgatggcggtgtgtgtccaagatggcggcgtgtgtccacgacggcggtgtgtgtccacgacgacggtgtgtgtcccagatggcagtgtgtgtccacgacgacggtgtgtgtccacgatggtggtatgcgtccaagatggtggtgtctctccaagatggcggtgtgtgtccaagatggcgatgcttttgctctgtcagaggggagatggtcagaggggagatgcggagttccctgcaccctggcagggtgtggcagccaggggctcccccactggaggcatttaccaccatcattcctgaccccacggtctctgcaggggtcactacctctaggccaggcctccccaggggcggtgttgtctcttcctgggtaccagggattgacgtagagccatcattgtctcccttcccacagccatcattgctggcgtttttcctgaatttcctgtgggcaggttgggttttgtactctgccccaaccttcaggtctctgggaatcctcggacactgttggctcgtgggttcaaggcccgagtcaatacctccctgctggcctctttgttcctggcttcttcctttgccaatctcttccctcgagagccaagaaggcccctggtcagtccctgaaggcccctggtcagtccgcggcccactaaccacacttagggaaagccctggtcagtccccggctccccagccacacttagggaaagcttggcggatggatgagctcacctgggacagggtcggggagtgtagcaaacgctatgtgcgtcctgcaaatcttgcatgtcccattcacttttcatagggtctttcattgacccttctgaccccttttctactgttgcagggtctcaggtttgaggtggtcccctccaagtttaaagagaagctggacaaagcctccttcgctactccgtatgggtacgccatggagaccgccaagcagaaggccctggaggtggccaaccggctgtaccaggcaaggggcccctgcccttcggcccttatgaaaattcctttgctgtgatgaggggatttgcgggtggtaaatatacatgacacaaataaacgtcattcaaaagatgcagttggtggcacagcttagctattgctatgttataatgtaatgcactattgcagtaacctaataataccattaatgatacagaattaatggagcttatctgttactgtgtgttataatattctcttgcaattgatacagtatcattgatgatatacaattaatgtagcttatctgttactatgtgttataataatttctcgcaattgatacagtatcatttatgatatacaattaatgtagcttatctattactatgtgttataatatcctcttgcaattgatatcatagtatcattgatgatacagaattaatgtagcttatctattactatgtgttataatattgtcacaattgatatcacagtatcatttatgatatagaattaatgtagattatctgttactatgtgttataatattctcttgcaattgatttcatagtatcatttatgatatagaattaatgtagcttatctattactatgtattataatctcttgtggccggtcgcggtggctcatacctataatcctagcactttgggaggccaaggcggacagatcacctgaggtcaggaattcgagaccagcctgaccaacagggtgaaaccccgtctctactaaacatacaaaaattagctgggcgtggtggcgggtgcctgtaatcccagctactcaggaggctgaggcaggagaattgcgtgaacctgggagacggaagttgcagtgagccgagatcatcccactgcactccaacttaggcaacagagcaagacttcgtctccaaaaaataaaaaattaaaacaaaaattatcttgcaatcaatataatagtctcgttgatgatatacaattaatgtagcttatctattactatgtgttataatattctcttgcaattaatataatagtatcatttatgatatagaattatgtagcttattaccatgccactaagtaatatcggattttaattaaaataatatcatttataatatagaattatgcagtttatctgttgctgtatgctacaatgcaatatacaattataattaatatactactatcatttaagatttaagattcatgtagcttgttactatgtttgaatataatattgcaattaatatagtaatatcagttacgatatagaattaacatccattactatgtgttgtgatacatagaattaatatgttactgtgtgatactatgtaatatactatgacaattaatataattgtatcataatgtagaattatgtcatttatctgttactatatgctcctatgtaatacatattattttagtagagatggggcttcaccatgttggccaggctggtctccaactcctgacctcaggtgatccacccgcctcggcctcccggagtgttgggattacaggcgtgagccaccgcaccccaccgtaatacactattataattaatacactactgtcatttaggatgtacaattaatgtagcttatcaattactatatgttatatatgactctaacataatgtcagtcacagtatataaaattaacatagctattactgtgtgttttaacttgctgttacaatgaatataatgctatcatttaggatatagagttaatgtagcttccctgctgctgtgtgttaccacacaatataccattactgttaatataagaaatacattcggggccgggtgcagtggctcacacctgtcatcccagcactttgggaggccgaggcgggcggatcacgaggtcaggagttcaagaccatcctggctcacacggtgaaaccccgtctgtactaaaaacacacacaaaatattggctgggcgcggtggcgggcgcctgtagtcccagctactcgggaggctgaggcgggagaatggcgtgaacccgggaggcggagcttgcagtgagccgaggtcgcgccactgccctccagcctgggcgacagagcgagactccatctcaaaaaaaaaaaaaaagaaagaaagaaatacattagaggtaaggctgttgtgagtcgtgctatcaagacaggagtattgattgtgggttttggcagtgcacagcttagggaggccagtgcggggctgagctaaggtcaaagctgcacacagatgtcctgtgactgcctgttgctctgaggctgaattttcaacctggatttgttttatcgtcctaagtacctttttctttttctttcttttccttgtttttttttttctttttttttttggagactgagtctcactctgtcacccaggctggagtgcaggtgcgcaaccttggctcactgcaacctccgcctcctaggttcaagcgattctgctgcctcagcctcctgagtagctgagattacaggtgcccgactgatattttgtatttttagtagagacggggtttcaccatgttggccaggctggtctcgaactcctgacctcaggagatgcgcccgcctcggcctcccagagtgctgggatgacaggcgtgagccaccgcgcccagccctaagtagctttttctgaaattacattgaacggatcaaaaaccttttggccttaattctgggtaactcagggaggtttggggcccctgaatcaaaccttacctgccgcccggaagaacaaaagcttacggaacaggcattgcgtttcccgtagtgcccgtgagatgctccgtgagtgcctgacccctgatcacgcagcccccgtgggccccggcctcacccacgttccagcccctgcagggcgaccaccggcgggacccacttgtgtccttgctcgtgaccttgagcacccccagccttcacttccaaagtcggcctggcttcgcccctgcggtgctctttcacgcccgtaccgacgggaaaacttctctgtgagacccacggcacgtcaccggtaaaccggaatctggttttcttacagaaagacctgcgggcccccgacgtggtcattggagcggacacgatcgtggtgagtgcggccagggtgcctcgtttctaatgtccgatgtggttttcctgtgcttggtgattctgcctcttgtggatgttgtacattccccttaagacagcagtggactcgcttccagaaactcccatcacaaactaccagcagatgaggggcctaagggcacgggaaggggccaggcgccgtggctcacccctgtcatcccagcattttgggaggccgaggtgggcggatcaccttaggtcatgggttcgagatcagcccgaccaacacggtaaaaccccatctctactaaaaatacaaaaattagccagacgtggtggctaattgatagtatcataagtgatactatatgatatcaattgcaagagaatattataacacatagtaacagataagctacattaattctatatcatcaatgatacagaatacagactccgcctgtaatcgcagctactcgggaggctgaggcaggggaatcgctcgaacccaggaggcggggttgcagtgagccgagatcgcgccactgcactccagcctgggtgacaagagcgagactccgtctcaaaaggcacaggaaggtacgcagttctagaggccagcaaccacaaatcacggtgtctgtagggtttcttccttccagaggtactgaggagaagttggtcttggtctttctccagctcctagaggctgttggcaacccattgtctcctttggctcatggccctgtggttcctatctgtgcctccatctccatgtggccttctcccctctgggtgtctgtggccaaatttccctcttcttttttttttttgagagagagtctcactgtgttgcccaggctggattacagtggcgtgatctcggctcaccgggacctccgcctcccgggttcaagcgattctcctgcctcctgagtagctgggatcacaggcacccgccaccacgcccggctgatttttgtatttttagtagagacggggtttcaccatgttggccaggctggtctcaaactcccgacctcaagtgatctgcccaccttagcctcccacagtgctgggatgacaggcgtgagccaccgcgcccggctgaaattttccccttcttttaacaacaccactcataaaatgcgcatcctaattctgtccaaccgcatcttaattacctaggcaaagacccatttctccttttttttttttttgagatggagtctcactctgtcgccaggctggactgtagtggcatgatctcagctcattgcaacctccgcctcccgggtttcaatgattctcctgcctcagcctcccgagtagcggggactacaggtgcgcgcgaccacgtgtggctaattttttgtatttttagtagagacggggtttcaccatgttggccaggatggtctcgatctcctgaccttgtgatccacccgcctcggcatcccaaagtgctaggattacaggcgtgagccaccacgcccggcccatgtcttttgttcataagccacccagtctatggtattctgtgatagcagcctgaaatggactaagacatctcataagaagaggagatgaggacacagacacacacagagggacgaccctgtgaggacacagggggaagacggcgtctccaagcccaggagagaggcctcaggaggaaccagccctgcccacacctggatctcagacttccagactccaggattatggaagaatcaatgtctgctgtttataagccacccagtctatagtattgttttagcagcctgaaatggactaagacacctcataagaagagcagataaggacacagacacacacagagggatgaccctgtgaggacacagggagaagacggcgtctacaagcctaggagagaggcctcaggaggaaccagccctgcccacacctggatctcagacctccagcctccagggctgtgggagaatcactgcctgttgtttataagccacccagtctgtggtattctgtgacagcagcctgagatggactaaagcatctcataagaagaggagatgaggacacagatacagagggacgagtctgtgaggacacagggagaagatggcatctccaagcccaggagagaggcttcaggaggaaccagccctgcccacacctggatctcgcccttccagtctccacgacgatgggagaatcaatgtctgtagtttaagccacctgggttgtaggactttgctatggtggcccagtcagactaatacatctactcttgtatgtacccaaaaggattcaaaacaggtgttccaccaaaaccttctacatgaatgttcacagcagcactattcacaacagctaaaaggcagaaacagctcaagtgtctgtcagtgggtaaatgggaaattacaacatggtccatccacacacagtggaatattatgcagccatgaacaggaatgaggctggccgggtgcggtggctcacccctgtcatcccagcactttgggaggccgaggcgggtggatcacaaggtcaggagatcgagaccatcctggccaacatggtgaaaccccgtctctactaaaaatacaaaaaattagccgggtgtggtggcgggcgcctgtagtcccagctactcgggaggctgaggcaggagaatggcgtgaacccgggaggcggagcttgcagtgagccgagatcgcgccactgcactccagcctgggtgatagagcgagactctgtctcaaaaaataaataaataaaaaataacaaaaattagccaggcatggtggtgtgcacctgtattcccagcaactcgggaggctgaggcaggagaatcacttgaaccccggaggcggaggttgcagtgagccaagaccgtgccactgcactccagcctgggcgacagagtgagactccatctcaagaaaaggaaaggaacgaggctgtgaaacaggctgcaacatggatgaatgttgaggacatcacggtcagtgacagaaaccagccccggaggaccacacgttgcaggattccatgactacaccacgtccgcaacaggcaaacgcacggtgaaagaaagaggatgggcggttaccaggatctggggaggcgcactggggagggacagctgcgtggggacagggtctccttctggagtgaagagaacatcctggaaccaggcaggtagtggtggtacaacatggcaactctggttagttgtttgaaatggcgactctcaggacgtgtcagcttcatttccataaaacaagtgacttctgcgaatgggaccgtgggacttgcacaggcctgacccagccggtgggaaccaactccctctgtcccttcctctcacagacagtcggggggctgattctggagaagccggtggacaagcaggacgcctacaggatgctgtcccggtaagcaccatgttggcctctgagccctctcgggttctgagccacagagtagctgtggtatctggccgggtgtcctggggagcagggtggatctctgtcagctctgccgtctgagctgtgctgtctgagctgtgctgtctgagctatgcagggaggcaggcactatccctccatgctcatccttgtctaggattctgcagcactgatcccagaatgtctcatgcccactgcagactgttggggtcatgagaagttggcagtgtcctgtccttcccactgggcatcctggacctgagcccgtagcctgggacgtcatccccatcccaggacgtggaagagatgcaccccctgcccgccataggcccagctgagagctgcctggcctggcgcctcccgtcagggccactgctggtgggatttgtgaccccttccctcggcctctccgtaaaggtttccctggagaccccacagcgggacgatcggggagaagatgctggggacggatccaggattaaggacgcctcgctgcctcccctggttttgagaaactcgctttgtagctcccacgggtcacagcatggtcacgtggtcacccgttgttgtcttacaggttgagtgggagagaacacagcgtgttcacaggtgtcgcgatcgtccactgctccagcaaaggtaaccgcggcccaggtttcggggtagccccagaggccgagacaaggacccgggacattctcgggacccttggcttgagggaggaggacggttgctcacccccacctgtggaggggtttgtgcctatgtcctgcttgggaaagttgtccgccgatttggaagtctgcaggacaaaggaaaacgtgtggttttatctttttctttttctttcttttttttttttttttgagatggagtctcgctctcttacccaggctggagggcagtggcacgatctcagctcactgcaacctccgcctcccaagttcaagtgatccttctgcctcagtagctgggattacaggtgcccaccaccatgcccggctaatttttgtatttttagtagagacggggtttcaccatgttggccaggctggtctcgaactcctgacctcaggtgatccacccgcctcagcctcccaaagtgctgggattacaggtgtgagctactgcacccggcctttctctttctttctttcttttttttttttttgagacagggtctccctctgtcacccaggctggagtgcagtggtgtgatcatagctcactgcagcctcgacctcctgagctccagcgatcctcccgcctcagcccctacagtcacagaaactacaggcacacgccaccacacctggctcatttttgtattttttatagaggtgcggtcttgctatgttgcccagactggtctcgaactcctgggctgaagaaatcctcccatctcagcctcccaaagtgctgggactgcaggtgttcaccatattgctgggactgcaggtgtgcaccacggtgcccggcccaggcagttgtatcaccatattgctgggttcttcctgcaccaacccattcccagcttgttggcggacaccaggaggcatcgtagaattcagtcagttctgacagtagccgtcggagttagcgcagatcccacaggtgaagggccgggtcccatgggacctccacgcacaatcccagccccatatccctggtcacacctgtagttttctcacccacctgccgctcactgctggctcctgcaagcacctgctcaggttgggtcatttgctcgaggggctcacagaactcgggacagcactttccttcccagcttggggttttgttatgaaggagcaggtcaggaagtgccagacagaagccaggcacagcgcagggtgctgggtgcaggatgtatggagcctccatgcccgccgtggcacagctctgccaacaccctgatgtgttcacccaccagaagctccctgaaccctgtccttctgggtctcttttttttttcttttttgtgacagagtctcgctttatcgcccaggctagagtgcacttgcgccatctcggctcactgcaagctccgcctcccgggttcacgcccttctcctgcctcagcctcccgagtagctgggacgacgggcccgccaccacgcccggctaattttttctattttttttttttttttttttttagtagagacggggtttcaccgtggtagccaggagggtctcgatctcctgaccttgtgatccgcccgcctcggcctcccaaagtgctgggatgacaggcgtgagccaccgcgcgcggtcccttctgggtctcttaaaaggccaggattaacgacatcatccgccactggggagcaaactccatctccagccccctccccctgttcccatgacaaccaaagcctgccctttccaaaaggcccctcattaacataaggtcccctgcggatgaaaggggcttgtcaccacatagcaaaacgcctgctttcgctcctgtcactcaacagattccccgggattcaggggctctgtgtccggaccctgaggcacagaccaaacatctgtttcttttattatttatttatttgagacagagtctcgctctgtcgcccaggctgcagtacagtggcgtgatcttggctcactgcaacctccgcctcccgggttcaagcgattctcctgcctcagcctcccgagtagctgggatgacaggtgcatgccaccacgcccggctaatttttgtatttttagtagagacggggtttcgccatgttggccaggctggtctcgaacccctggcctctggtgatccatccgcctcggccgcccaaactgctgtttcttttgttttttttagagacggagtctcgctctgtggcccaggctggaatgcaggggcgcgatctcggctcactgcaacctgcacctcccgggttcaagcgattctcctgcctcagcctcccgagtagctgggactacaggcacctactaccaggcctggctaattttttgtatttttagtagagacggggtttcaccgtgttagccaggatggtctcgaactcctgacctcgtgatccacccgcctcggcctcccaaggtgctgggatgacaggcgtgagccaccgcgcccggcccctttctcccttttcttgtccgaaatgaaccttattctcccatgaagcatccatatctgaactgtgcgctgcgctcgagtacacacctccacagcacagccacgcagctgtcagggcacggaggtgacaagctggcgtccacgctcacccccacggctgtgtccttgcagaccatcagctggacaccagggtctcggaattctacgaggaaacgaaggtgaagttctcggagctgtccgaggagctgctctgggaatacgtccacagcggggagcccatgtgagtctcgggggcggtggggggacgggggacacgtgtggaagcctggccaccctcacacgtggggtgtcccacccagcctttgggaaagaaggaggccccgctccgggggccgtgtggcacagggagagccgcccggctcagaagcacaaacccttcacgaccacactgacccatggaggctcaaagaggcaaactcccaggacagagaggggcagggtgggagccaacgctgggctgcggtggggactggggaggcgctgggcaggggtagaggagttcacgtggtgggaggaggagaccccagaggtctgtgcccaggacgctggctgcaattaacacgaataaactctgtgatccaaagtcaccctaagaggtgattctacctgtcgtcccgtccacagattggtgagcacgggaagtatgcgtgcaccaatcagcttcacttcatcacccaccatttgcgtttatatgtattatatttatctacatcatatgtcatataatgtctacataattatacattatataatgtaacatgatatatatttacaattatatataatttatgtattccacattatatattctattaattatatataatctacattatacaaattatataatatatatttataatatattgtattatatactataatagattatactgtaatatgtatactatattacatatagatattataatatagattatatattaacacttttgattgaaatttaatgatttttaatgattaattttaataagtagtgattaatattaatgtaatatataccatctattataatatatactgttataatagattatatgataggttatataactgttaaaatagattatataataggtagttataatcgattataattatatataaattatataatttatatttataattatttataattatatataaaatatataattttatatattttatatatttaattttatttatatataaatatataattacatatatttataattatatataaatataatttataattatatataattaattataaatgatatataattatatataattataaacaattatataaatataaattatatataattatatatataattataaaatgattatatattataaaatataattatatatttatataatatagaaatatatgaatatatggataatatgtaatatgtattaaatatgattaatatatgtaactgcatattaatacatattacataataatataaagtgtgattatatgtaaattatatattaattaaatatatgtaatacatattagttatatataatatataatgtattatgtgttatataaatatataattatataaaatatatttttatattataaaagtatataaatatataaatatatgtatataaatacatttgtataaaatatatgtttattttatatatttatataaataattttatttatttttttgagacacggtctcactctgtcacccaggctggagtgcagtggtacagtcatagctcactgcagcgtcagcctcttgagtcaaaatgatcctctcacctcagccccactagtggctgggtctgcagacgcataccaccacgcctggctaattttttctattttttgtagcaatggggtctcactatgttgcccaggctggtcttgaactcctgggctcaggcgatccttccaccaaagcctcctgagtaggtgggaccacaggacacgcaccaacacacgcggccgattttattgttagtttttgtagagatggagtctgcgtaatatatatgtatattaacctagaggattttacatcaattgaaataagcccggcagaagaagacacataccacaggatctcacttatatggaatataaaacagttgcacttggtcaaaggatacaagatttaaatcagggccaggcatggtggctcacgcctgtcatcccaatactttgggaggccgaggcaggcggatcacctgaggtcagaagttcaagaccagcctggatatggcaaatcccaatctctactaaaaatacaaaaattagcccggtgtggtggcaggtgcctgtaatcccagctacccaggaggctgagacaggagaatcgcttgaacccagcaggtggaggttgcagtgagccgagatcgcgccactgcactccagcctgggcaacagagcgagactccgtcttttaaaaaaaaaaaattaagtgagacgggagaagttcaaggctctttacagcctagtgactgtggtttacaggaacagtgtcttactggaaaattgccagcacactacatctgaagtcttctccccacacacacagaataggtacatgaggtgctcgatgggataattggcttgatttaatgatgtcacatgtatacatatatcaaaacatcccatttaacacatgaaattttttttgagacggagtcttcctccgtcacccaggctggagtgcagtggcgcgatcttggctcactgcaacctccaccttccagtttcaaacgattctcctgcctcagcttcccaagtagctgggactacaggcacccaccgccacgcctggcgaattttttatttttagtagagaaggggttttgccatgttggccaggctggtctcgaactcctgacctcaggtgatctgcctgcctcagcctcccgaagtgctgggagccaccgcgcccagcccaacacctgcactttcatacatactttaatgtttacatacatttaaagaaagacaggccgggcacagtagctcaagccaagacgggaggatcacttcatcccaggagttcgagaccagcctgggcaacagagtgaaaccccatctttataaaaaatgataaaactagctgagtgtgtccctgctacgtgggaggctgagattacagcatcatttgagcccagaattttgagggagcagagaaccaagaatgtaccactgcacttcagcctgagcaaccgagtgagaccctgtcttgaaaaaaaaaaatagataaaataagaaagagaaaagagggccagacgtggtggttcacacctgtaatcccagcactttggggggccgaggcaggcgcatcacctgaggtcaggagttcgagaccatcgtggccaacatggtgaaaccccgtctctactaaatacaaaaattagccgggtgtgttggcaggtgcctgtcatcccagctacccgggaggctgaggcaggagaatcgcttgaacccaggaggcggaggttgcagggagccgagatcgcgccactgcactccagcctgggcgacagagcgagactctgtctttaaaaaataaaaataaaaaataaaaaagtgagacaggaggaagaagttcaaggctctttacagcctgtgactgtggtttataggaacagtgtcttactggtaaattgccagcacactagatctgaagtcttctccccacacacacacacacaattcgtagatgagatgctgaatgggataattggcttgatttaatgatgacgcatgtatacatatgtcaaaacatcccatttaacacatgaaattttatttatttatttatttatttgagacggagtcttcctctgccgcccaggctggagtgcagtggcacgatctcggctcactgcaacctcctcctcctgggttcaagtgattctcctgtctcagcctcctgggtagctgggattacaggcgtgtgccaccacaccacacccggctaatttttgtatttttagtagagatggggtttcaccgtgttggccaggctggtcttgaacttctgacctcaagtaatccacccgtctcggcctcccaaagtgctgggattacagccgtgagccattgcgcccagccttgctgtgaaattgtttttctttttttttttttttttgagatgccaaaggcgcctgcccccacgcctggctaattttttgtattttttttagtagagacagggtttcactgtgttagccaggatggcctcgatctcccgacctcgtgatccacccacctccgcctcccagccgtgaaatgttcagacccaggaacttttctcctccttgtcacctcttaccttcccctgcccacccagggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaaggtacctgtgtctgtctcctcaggccacatttcacaaatgagcctacacactcggcttaaatcaaagggaatttacttctcactgtcctggaggctggcagtctgaggtcaggttgtctcagggccatgctttctccgaaggttctaggagagggtccttcctgcctctcccagctcctgacagctccaggcatccctgggcttgtggccgcatcactccagtctctgccacgtcctccacgtggcctcatccactgtgtctgtgtctcctcctctgtctcttagaaggacacctgtcattggacttggagtccacccttcttcgtgatgatttcctcttgagattcttaattacatctgccaagacccctttttaaaacaaggtcccattcacagattctggggatcaggatatggacagatctttcaggaggaccacagttcagtccactacagatgtatccagttccttctggaggccccaggggagggtccttcctgcctctcccagctcctgggggctccaggcatccctgggcttgtggccgtatcactccagtctctgcctttgtctccacgtggccttctcctctgtgtctgtgtctcttctgtctcttagaaggacacctgtcattggattttgaggtctccctaatccactgactccaactcatctgaagtcccctagcttacttacgtctgcaaagacccttttttctttttctcttttttttgtttttgtttttgtttttgagacagagtctggctctgtcatccaggctggagtgcagtggcatgatctcggctcactgcaacctctgcctcccgggttcaagcgattctcctgcctcagcctcctaactgtggtcctcctgaaagatctgttcatagcctgatccccagaatctgtgaatgggaccttgttttaaaaaggggtcttagcagatgtaattaagaatctcaagaggagatcctgagtagcctcaggagtagcctcctgattacaggcgcccaccaccaagcccggctaatttttgtacttttagtagagacagggtttcgctatgttggccaggatggtctcgaactcctgacctcagctgatccacccgcctcggcctcctaaagtgctgggattacaggcgtgagccagcgcgcccggcctgaggccccatctttcagctgttctgttcaggggcccctcacggtggcagcctagaagggatgcagccctcccaacaccaggggtccctcacagggcgtcctccgggaagcagaggtggggatgtcgggtgcaggagggacgcaggctttgggagacagggagacgggctgatgacacctcctgccattcatcatcaggagagagaacatgcagtgaataaggaataaaggtggttacagcacattccgtctgtgcctctaatttaccaagtggtgattattaaatcaccaccaggtggtttataaacaacagacattgattctcccacagtcctggaggctggaggtccaagatcaacgtgtgggcagggctggttcctcctgaggcctctctcctgggcttggagatgctgtcttctccctgtgtcctcacagggtcgtccctgtgtgtgtgtctgtgtcctcatctccttttcttatagggaccccagtcctattggattagggtccacccaaatgacctcattttacctgaatcacttctttaaaaccctgcctacaaatacagtcacatcctgagggactggggggattaggagttcaacatctgggttttgaactcagtccatatcggcagcatgttgatttttctcccatgggctagtttttctgcatgatattcgttgatgtgctttttccttgtgtacaccttgttttatagctggggacttgatcctataaatccccaccgttctctgtgaaagaaggctcaatggccaagttgtatacttccgacagcgttggcctccatcttttgagtctgtgggagtagaaagtactggacaagggacttaatgagtctctctgcacttgcttttaacagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggtgacaggacccagcgggttttgctctgaggatctttgcaggtggaagtcactgagggaaggtgacctggagcctgggcagagcgaggaaggaggcccacaccttctgtccctctgccctcaggaatgctgcttttcccgaaaggttgagaagcagagggtgaatgacagagagggaacagtggcagccgcgagcacataggagaagcgtgacctccttatgggctctagtctcaaaggggctgtatcagtccatgttctcctgagaaacagaacccaatacggtgtacacagacattgatttagttgcttatttatttttatagacaaataacgtagatggatgggtagacagatacatagatagatgataaatgcatagatacattgatatagattgacgatagagagatgacagatacatagatgatgggtagagttgatatataaatggatggatggatagatggatggatggatggtaggtggatagatgggaggaaggatggatggatggatggatggatggtaggtggatagatggatgggaggagggatggatggatggatggatggacagatggattgatcaatggatggatagatacatggatgggaaggtggatggattggtggatcagtggatgggtggatggatgggtgggtgggtggatggatagatggatggatggagaggtggatggataaatggaagggtgggtagatgggtgggtaagtggatggatgggtggatggatgagtgggtgagtggatagatggatggatgtgtgaatggaaggatgtgtggatggatgggtggatgactggatggataaaggtgggtagatggatggatggatcgatgaatcggtggatgagtgcatagatgggtgggtaagtggatggatgggtggatggataagtgggtgagtggatgggtggctggatggatggatggacggacagatggatggatggatggatgtgtggatggatgggtgagtggatagatgtgtggatagatggatgagtgggcgtgtggatgggtgggcgtgtgaatggatggatgagtggatggatgggtgcacggctgggtggatgattgggagtgtgggtgaatagacggatgggtgggtggacagatggatgggagggtggatgaacagatatatcagtggatcggtggttgggtagctgggtgggggaatggatggatgaatgggtaggtgggtggttggatgggtggatggatgagtgggcatgtggatgagtgcatgaatggatggacgggtgcatggctgggtggatgatggggagggtgggtgaacagatgggtgggtgggtgggtggatggatggatggatgagtgattggatgggtgggggaatgaatggataaatggatgtggatggatggatgcatgcatgggtggatggatcagtggatccatcagtggatgggtggatggatgggtaggtgggtgggtggatggatggatggatggacagatggatggatgagtgattggatgggtgggggaatgaatggataaatggatgtggatgtatggatgcatgcatgggtgcatggatcagtggatccatcagtggatgggtgaatagatggatgggtaggtggatggatggatgagtgggcatgtggatgggtgggcgtgtgaatggatggatgagtggatggatgggtgcatggctgggtggatgattgggagggtgggtgaatagatggatgggtgggtggacggatggatgggaggatggatggatagatgtatcagtggattgctggatgggtagctgggtgggggaatggatggatgagtgggtagatgggtggatcggtggattggatgggtgggggaatgcatagatgagtgatgaatgggtggatcagcagatgggtgggtggatgactagatgggtgggtgagtggataactggatgggtgggtgagtgggtggatggatggatggatgacaatgtgttttctgaattgaacagaactcttcagcatggtgctagaatagagagcacatgaccaagtccttgagtagcctgggaagggcaggacaacagatgacacctgggcagaggtggctgtgcttctgtgattaggagacaaagcatgccctggttgaggctccaaaggctgtgcccttaccacagagacatgtgactatatccttagaggctggaacatagaagccagaacatcttccccagccagagcagttcaggaccattctcccgtattgaaaataatgatgaataggccacgcctgtaatcccagcacttggggaggccaaggcaggcagatcacgagttcaggagatcaagaccatcctggctaacacggtgaaaccccgtctctactaaaaatacaaaaaattagccgggcacggtggcgggtgcctgtagtcccagctactcgggaggctgagggaggacaatggcatgaacccaggagacggagcttgcagtgagctgagatcgtgccactgcactccagcctgggggacagagtgagactccatctcaaaaaaaattaaaaaattaaaagaaagaaaataatgatgaatatggagaaaggcttttcatcaccggcaccatgcaagcttgttccaactccttttgacaacgctttgtgcagttgagtcctaggagcagttccacgtctgcagaggctgctcctgcttcaccataggtctcatcatttattcatgatgaaaataaatgtcatctatctgactatagcaaaccgtacactcagggtcagctcggtgggaaaacagtaacatttcatcattaacatgaacacagggctgtttcttacataggaggaccggagtggtgcgaggccatctgtttccatatacgggtctccaccaacaacttctccaccttccagcctcccattctgtgggagggggcatcctggaagggagcttggggactgggtctatggacagctgacctgggcatgaagtgggtggagaatgaagttccctgtatcatttggggctctccagggtaacagaacccctaggatataacctaggagatttatcttgaggacttacgtgattgtgtaggctggcaagtccaaaatccacagggcaggccaggaggctggaagctcaggcaggagctgctgctgccatcttcaagtggaatttctcctccaggaaagcccaatgtttgcttctggggttttcaatgagctggatgaggccaatgcacattttggggggttaatctccttaaagtcaaactgatggtagatgcaaacgccagctacagcacacctccacagccacatctagatgggtgtttgcctgcataactgggaacttgagcgtggccacgatcatgaagaaaggatcagcctcagtgggtaacagttacagcagttgacagctggggcgtggtggctgctgttttcctgcccagctgaccctgagtgtacagtttgctatagtcagatggatgatgtttattttaacatctcaatgatgcatcccctatggtcaggtttccttgagtgtacggtttgctatagtcagatgggtgatgtttattttaacatctcaatgatacatcccctacggtcaggtttccttgggttttctcgttaggaggtcacacgactgtccccatttctccaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggtagcataacacccccgcggacacctttccgtctagcgtgcattttgctaaaacactttgacacacagatcagtaggcaccttgaccagtctgtctccagtctgacagatcccaaaggcttggctcgttctgcctggagaacttagtgccgtggctcttgtgtcactcagccctggaacaggtgcaacttagacatcctccactgttatccagcagctgatgaaaatagaatttcctcctagaaacaggtttgaaggccatgctcaggggctcacacctgtcactcccagcactttgggaggccaagttgggaggatgatttgagcccgggagtttgagaccagcctgggcaacatagtgagacccccatctctacaaaaaattaacagttaggctgggcatggtggcatgagcctgtaatcccagctagtttgggaggccaaggtgggctgatcacctgaggtcaggagtgcgagaccaacctggccaacgtgctgaaaccccatctctactaaaaatacaaaaaaaaaattagctggggatgatggcgcgtgcctgtagtcccagctactcaagaggctgaggcaggagaatcacttgaacccgggatgtggtggttgcagtgagctgagatcacgccactgccctccagcctgggtgacagagcgaaactccatctcaaaaaaaaaaaaaaaaattaacgattagccaggtatgattaggcagctactttgggaggcccaggtgggtgggaagatcacttgaacctgggaggtcaaggctgcagtgtaagccgtgatggtgctgctgcactccagcccgggtgacagaacaagactctgtctgaaaaatagaaataggaaggagttggacaggctgccttaaatgaatgccctgtttcttctttgcttcaatggaactgacacttgcttatctgaggccgctgtttgcaaagcgctccctgcatcctctcgcccctccttcccctttccccgcccagaaccttcctgaggtggacgtgtgagatatggtggggtccgtggggcctgtgcagatgggtgggtctcggtctgcagggctgtgccagccaggcgtggggagtctgctgtgggctcggctggccgtggcctcatgcctccttggcagcgctggccgagcttctgtggcagtgagcacggagtcagggtgtgtgtgtgtgatgcagagatgagccccagggagccgggggcttcctgcagatgttggggagagacatacagacagggagacacagagagagagataggcagacagaaagatagagggagacagagacagacagagatggaggcagacagagacagggagatagagggagacagaaacagggagacagaaagacagagacagagatagagtgagacagacacggagatgggagacagatagtgagatagggagagagatggagagacagggagacttgagagacagagggaggcggagacagagatagggagacagaaacaaagatggagacagacagacacatagagggagatgggagacagagacagggaggcttggagagacagagatagaggcagatagagacagaaacaggagacagacatagagacagagacagagggagatagaaagaaacagagacaggagacagaaacagagagagagaaagaggaagacagagacacacagacggagacagagacagacagacagagaccaagggagaaagagtcagagagagaagccagtggtggagaagccgagaggcacggacaggggccctgagctggcgtgagcagccagcgtgggcatcgcagaggacagatccctgagccccatgattgccacccacgcaggggagggccggggagcccccgcgagatttagggagccaggatggagaccggctgtcctgctgggagcggggctcagaagcatcctcagctgggcttgcttgccctgcagggacgggatgtccaggcgaaccctggacacagcactgagccaggatgagcctgggctcctctgggacccggggtaggtgccactggggggacttggagaagctcggaggagcttctcctctgcacaccagaattctcggaggagccccctctgcacaccgcaccattgtggtgaaggctgagccggggcacctgcagagacattgtggcttctctcctggttttctccagtgaggtgtttgtgggccacccggagcctccagggtgaaaagctttattgtgaaaagcctactgcgaaagtcagacgcttggagttcaggctgtggtgtggaccaagtgattccaaggagatcgtccaccactttggggtcctctgtccccagccagcccagcccccacacagacaagagtagcccacacagctgtggcatgaagcccgctctgcagcccaggcgcggctgagcccccacgctctggagccctgcacttctccccccgacccccagggagaggctgggcgagccctcgccccgtgttctctggtgcccctaagcacctgctgtgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggtgggtggcccccccgccagggctctccttactttcgtttattaagccacaggtatcttccctgctcaggacacctaccaactgcctttttccattgacaaacctgataacgacctgaaccgggccaggctgagtcccagatcatgggtggatattcccaagttccaggaggaccccggggatgcctaaatgcccccctagaaactccggggccctctcttttggctgcggagctgaggcagagcaccttggaacccctggattcccctcagcaagtctgattatatcctgactcaccctccaccccaccccagccctggacagtgggtggagcagtagacacattcccaagggctgctgggggatcggggcctgggacgattctcacaccatcagcttacatttccccaacctctgaatgcctctcctccttgtggtccagagtggctgctgtagcaccagccatcgtgtctgcatccccatggcaggaaggagaagggaggagtacagcccccacccctgggcagaaaggatttccctgtaggtctgtgccccctacacgtggcccagagtggctgctgtagcaccggccattgtgtctacatccccacggcaggaaggagaagggagtacagccctccacccctgggctggaaggatttccctgcaggtctgtgcccccacactcacctgcttgtacagtcttgtctgggataccagcgagctccccaccactggctttcccttccagcatgggaatcaatgccatgcccttgaacattacttctgccccagttgagctttggagagtcgtcagagttccatagacgacccagccacagagcatgcatttgcttccccgcaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgagccctcctcctgttcaccctgctaaccttttccagactgcagcatctctttctagacagagggcatggctgtgtgtgcacctgtgtttctgcctgggcgtttccatggtgggtatgtgtgtgcaaatgggactgtctacggtgcttgtgtgtgtgtgtctctctgtgtgcatgtgtgtggtatgccctggagcatacctgtgacatggagcatgtctgtgcgtgagcatgtctgtgtgtgtgtgtgtctgcatccgcatgtgtgtgcacgtctctggtgtgtggttgcatatgtttctgtgagagtatgtgtgtgtgtctgtgtgggtatatgtgtgcatgtctgtgtgtgtgtgtctgcatctgtgtgcatgctgtgagccggtgggtgtctgtgtgcatatgactgtcgtgcttgtgtgtctgtgtgcatgtgtgtgtgtgtgcatgtctgtgtctgtatctgtgtgcatggtgtgtgtcttccgtgcatatgtaactgtgtgtgcacgtctgtgtagtatgtccttgtgtgtgtgtctgtgcatgagactgtgtgtccacgtgtctgcaagtctctgtggtgtgtggttgcatatgtttctgtgaggtgatgtgtgtgcatccgtgtggatatatgtgtgcatgtctgtgtatgtgcgtctgtgtgcccgtctgtgtctgcatttgtgtgtatgctgtgtgctggtaggtgtgtgtgtgtatgtgactgctgtggttgtgtgtccctgtgtgcatgtgtctgtgtgtacgtctgcatctgtgtgcatgctgtgggccggtggttgtgtgcatatgtgactgctgtggttgtgtgtctgtgtgcatgtgtctgggtgtgcttgtctgtgtgtctgcatctatgtgcatggtgtgtgtctgtgtggatatgtgagcatctgctgtgcttgtgtctgtgtctctgtgtgtttctgagtctgtgtgtgcacatctctgtgtggtatgtccttgcatgcgtgtctgtacgtcagaatgtctctgtgtctgagtccgtgtgtgtgtgtgcacctctgtggtgtgtatgtctctgagggtatgtgtgtctgcgtgtctgtggatatatgtgtacatgtctgtgtgtgcatgtctgtgtgcccatctgtatctgtgtgcatggtgtgtgtgcatgtcactgctgtgcttgtgtgtacgtctgtgtgtgcatgtgtctgtgtgtgcatgactgactgtgtgtggtatgtccttgtgtgtgcgtgcgtaagaatgtgtctctgtgtctgcatctgcgtttgtgtgtgtgcaactctctgtggtgtgtgcttgcatatgtgtgagggtatgtgtgtttctgtgcgtctgtgtgggtatatgtgtgtatgtctgtgtgtctgcgtctgtgtgcctgttggggtatctctgtgtgtccgtgcgtgtgcccatctgtgcatgtctgcatccgtgtgtgtgtgcctgtcgctgtatctgtatgtccatgtgtgtctgcgtgtccatctgtgcatgtctatgtttatgtgcgtgtgcctgtctgttggtgtatctgtatgtccgtgtgtgtgtgtgcccatctgtgcatgtctgcgtctgtgtgtgcctgtcactgtatctgtatgtccgtgtgtgtgtgtgtccagctgtgcatgtctgcgtctgtgtgcgtgcctgtctgttggtgtatctgtgtgtccgtgcgtgtctgtctgtgcccatctgtgcatgtctgcgtctgtgtgtgcctgttgctgtgcatgtctgcgtctgtgtgtgcctgtcgctatatctgtatgtccatgtgtgtgtgcccatctgtgcatgtctgcgtctgtgtgtgcctgttggtgtatcactgtgtgtccgtgcgtgagtgtgcccatctgtgcatgtctgtctctgtgcgcgtgtgcctgtcactgtatctgtgtccgtgtgtgtgtgtgtgcctgtcttgctgtatctgtgtgtccatgtgtgtacctgtcagtgtatctgtgtcctgcatgtgtccgtgtgtgcatgtcttgtggcgtgtgcttgcatgtgtgcctttgtgtctgcatttctgtgcatctggatgggtatatgtgtgtgtgcctgtgtctgtgtctgtgcgtccgtgggtctgcctgtgcgtgtctctctgcgggtccacacagacacgagggcatctccaaacaggtggacaaggctgggcacagtagctcacgcctgtaatcccagcactctgggaggctgaggcgggcggatcccctgtggtcaggagttcgagaccagcctggccaacatggcgaaaccccatctctactaaaaatacaaaaattagccgggcgtggtggcgggcgcctgtaatcccagctactcaggaggctgaggcaggaaaatcgcttgaacctgggaggcggaggttgcagtgagctgagatctcaccactgcactccagcctgggcaacaagagcgaaactccatctcaaaaaaaaaaagacaatgataataataatgataaataaaaataaacaggtggacgactgtgtgaagttatcatcagtgcaagtagccgagacgtgaggggagtggagatggggaacagccgagatcagcattcatgggcatccacggtgccgaggtcacggaaggaactgacccgagagccgtcacagtgtggccttaggttagacttgaaggagaacttccaggtggcagctgctgaggccaggacggattgacaggagacgcctggaatcccagccctctgggaggctgaggcgggtggatcacctgaggtcaggagtttgagaccagccagagcaacatggtgaaaccccatctctactaaaattacagaaattagccaggcatggtggcgggtgcctataatcccacctattcaggaggctgaggcaggagaatcgcttgaacccgggaggcggagcttgccgtgagccgagatcgcgccactgcactccagcctgggcaacacagcaaaactccatctcaaaaaaaataaaaaaataaaaaaagagacagctgacgtgctgtaactcagcaccatccgacagcggccaggcctgtgggcacaggtgctggggacctccacaaccctcccccagaggttcctggatgcttttctcgtttttaaaaaaacaaaacgcaaccaccctacagctcctcctgcaggacatcatgatagctgtgcttctgatttgccagatctgcagagacagaaatgctgaaatttatttatgtttgaatggtgtctcgctctgtcacccaggctggagtgcagtggcgtgatcttagctcactgcaacctccacttcctgggttcaagggatcctcccacctcagcctcccgagtagctggggtgacaagtgcccgccaccacgcctggctaacttttgtatttttagtacagatggggtttcaccatgttggccaggctggtctcgaactcctcacctcaggtcatccacccgtcttggcctcccaaagtgctgggattacaccccgcccggccggaaatgctaaagtttaaaatcatgagccctgaaagagcaccttctcctcgcagctgggggaaaacagctctggagacttcccaccgcacactctcccgccccttctttcccctcatgcaactcacagcttgctatttatcctctccctgtcctgcagaccggaggtctgagatcaaggcatctcagggctgtgctccctctggaggctctaggggaggatccttcctgcctctcccagctcctgggggctccgggtgtccctgggcttgtagccgcatcactccagtctctgcctccatctccacgtggccttctcctctgtgtgtctcctcttctgtctcttagaaggacacctgccattgcatttagggcccaccctactccaggatgatcccatctccagatccttaattacatctgcaaagaaactttatccaaatgaggtcccattcccaggttctggggcttaggacttggacagatcttttggacgtcaccacccaacccattgcagttgtgtttgattctttctgagaggctctaggggaggatccttcccgcctcttccagctcctgggggctccaggcgtccctgggcttgtggccgcatcactccagtctctgcctccgtctccacgtggccttctcctctgtgtctgtctcctcttctgtctcttagaaggacacctgtcattggatttaggggacaccctactccaggatgatctcattttgaaattctttactcaatgacatccatagagaccctatttccagataaggtcccattcccagcgactgagggtcagcacctgaatatatcttttaaggggacaccattcactgcactacagcagaccatctttttatttcagcaattacagaggggcgtgcagctacatgcgccccccgcaacaggcaaccctcctggggcgcctgaatcaggggatcaccagagaaggccctgccattgcccactcaccggcagtgcggccccgactctccctggcacacgcccatgtgcgccgactctgcctgcctcgcccaggtgctgcccctgaattccctgcttttttcctcccttgccttcttgtcgcccaggctggagtgcgatggcgcgatctcggctcactgcaacctccacctcccaggttcaagcgattctcctgcctcagcctcccgcgtagctgggatgacaggcgcccgccacccctgtccagctaatttgcatttttagtagagatggggtttcgccgtgttgcccaggctggtctcgaactcctgagctcagacaatctgcccacctcaggctcccaaaatgctgagattacaggtgtgagccactgtccccagcgttttctcagcccgagtcaaaccgcacgggcgtgacatcactaaccagctcctcatggagctctgttcaagtccccacggggatgtacttcaggaagacccattcccgcccacacccctctcttctctgtccctgatttaggatgcgggtggccgtcccaggatctgtccggggaggactgcttcttccatacctgacggacgtatctcgttttgtctttaaaccaggtgactttttcagggaccccctccccagcgctgagctgtacgtcctgtgccggatcctgcatgactggccagacgacaaagtccacaagttactcagcagggtcgccgagagctgcaagccaggtgagagcccatcgtcaggttagctgtttttgttaagacgtagtattttgggttcaagttttacaaggaggccgggcgcggtggctcacgcctgtcatcccagcgctttgggaggccgaggcgggcggatcacctgaggtcaggagtttcagaccagcctggccaacgtggtgaaaccccatcgctactaaaaatacaaaaattagccaggcgtggtggctcatgcctataatcccagcactttgggaggctgaggcaggtggatcacccggggtgagcagttcgagaccagcctggccaacatggtgaaaccccgtctctactaaaaatacaaaaattagccaggtgtggtagtgcgcacctgtaatcccaggtacttcagaggctgaggcaggagaatcacttgaacccgggagctggagactgcagtgagccgagatcgcgccactgcactccagcctgggcgacggagtgagattcggtgtcaaaaaagaacaaccacaacaaaaaaagaattggcttatgtgactttggaggttggcaggtccagcgtctgggtgagaggcccgctaaattgtggagggtaaatctgctgtatttaaagttggccagtgtggccaggtgtggtggctcacgcctgtcatccccgcacttcgggaggccgaggcgggcggatcacctgaggtcgggggtttgagaccagcctggccaacatggtgaaaccccgtctctattaaaaacaaacacaaaaaataagccgggcttgatagcgggtgcctgtaatcccagctactcaggaggctgaggcaggagaatcgcttgaacctggagacggaggttgcagtgagccgagactgcgccaccgcactccagcctgggtaacagagcgagactccatctcaaaaaaaaaaaaaaaaaaaaaaaagaaaatcctaaagagaaaatatatttactattcgtgaagttgaagtggctcatgataaaagtcttcattcttgaggaggtcttcacactgaggaggctgcagaggaggaagccgtgggctggtgttgctgtctcaggggtggccgaggcagagggaaatccacgcatgagtggactctgcagctggatctaatctgtgtgtttctacgcagacacacgtgcacacacacacagcacgcaccatctcggctcaaagccttcacatcaggtttctcccccgtccacccaggctgctcctggagcccagtggggctgctggaaaccctggctccaggggttcgggccagggctgcatattgggtttccacagttgaaccagctggccctgagggaatctgacgggcactcagcctccctcaagagttcagcgttgttgctccagtgagaattcctggaatatttgcagacaacggttaattatcttcacagagccagggcctggcacctgcgcgttgaaacaggactccccataggctcaaatggtcaagagacttccattcttctctccctctgtctctccttctttctctctttctctgtgtatctctcttcttttttttttttgagacggagtctcgctctgtcgcccaggctggagtgcagtggcacgatcttggctctccgtaacctccacccccagggttcaagtgattctcctgcctcagcctcccgagtagctggattactggcacataccaccacgcccggctaattttttatttttaatagagacagggtttctccatgttggtcaggctggtctcgaactcccaacctcgggtgatccacccagctgggactcccaaagtgttgggattacaggcgtgagccacctcgcccggctctattatattttttgagacgaggtctcactctgctgcccaggctggtgtgcagtggagcagtcacaggtcactgcagccttgacctcctaggctcaagctgtcctcccacctcagcctcccgagtagctggaagtacaggcatgcatcatgcatcaccatgcccagctaattttttaagaagttttttctgagaccgggcacggtggctcacacctgtaatcccagcactttgggaggccaaagcgggcagatctcgaggtcaggagttcgagaccagcctaagccacgtggtgaaaccccgcctctactaaaaatacaaaaattagtccggcgtagtggtgcacgcctctaattctagctactcaggaggctgagagaggacatcacttgaacctgggaggcgaaggttgcagtgagcagagatcgcgccactgcactccagcctgggcaacacagcaagactccgtctcagaaaaaaaaaaaaaagttttttgtggagataggagtccccctctgtcacccaggctggagtgcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagtgcagtgttgtcatcatagttcactgcagccttgacctcctgggctcaagcgatcctcctgcctcagcctcccgagtatttgggagtagcagcatttggctggagtgcagtgttgccatcatagttcactgcagccttgacctcctgcactcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggactgcagtgttgtcatcatagttcactgcagccttgacctcctgggctcaagcgatcctcctgcctcagcctcccgagtatttgggagtagcagcatttggctggagtgcagtgttgccatcatagttcactgcagccttgacctcctgcactcaagcgatcctcctgcctcagcctcccgagtatttgggagtagcagcatttggctggagggcagtgttgtcatcatagttcactgcagccttgacctcctgggctcaagcgatcctcctgcctcagcctcccgagtatttgggagtagcagcatttggctggagggcagtgttgccatcatagttcactgcagccttgacctcctgcactcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggactgcagtgttgtcatcatagttcactgcagccttgacctcctgcactcaagcgatcctcctgcctcagcctcccgagtatttgggagtagcagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgcactcaagcgatcctcctgcctcagcctcccgagtatttgggagtaccagcatttggctggagggcagtgttgccatcatagttcactgcagccttgacctcctgcgctcaagcgatcctcctgcctcagcctcccgagtatttgggagtaccagcatttgttatcatgccctgttagggttttttaaattttgtagagatgggatcttgcgatgttgcccaggctacccttcctgggctcaagcgatcctcctgcctcagcctcccaaaatgctggggttaaagacatgagccactgcacccggcctctgtctctctttctctctcttctccctcttcctctctgtctcctcctctctgtgtctttttaggtatctcatctatcatcatcaatctctgtttctcttctctcctccttcctcctttatcttctctgtctcttcctccctctctccaccctgtctctgtctctctttatacatctatcatccttttttaaaaaaaataaaatagagacagggtctcactatgttgctcaggttggtttcaaactcctgggctcaaaccatcctcccacctctgcctcccaaagtgctgcgattacaggtgtgagccactgcgtctggccttctaacaatgctccgtcacctgtcatctgtctatcatttattatctatccatccatccatcatctacctacccatcatctaccatatattcacccatccatccatctcatccatgcatccatctatccatctattcatctatctacctatcatctaccatctattcacccatccatccatctcatgaatgcatccatctatatccatccattcatctacctacctgcccatcacctaccatcaatacacccatccatctcatccatctatccatccattcatctacctgcccatcatgtaccatctattcagccatccatccatctcatccatgcatccatctatccatccatccatctacctacctacccatcatctaccatctattcacccagccatccatctcatccatgcatccatctatatacatccattcatctatctacctacccatcatctaccatcagttcacccatccatccatccatctacccatcatctaccatcagttcacccatccatctcatccatgcatgcatccatccatccatccatctacctacccatcatctaccatctattcacccatccatccaatccatgcatctatccatccattcatctacctacccatcatctactatctattcacccatccatctcatccatgcatccatctattcatctatctatgtacccatcatctaccatctattcacccatccatccatctgttccatgcacccatctatccatccattcatctacctacccatcatctattatctattcacccatccatccatctcatgcatgcatccatgtatctatccattcatctacctacctacccatcatctaccatctattcactaatccatccatctcatgcatgcatccatctatccatccattcatctacctacttaaccatcatctactatctattcacccatccatccatcacatccatgcatccatctacctacctacctatctattcacccatacatccatctcatccatgccatctatccatccatccatccacctacctacccatcatctaccatctattcaagcatccatcacatccatacatccatctatccatccactcatctatctacgtacccatcatctaccatctattcacccatccctccatccatctcatccatgcatccatctatccatccattcatctacctacctacccatcatctaccatctattcacctatccatccatctcatccatgaatccatccatccatctacctacctacccatcatctaccatctattcacccaaccatccatctcatccatgcacccatctattcatcttcctacctacccatcatctaccatctattcacccatccatccatctcatccatccattcatctatctacccatcatctaccatctattcagccatccatccatctcatccatgcatccatctatacatccatctacctacctacctacccatttattcacccatccatccatctcatccatgcctccatctatccatccacctacctacccatcgtctaccatctattcacccatccatcacatccatacatccatctatccatccattcatctatctacgtacccatcatctaccatctactcatccattcatccatccatccactcatctacctacccatcatctaccatctattcacccatccatctcatccatgcatccatctatccatccatccatctacctatgtacccatcagctaccatctattcacccaaccatccatctcatccatgcatccatctattcatcttcctacctacccatcatctaccatctattcacccatccatccatctcatccatacatccatatatccatccattcatctatctacctgcccatcatgtaccatctattcacccatccatccatctcatccatgcatccatctatccatccattcatctatctacctacccatcatctaccatctattcacccatccatccatctcatgcatgcatccatctatccatccatccgtctacctacctacccatcatctatacacccatccatctcatgcatgcatccatctatctatccactcatctacctacctaaccatcatctactatctattcacccatccatccatcacatccatgcatccatctatacatccatctatctacctacctacctattcacccatccatccatctcatccatgcctccatctatccatccacctaacgatccatcatctaccatctattcacccatccatcacatccatctatccatccactcatctatctacgtacccatcatctaccatctgttcacccatccatccatctatccatccattcatctatctacgtacccatcatctaccatctattcacccaaccatccatctcatccatgcacccatctattcatctacctacctacgcataatctaccatctgttcactcatccatccatctcatccatgcatccatctatccatccattcatctatctacgtacccatcatctaccatctattcatccattcatccatctatccatccactcatctacctacccatcatctaccatctattcacccatccatccctctcatccatgcatccatctatccatccatacatctacctacgtacccatcagctaccatctattcacccaaccatccatctcatccatgcatccaactattcatcttcctacctatccatcagctaccatctattcacccatccatccatctcatccatacatccatatatccatccattcatctatctacctgtccatcatgtaccatctattcacccatccatccatctcatccatgcatccatctgtccatccattcatctacctacccatcatctaccatctattcacccatccatccatctcatccatgcatccatctatccgtccattcgtctacctacctacccatcatctatcatctatacacccatccatccatctcatgcatgcatccatctatccatccattcatctacctacttacctaaccatcatctactatctattcacccatccatccatccatctatacatccatctatctacctacctacccatctattcacccatccatccatctcatccatgcctgcatccatccatccatccatccacctacctacccatcatctaccatctattcacccatccatctcatccatgcattcatctatccatccattcatctatctatgtacccatgatctaccatctattcacccatccatccatccatctcatccatgcatccatctatccatccattcatctacctacctacccatcatctaccatctattcacccatccatctcatccatgcatccatctatccatccatctacctacgtacccatcatctaccatctattcacccaaccatccatctcatccatgcacccatctattcatcttcctacctacccatcatgtaccatctattcacccatccatccatctcgtccatgcatccatctatccatccgtctacctgcccatcatgtaccatctattcacccatccatccatcacatccatgcatccatctgtccatccactcatctacctacctacccatcatctaccatctattcacccatccatccatctcatacatgcatccatctatccatccatccatgtacctccccatcacttaccatctgttcatccatccatccttctcatccatgcgtccacctatccatacatctttctacctacctacccacccatcatctaccatctgttcatccatgcatccaggagaaccggaaaaggcccaggtgatgcatccatctatccatccatctttcgatcaaatctccttctccctgtctgtccgccctgcatcaagtctctgtctctctcccctcccctacctgtgtgggccccctggccaagggttctcagcagcctctgctcaccgttctgagctcctgttgcctgctgtgtcccctgtgtcctgctgaaggatccccgcctggctggccaggactccagctctctgctgtctccctcaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagc

SEQ ID NO: 4160 - DNA, 49732 bp, human
aagtgcggacgcccggctcccggcgtggacgccatggtgctgtgcccggtgattgggaagctgctgcacaagcgcgtggtgctggccagcgcctccccacgccgtcaggagatcctcagcaacgcggtacggcctgggcctgggcggggcaggggaccggggacggaggggctgaaccccggagggcccagcgactcaggaactctagggatagggatgggagagtgacccgagacccttagggatgggggaggggagagtgtcccgggacctccagggatagggttggggagagtgacccggaacctctagggatgggggaggggagagtaacccggaaccccctaggcatgggggtggggagtgacctgggtccccatagggatgggggaggggatcgtaacccgggacccctaggaatggggagggtagagtgacccaggaccgctagggatggggacagcagagtgaccccggagccccatggatggggatgaggagagtaacccgggacccccaggcatggggatggggagagtaacccgggacctccagggttggggatggggagagtaagccgagaccccccctagggatgggggtgggggagtaacccgggacccctagggatgggggagaggagagtaacccgggacccccaggcatggggatggggagagtaagccgagacccccaggaatggggttggggagaataacccgggacccctagggatggggttggggagagtgacccaggaccccctagggatgggggaggggagagtaacccgggacccccctaggggtgggggaggggagagaaacccgggacaccttagggatggggttggagagagtaacctgtaacctgggaccccctagcgatgggggtggggagagtaacccaggacgccctaggcatgtggttggggagagtgacccgggaccccctagggatggggagggaggagtgacccaggaccgctagggatggggacagcagagtgaccccggagccccatggatggggatggggagagtaacccgggacccccaggcatggggatggggagagtaacccgggacctccagggttggggatagggagagtaagccgagacccccctagggatgggggtggggagagtaacccgggacccctagggatgggggagaggagagtaacccgggacccctaggaatggggaggtcaagtgacccgggacccccctagggatgggggtggggagagtgacccgaaacccctaggcatggggttgcagggagtgacccagaaccccctaggaatggggatgggagagtaacctgggaccccctagggatgggggaggggagagtaagccgggatccccctagggatgggggtagggagagtaacccgggacccaaaaggatgagggaggggagagtgacctggaacccctaggcatggggttggggagagtgacccaggaccccctagggatgggggagggaagggtgacccgggacccccaaggaatggggaggggagagtgacccaggaccacctagggatggggaaggggagagtaacccaggaccccctagggatgggggtggggagagtaacccaggacgccctaggcatggggttggggagagtgacctgggacccccttagggatggggagggaggagtgtcccaggaccccctagggatggggagggaggagtgtcccaggaccccctaggaatggggaggggagagtgatccaggaccgcctagggatgggggaggggagagtgatccggaatccctaggtatgggggaggggagagtgacccaggaccccctaggaatggagaaagcagagtgacccgggacccctagggatgggggaggggagaataacccaggacccctagggatgggggaggggagagtgagccaggaccccctaggaatggggagggcagagtgacccgggacccatagggatgggggagggcagagtgacccgggacccctagggatgggggaggggagagtgatccagtaccgcctagggatgtgggtggggaaagtaacctgggacccctagggttgggggaggggagagtaacccgggaaccctagggatgggggaggggagagtaacccagaacccctagggatggggttggggagtgtgacccggaaccccctagggatgggggaggggagagtgacccagaacccctagggatgggggaggggagagtgacccagaacccctagggatgggggaggggagagtgacccagagcccctagggatgggggaggggagagtgacccaggatgccctagtgatgggggaggggagtgtgatccaggacctcctagggataagggaggggagagtaatccaagacccctaggaatgggggaggggagagtaacccgggaccccctaggggtgggggaggggagtgacctgggacccctagggattggggaggtgagtgactcaggacttctagggatggagtgggccctgtgactgatggttggactttgtagctggggtatgggaagtgtttcctggtgcccccatgaggatcttattccgggtggtaggacgcctaggtagtgggtgtctgcctctctctggagccctaatcacatggaggagacggtctagtgatgaagggatagttacttgtgatggggggtagttactggtgacaggcggatagttataggtgatgtgggatagttactggtaatggggtgatagttactggtgatgggatagttactggtgatgggggcatagttactggtgatggaaggatagttactggtgatgggggatagttactggtgatgggagatagttactggtgatggggcgtagttaccggtgatgagggatagttactggtgatgatggggcatatttactggtggtgggggttagttactggtgatggtgggatagttactgggtttgatgatggggcatagttattggtgatgggggtagttactggtgatgtggggatagttactggtgatgggaggatagttactgttgatgggagatagttactggtgatggggggatagttactggtgatgatggggcatagttactggtgatgggggatagttactggtgatggtggatagttactggtgatggggggtagttactgggtttgatgatggggcatagttactggtgatggggggtagttactggtgatgtgaggtagttactggtgatggcagagaagttactggtgatggtagggtagttactggttgcctatggatggtgcagtggggcaggagtctactcttggggactacggactggaggtctggtaccctgggaggggggacaccacatgcctggtcctagtgacggggatgagagtggtcagggtgcctcacagaaggcatgggtctccatgattgggggtgacagggcatagggcaggggtctatatgatctggggttgagatctgcagggcaggtccagggcttggtgactggtgccctgaagaccaggatgggcgtcagggccaggatctgggggcaccttcaagaggtgaggagcgctgaggagtgtagaagagtggaagaaagacgaaaaaagaaaagcagcttcacagtcaaagacgggtttattttggagaacaagcctgagcggggcttctggctgagttaggtcaggagtgttctctcttacagactaagggtatttaagggtttaggaaggggaatcttatcgcaggctcggaatgtttccctgtgaggcaaagttgactgaggtgttagaatgtctctggtctgaaggaggttatcttgggcttgggatgtttctggtcagaggcggtttatttcaggctttgactgtttctggtcatgctgacattagccattaggctgatgttttggggctggttttaggcagtttttaatcacgggaacttaaaatggcaatgcttgtccaagatggcggtgtgtgtccaagatggtggtgtgtgtcaaagatgaccatgcatgtccaagatggcagtgcttgtccaagatggtggtgcttatccaagatggcggtgtgtgtccaagatggtggtgcttatccaagatggtggtgtgtgtcccagatggtgtgtgtccaagatggtggtgcttctccaagatggcagtgtgtgtccaagatggtgtgtctccaagatggtggtgcttatccaagatggcggtgtgtgtccaagatggtggtgcttatccaagatggccgtgtgtgtccaagatggtgtgtgtccaagatggtggtgcttatccaagatggcagtgtgtgtccaagatggcggcatgtgtccaagatggtggtgcttatccaagatggcagtgtgtgtccaagatgttgtgtgtccaagatggtggtgcttttccaagatggtggtgtgtatccaagatggtggcgtgtccaagatggcggtgtgtccaagatggtggtgcttgtccaagatggtgttatgggtccaagatggcagtgtgtgtcccagatggtgtgtgtccaagatggtggtgcttatccaagatggcggtgtgtgtccaagatgttgtgtgtccaagatggtggtgcttatccaagatggcagtgtgtgtccaagatggtgtgtgtccaagatggtggtgcttatccaagatggcggtgtgtgtccaagatggtggtgcttatccaagatggcggtgtgtgtccaagatggtgtgtgtccaagatggtggtgcttatccaagatggctgtgtgtgtccaagatggtgtgtgtccaagatggtggttcttatccaagatggcggtgtgtgtccaagatggtgtgtgtccaagatggtggttcttatccaagatggcggtgtgtgtccaagatggtggtgcttttccaagatggtgttgtgtatccaagatggcggtgtgtccaagatggcggtgcttgtccaagatggtgttatgggtccaagatggcagtgtgtgtcccagatggtgtgtgtccaagatggtagtgcttatccaagatagctgtgtgtgtccaagatggtggtgcttatccaagatggcggtgtgtgtccaagatggtggtgtgtgtcaaagatggccatgcatgtccaagatggcagtgcttgtccaagatggtgtgtgtccaagatggtggtgcttctccaagatggcggtgtgtgtccaagatggtgtgtctccaagatggtggtgcttatccaagatggcggtgtgtgtccaagatggtgtgtctccaagatggtggtgcttatccaagatggccgtgtgtgtccaagatggtgtgtgtccaagatggtggtgcttctcccagatggcggtgtgtgtccaagatggtggtgcttctccaacatggccgtgtgtgtccaagatggtgtgtgtccaagatggtggtgcttatccaagatggcagtgtgtgtccaagatggtggtgcttctccaagatggccatgtgtgtccaagatgttgtgtgtccaagatggtggtgcttatccaagatggcggtgtgtgtccaagatggtgtaatgggtccaagatggcagtgtgtgtcgaagatggcaatgctcctgctctgtgaatccagaccctctagttataacaggacgaggggtggtgtgttctttctggccacttcctgctgagggaggtggttattacgggtcaccaaacacagccctggaggggaagaggttgatttgttcctggtagcactctttaggggccttccaagcagcacccgttgaaacatctagcttttagttcacagggctttaagaaagcagaacttgggtttcagaggttttcagttaggaaaaattggagaaaaagaaaaaggaaaagaatgcaaaacattatcttggagacatgtagccagaaaaattagaatttaattcaaaccgtagaaaagaataaaaactgaaaaccattaggcaagactagaatttcacgacaggggtaactatagtttttcaaacacgatttttctttttccagttttcccacttttattaaaagacaaattatgggctgggcatggtggctcatgcctgtaatcccagcagtttgggaggccgaggttggcggatcacgaggtcaggagatcgagaccatcctggctaacatggtgaaaccccgtctctactaaaattacaaaaaattagccgggcgtggtggcgggcgcctgcagtcccagctacttgggaggctgaggcaggagaatcgcttgaacctgggaggcagaggttgcagtgaaccgagatggcaccactgcactccagcctgggcgacagagcaagactccgtctcaaaaaaaaaaaaaaaaatgtcatgagatgtagggaccagccccacagggtcagtggatctctccctgtgtgcggaggcatgagagtgtagaaataaagacacaagacaaagagataaaagaaaaggcagctgggcccgggggaccactaccaccaagacgcggagactggtggtggtcccgaatgccaggctgcgctgatatttattggatacaagacaaaggagcagggtaaggagtgtgagccatctccaatgataggtaaggtcacgtgagtcacgtgtccactggacagggggcccttccctgcctggccgccgaggcagagagagagaggagaaggagagaaacagcttacgccattatttctgcttatcagacacttttagtactttcactaatttgctcctgctaactaaaggcagagccaggtgtacaggatggaacatgaaggcggactaggagcgtgtgaccactgaagcaaagcaccacagggagagggttaggcctccggataactgcgggcgggtctgactgatgtcaggtcctccacaggaggtggaggagcagagtcttctctaaacccccccagggaaagggagactccctttggtgaccccgtctgggcataacagaaggctcgcgctcgtcttctggtcgcacctcaccatgtcccctcagctcctatctctgtatggcctggcttttcctacattatgattctagagcaaggattattataagattggtataaagagtaattactaccaactaatgattaatgatattcatatataaccatatctaagatctatatctggtataactttctcgttttatattttatcatataccggaagagctcgtgtcctcggtctcttgcctcagcacctgggtgtcttgccgcccacaatgagaggtgcaacttgacatagggagggtagaagatagcctgagtatagggaacctcttgccatttcctggtgataaagttgtcaaggtccctgagaatttgcaagttaaaggtgctatgttcgggccatctgctgtcattatgtagtttgtattgatgccagactattgcaataaaaaattcaacactctggctttaggttcctctgtaagccaagtttggccaggttggaaaggagacatcccagagaggaggacataggaatgtcgggttgtttggcacccacgtgggctggtaaaaggaagccgagagtgtctgtttgtgttttaggcaaccccagacaaaagacagagacccagaatcctctttataaggaggacggccaagctgagaagatactgggcatccctcaagatcgcttctagcttagtgccgctggtcctccgaggactgggatggccgacctgacttttcctgggtaccaaaagtcagaggagggcagatcttaccagacggctggatttgtgtctgatgttggatgttcctgttggaattggcaaaggggctcccaaactggagccgcgcagggaagacagagagagagagagaagagggaagaagacggacgaagagagaggaagacgaagcaagggttagggagcgaaatacctgttgcagggggtcagaggtggatttctgagacctgagggttttgagaaccctccagcttgagcctctaagtcccctttacatgagttgtcttcctcacacaaattgcttggaaggtgaatggagagaaaagatgggaggggtggccagagaccctcacgatccaggagttagcccaggatgagctgctgctgcccacagcttcctgggttgcaagagaacctccactcccaacactcaaagagggagagagagaaaggacagggtcagagggccagaggctctaaaggatccaggagttagcccgggacaggctgcccctgcccactgcatcctgggttgcaaaagggcctctgtccgtaacacctgtcctgggtttcggcaccaaatgtaagagtttaagaaggaggaaacaaatatagaaagtgagcctgggcgcagaggctcacatctgtaatcccagcactttgggaggccgaggcgggcggatcacctgaggtcaggagttcgacaccagcctgaccaacatggtgaaaccccatctctattaaaaatacaaaaattagccgggtgtggtggcgcccacctgcaatcccagctactcgggagactgaggcaggagaatcgcttgatcctgggagatggagcttgcagtgagccgagatggcatcactgcccctccagcctgggcgacacagcgagactccgtttcaaaaaaaaaaaaaaaaatacaaaaagtggctcagcaaagggttttggaaaagggggcttctcgcaggctcggaatgtttctgtgtgagggaaaattgattgcggggttggactgtctctggtcggaggggaggtttctggtcacagaggggtttatcccacggctggaatgtttctggtcatgctgacattagccattaggctgatgtttgggggctggatttaggcagtttttaatcaagggaacttaaaatggaagtgtgtgtccaacatggcagtgtctgtccaagacgggggtgtctgtccaagatggcggtgtgtgtccatgatgggggtgtctgtccacgacggcggtgtctgtccacgatggtggtgtgtgtcctcgatggccaaaatggcggtgtgtgtccacgatggtgtctgtccacgatgggggtgtgtgtccacgatggccaagatggcagtgtgtgtccacgatgatgtctgtccacgatgggggtgtgtgtccacgatggccaagatggcagtgtgtgtccacgatggcggtgtgtgtccatgatggcggtgtgtgtccatgatggcggtgtctgtccacgatggcggtgtctgtccacgatggcggtgtctgtccaagatggcggtgtgtgtccatgatggcggtgtgtgtccaagatggaggtgtctgtccaagatggcggtgtgtgtccacaatgacactgtgtccatgatggccaagatggcggcatgtgtccacgatggtggtgtgtgtccaagatggcggtgtctgtccaagatggcggtgtgtgtccaagatggcggcgtgtgtccaagatggcggcgtgtgtccatgatggtggtgtgtgtccaagatggcggtgtctgtccaagatggcggtgtgtgtccaagatggcggtgtgtgtccaagatggcggtgtgtgtccatgatggcggtgtgtgtccaagacggcggcgtgtgtccacgacggcggtgtgtgtgcacgacgacggtgtgtgtcccagatggcagtgtgtgtccacgatggcggtgtgtgtccacgatggcggtgtgtgtccaagatggcggcgtgtgtccacgacggcggtgtgtgtccacgacgacggtgtgtgtcccagatggcagtgtgtgtccacgacgacggtgtgtgtccacgatggtggtatgcgtccaagatggtggtgtctctccaagatggcggtgtgtgtccaagatggcgatgcttttgctctgtcagaggggagatggtcagaggggagatgcggagttccctgcaccctggcagggtgtggcagccaggggctcccccactggaggcatttaccaccatcattcctgaccccacggtctctgcaggggtcactacctctaggccaggcctccccaggggcggtgttgtctcttcctgggtaccagggattgacgtagagccatcattgtctcccttcccacagccatcattgctggcgtttttcctgaatttcctgtgggcaggttgggttttgtactctgccccaaccttcaggtctctgggaatcctcggacactgttggctcgtgggttcaaggcccgagtcaatacctccctgctggcctctttgttcctggcttcttcctttgccaatctcttccctcgagagccaagaaggcccctggtcagtccctgaaggcccctggtcagtccgcggcccactaaccacacttagggaaagccctggtcagtccccggctccccagccacacttagggaaagcttggcggatggatgagctcacctgggacagggtcggggagtgtagcaaacgctatgtgcgtcctgcaaatcttgcatgtcccattcacttttcatagggtctttcattgacccttctgaccccttttctactgttgcagggtctcaggtttgaggtggtcccctccaagtttaaagagaagctggacaaagcctccttcgctactccgtatgggtacgccatggagaccgccaagcagaaggccctggaggtggccaaccggctgtaccaggcaaggggcccctgcccttcggcccttatgaaaattcctttgctgtgatgaggggatttgcgggtggtaaatatacatgacacaaataaacgtcattcaaaagatgcagttggtggcacagcttagctattgctatgttataatgtaatgcactattgcagtaacctaataataccattaatgatacagaattaatggagcttatctgttactgtgtgttataatattctcttgcaattgatacagtatcattgatgatatacaattaatgtagcttatctgttactatgtgttataataatttctcgcaattgatacagtatcatttatgatatacaattaatgtagcttatctattactatgtgttataatatcctcttgcaattgatatcatagtatcattgatgatacagaattaatgtagcttatctattactatgtgttataatattgtcacaattgatatcacagtatcatttatgatatagaattaatgtagattatctgttactatgtgttataatattctcttgcaattgatttcatagtatcatttatgatatagaattaatgtagcttatctattactatgtattataatctcttgtggccggtcgcggtggctcatacctataatcctagcactttgggaggccaaggcggacagatcacctgaggtcaggaattcgagaccagcctgaccaacagggtgaaaccccgtctctactaaacatacaaaaattagctgggcgtggtggcgggtgcctgtaatcccagctactcaggaggctgaggcaggagaattgcgtgaacctgggagacggaagttgcagtgagccgagatcatcccactgcactccaacttaggcaacagagcaagacttcgtctccaaaaaataaaaaattaaaacaaaaattatcttgcaatcaatataatagtctcgttgatgatatacaattaatgtagcttatctattactatgtgttataatattctcttgcaattaatataatagtatcatttatgatatagaattatgtagcttattaccatgccactaagtaatatcggattttaattaaaataatatcatttataatatagaattatgcagtttatctgttgctgtatgctacaatgcaatatacaattataattaatatactactatcatttaagatttaagattcatgtagcttgttactatgtttgaatataatattgcaattaatatagtaatatcagttacgatatagaattaacatccattactatgtgttgtgatacatagaattaatatgttactgtgtgatactatgtaatatactatgacaattaatataattgtatcataatgtagaattatgtcatttatctgttactatatgctcctatgtaatacatattattttagtagagatggggcttcaccatgttggccaggctggtctccaactcctgacctcaggtgatccacccgcctcggcctcccggagtgttgggattacaggcgtgagccaccgcaccccaccgtaatacactattataattaatacactactgtcatttaggatgtacaattaatgtagcttatcaattactatatgttatatatgactctaacataatgtcagtcacagtatataaaattaacatagctattactgtgtgttttaacttgctgttacaatgaatataatgctatcatttaggatatagagttaatgtagcttccctgctgctgtgtgttaccacacaatataccattactgttaatataagaaatacattcggggccgggtgcagtggctcacacctgtcatcccagcactttgggaggccgaggcgggcggatcacgaggtcaggagttcaagaccatcctggctcacacggtgaaaccccgtctgtactaaaaacacacacaaaatattggctgggcgcggtggcgggcgcctgtagtcccagctactcgggaggctgaggcgggagaatggcgtgaacccgggaggcggagcttgcagtgagccgaggtcgcgccactgccctccagcctgggcgacagagcgagactccatctcaaaaaaaaaaaaaaagaaagaaagaaatacattagaggtaaggctgttgtgagtcgtgctatcaagacaggagtattgattgtgggttttggcagtgcacagcttagggaggccagtgcggggctgagctaaggtcaaagctgcacacagatgtcctgtgactgcctgttgctctgaggctgaattttcaacctggatttgttttatcgtcctaagtacctttttctttttctttcttttccttgtttttttttttctttttttttttggagactgagtctcactctgtcacccaggctggagtgcaggtgcgcaaccttggctcactgcaacctccgcctcctaggttcaagcgattctgctgcctcagcctcctgagtagctgagattacaggtgcccgactgatattttgtatttttagtagagacggggtttcaccatgttggccaggctggtctcgaactcctgacctcaggagatgcgcccgcctcggcctcccagagtgctgggatgacaggcgtgagccaccgcgcccagccctaagtagctttttctgaaattacattgaacggatcaaaaaccttttggccttaattctgggtaactcagggaggtttggggcccctgaatcaaaccttacctgccgcccggaagaacaaaagcttacggaacaggcattgcgtttcccgtagtgcccgtgagatgctccgtgagtgcctgacccctgatcacgcagcccccgtgggccccggcctcacccacgttccagcccctgcagggcgaccaccggcgggacccacttgtgtccttgctcgtgaccttgagcacccccagccttcacttccaaagtcggcctggcttcgcccctgcggtgctctttcacgcccgtaccgacgggaaaacttctctgtgagacccacggcacgtcaccggtaaaccggaatctggttttcttacagaaagacctgcgggcccccgacgtggtcattggagcggacacgatcgtggtgagtgcggccagggtgcctcgtttctaatgtccgatgtggttttcctgtgcttggtgattctgcctcttgtggatgttgtacattccccttaagacagcagtggactcgcttccagaaactcccatcacaaactaccagcagatgaggggcctaagggcacgggaaggggccaggcgccgtggctcacccctgtcatcccagcattttgggaggccgaggtgggcggatcaccttaggtcatgggttcgagatcagcccgaccaacacggtaaaaccccatctctactaaaaatacaaaaattagccagacgtggtggctaattgatagtatcataagtgatactatatgatatcaattgcaagagaatattataacacatagtaacagataagctacattaattctatatcatcaatgatacagaatacagactccgcctgtaatcgcagctactcgggaggctgaggcaggggaatcgctcgaacccaggaggcggggttgcagtgagccgagatcgcgccactgcactccagcctgggtgacaagagcgagactccgtctcaaaaggcacaggaaggtacgcagttctagaggccagcaaccacaaatcacggtgtctgtagggtttcttccttccagaggtactgaggagaagttggtcttggtctttctccagctcctagaggctgttggcaacccattgtctcctttggctcatggccctgtggttcctatctgtgcctccatctccatgtggccttctcccctctgggtgtctgtggccaaatttccctcttcttttttttttttgagagagagtctcactgtgttgcccaggctggattacagtggcgtgatctcggctcaccgggacctccgcctcccgggttcaagcgattctcctgcctcctgagtagctgggatcacaggcacccgccaccacgcccggctgatttttgtatttttagtagagacggggtttcaccatgttggccaggctggtctcaaactcccgacctcaagtgatctgcccaccttagcctcccacagtgctgggatgacaggcgtgagccaccgcgcccggctgaaattttccccttcttttaacaacaccactcataaaatgcgcatcctaattctgtccaaccgcatcttaattacctaggcaaagacccatttctccttttttttttttttgagatggagtctcactctgtcgccaggctggactgtagtggcatgatctcagctcattgcaacctccgcctcccgggtttcaatgattctcctgcctcagcctcccgagtagcggggactacaggtgcgcgcgaccacgtgtggctaattttttgtatttttagtagagacggggtttcaccatgttggccaggatggtctcgatctcctgaccttgtgatccacccgcctcggcatcccaaagtgctaggattacaggcgtgagccaccacgcccggcccatgtcttttgttcataagccacccagtctatggtattctgtgatagcagcctgaaatggactaagacatctcataagaagaggagatgaggacacagacacacacagagggacgaccctgtgaggacacagggggaagacggcgtctccaagcccaggagagaggcctcaggaggaaccagccctgcccacacctggatctcagacttccagactccaggattatggaagaatcaatgtctgctgtttataagccacccagtctatagtattgttttagcagcctgaaatggactaagacacctcataagaagagcagataaggacacagacacacacagagggatgaccctgtgaggacacagggagaagacggcgtctacaagcctaggagagaggcctcaggaggaaccagccctgcccacacctggatctcagacctccagcctccagggctgtgggagaatcactgcctgttgtttataagccacccagtctgtggtattctgtgacagcagcctgagatggactaaagcatctcataagaagaggagatgaggacacagatacagagggacgagtctgtgaggacacagggagaagatggcatctccaagcccaggagagaggcttcaggaggaaccagccctgcccacacctggatctcgcccttccagtctccacgacgatgggagaatcaatgtctgtagtttaagccacctgggttgtaggactttgctatggtggcccagtcagactaatacatctactcttgtatgtacccaaaaggattcaaaacaggtgttccaccaaaaccttctacatgaatgttcacagcagcactattcacaacagctaaaaggcagaaacagctcaagtgtctgtcagtgggtaaatgggaaattacaacatggtccatccacacacagtggaatattatgcagccatgaacaggaatgaggctggccgggtgcggtggctcacccctgtcatcccagcactttgggaggccgaggcgggtggatcacaaggtcaggagatcgagaccatcctggccaacatggtgaaaccccgtctctactaaaaatacaaaaaattagccgggtgtggtggcgggcgcctgtagtcccagctactcgggaggctgaggcaggagaatggcgtgaacccgggaggcggagcttgcagtgagccgagatcgcgccactgcactccagcctgggtgatagagcgagactctgtctcaaaaaataaataaataaaaaataacaaaaattagccaggcatggtggtgtgcacctgtattcccagcaactcgggaggctgaggcaggagaatcacttgaaccccggaggcggaggttgcagtgagccaagaccgtgccactgcactccagcctgggcgacagagtgagactccatctcaagaaaaggaaaggaacgaggctgtgaaacaggctgcaacatggatgaatgttgaggacatcacggtcagtgacagaaaccagccccggaggaccacacgttgcaggattccatgactacaccacgtccgcaacaggcaaacgcacggtgaaagaaagaggatgggcggttaccaggatctggggaggcgcactggggagggacagctgcgtggggacagggtctccttctggagtgaagagaacatcctggaaccaggcaggtagtggtggtacaacatggcaactctggttagttgtttgaaatggcgactctcaggacgtgtcagcttcatttccataaaacaagtgacttctgcgaatgggaccgtgggacttgcacaggcctgacccagccggtgggaaccaactccctctgtcccttcctctcacagacagtcggggggctgattctggagaagccggtggacaagcaggacgcctacaggatgctgtcccggtaagcaccatgttggcctctgagccctctcgggttctgagccacagagtagctgtggtatctggccgggtgtcctggggagcagggtggatctctgtcagctctgccgtctgagctgtgctgtctgagctgtgctgtctgagctatgcagggaggcaggcactatccctccatgctcatccttgtctaggattctgcagcactgatcccagaatgtctcatgcccactgcagactgttggggtcatgagaagttggcagtgtcctgtccttcccactgggcatcctggacctgagcccgtagcctgggacgtcatccccatcccaggacgtggaagagatgcaccccctgcccgccataggcccagctgagagctgcctggcctggcgcctcccgtcagggccactgctggtgggatttgtgaccccttccctcggcctctccgtaaaggtttccctggagaccccacagcgggacgatcggggagaagatgctggggacggatccaggattaaggacgcctcgctgcctcccctggttttgagaaactcgctttgtagctcccacgggtcacagcatggtcacgtggtcacccgttgttgtcttacaggttgagtgggagagaacacagcgtgttcacaggtgtcgcgatcgtccactgctccagcaaaggtaaccgcggcccaggtttcggggtagccccagaggccgagacaaggacccgggacattctcgggacccttggcttgagggaggaggacggttgctcacccccacctgtggaggggtttgtgcctatgtcctgcttgggaaagttgtccgccgatttggaagtctgcaggacaaaggaaaacgtgtggttttatctttttctttttctttcttttttttttttttttgagatggagtctcgctctcttacccaggctggagggcagtggcacgatctcagctcactgcaacctccgcctcccaagttcaagtgatccttctgcctcagtagctgggattacaggtgcccaccaccatgcccggctaatttttgtatttttagtagagacggggtttcaccatgttggccaggctggtctcgaactcctgacctcaggtgatccacccgcctcagcctcccaaagtgctgggattacaggtgtgagctactgcacccggcctttctctttctttctttcttttttttttttttgagacagggtctccctctgtcacccaggctggagtgcagtggtgtgatcatagctcactgcagcctcgacctcctgagctccagcgatcctcccgcctcagcccctacagtcacagaaactacaggcacacgccaccacacctggctcatttttgtattttttatagaggtgcggtcttgctatgttgcccagactggtctcgaactcctgggctgaagaaatcctcccatctcagcctcccaaagtgctgggactgcaggtgttcaccatattgctgggactgcaggtgtgcaccacggtgcccggcccaggcagttgtatcaccatattgctgggttcttcctgcaccaacccattcccagcttgttggcggacaccaggaggcatcgtagaattcagtcagttctgacagtagccgtcggagttagcgcagatcccacaggtgaagggccgggtcccatgggacctccacgcacaatcccagccccatatccctggtcacacctgtagttttctcacccacctgccgctcactgctggctcctgcaagcacctgctcaggttgggtcatttgctcgaggggctcacagaactcgggacagcactttccttcccagcttggggttttgttatgaaggagcaggtcaggaagtgccagacagaagccaggcacagcgcagggtgctgggtgcaggatgtatggagcctccatgcccgccgtggcacagctctgccaacaccctgatgtgttcacccaccagaagctccctgaaccctgtccttctgggtctcttttttttttcttttttgtgacagagtctcgctttatcgcccaggctagagtgcacttgcgccatctcggctcactgcaagctccgcctcccgggttcacgcccttctcctgcctcagcctcccgagtagctgggacgacgggcccgccaccacgcccggctaattttttctattttttttttttttttttttttagtagagacggggtttcaccgtggtagccaggagggtctcgatctcctgaccttgtgatccgcccgcctcggcctcccaaagtgctgggatgacaggcgtgagccaccgcgcgcggtcccttctgggtctcttaaaaggccaggattaacgacatcatccgccactggggagcaaactccatctccagccccctccccctgttcccatgacaaccaaagcctgccctttccaaaaggcccctcattaacataaggtcccctgcggatgaaaggggcttgtcaccacatagcaaaacgcctgctttcgctcctgtcactcaacagattccccgggattcaggggctctgtgtccggaccctgaggcacagaccaaacatctgtttcttttattatttatttatttgagacagagtctcgctctgtcgcccaggctgcagtacagtggcgtgatcttggctcactgcaacctccgcctcccgggttcaagcgattctcctgcctcagcctcccgagtagctgggatgacaggtgcatgccaccacgcccggctaatttttgtatttttagtagagacggggtttcgccatgttggccaggctggtctcgaacccctggcctctggtgatccatccgcctcggccgcccaaactgctgtttcttttgttttttttagagacggagtctcgctctgtggcccaggctggaatgcaggggcgcgatctcggctcactgcaacctgcacctcccgggttcaagcgattctcctgcctcagcctcccgagtagctgggactacaggcacctactaccaggcctggctaattttttgtatttttagtagagacggggtttcaccgtgttagccaggatggtctcgaactcctgacctcgtgatccacccgcctcggcctcccaaggtgctgggatgacaggcgtgagccaccgcgcccggcccctttctcccttttcttgtccgaaatgaaccttattctcccatgaagcatccatatctgaactgtgcgctgcgctcgagtacacacctccacagcacagccacgcagctgtcagggcacggaggtgacaagctggcgtccacgctcacccccacggctgtgtccttgcagaccatcagctggacaccagggtctcggaattctacgaggaaacgaaggtgaagttctcggagctgtccgaggagctgctctgggaatacgtccacagcggggagcccatgtgagtctcgggggcggtggggggacgggggacacgtgtggaagcctggccaccctcacacgtggggtgtcccacccagcctttgggaaagaaggaggccccgctccgggggccgtgtggcacagggagagccgcccggctcagaagcacaaacccttcacgaccacactgacccatggaggctcaaagaggcaaactcccaggacagagaggggcagggtgggagccaacgctgggctgcggtggggactggggaggcgctgggcaggggtagaggagttcacgtggtgggaggaggagaccccagaggtctgtgcccaggacgctggctgcaattaacacgaataaactctgtgatccaaagtcaccctaagaggtgattctacctgtcgtcccgtccacagattggtgagcacgggaagtatgcgtgcaccaatcagcttcacttcatcacccaccatttgcgtttatatgtattatatttatctacatcatatgtcatataatgtctacataattatacattatataatgtaacatgatatatatttacaattatatataatttatgtattccacattatatattctattaattatatataatctacattatacaaattatataatatatatttataatatattgtattatatactataatagattatactgtaatatgtatactatattacatatagatattataatatagattatatattaacacttttgattgaaatttaatgatttttaatgattaattttaataagtagtgattaatattaatgtaatatataccatctattataatatatactgttataatagattatatgataggttatataactgttaaaatagattatataataggtagttataatcgattataattatatataaattatataatttatatttataattatttataattatatataaaatatataattttatatattttatatatttaattttatttatatataaatatataattacatatatttataattatatataaatataatttataattatatataattaattataaatgatatataattatatataattataaacaattatataaatataaattatatataattatatatataattataaaatgattatatattataaaatataattatatatttatataatatagaaatatatgaatatatggataatatgtaatatgtattaaatatgattaatatatgtaactgcatattaatacatattacataataatataaagtgtgattatatgtaaattatatattaattaaatatatgtaatacatattagttatatataatatataatgtattatgtgttatataaatatataattatataaaatatatttttatattataaaagtatataaatatataaatatatgtatataaatacatttgtataaaatatatgtttattttatatatttatataaataattttatttatttttttgagacacggtctcactctgtcacccaggctggagtgcagtggtacagtcatagctcactgcagcgtcagcctcttgagtcaaaatgatcctctcacctcagccccactagtggctgggtctgcagacgcataccaccacgcctggctaattttttctattttttgtagcaatggggtctcactatgttgcccaggctggtcttgaactcctgggctcaggcgatccttccaccaaagcctcctgagtaggtgggaccacaggacacgcaccaacacacgcggccgattttattgttagtttttgtagagatggagtctgcgtaatatatatgtatattaacctagaggattttacatcaattgaaataagcccggcagaagaagacacataccacaggatctcacttatatggaatataaaacagttgcacttggtcaaaggatacaagatttaaatcagggccaggcatggtggctcacgcctgtcatcccaatactttgggaggccgaggcaggcggatcacctgaggtcagaagttcaagaccagcctggatatggcaaatcccaatctctactaaaaatacaaaaattagcccggtgtggtggcaggtgcctgtaatcccagctacccaggaggctgagacaggagaatcgcttgaacccagcaggtggaggttgcagtgagccgagatcgcgccactgcactccagcctgggcaacagagcgagactccgtcttttaaaaaaaaaaaattaagtgagacgggagaagttcaaggctctttacagcctagtgactgtggtttacaggaacagtgtcttactggaaaattgccagcacactacatctgaagtcttctccccacacacacagaataggtacatgaggtgctcgatgggataattggcttgatttaatgatgtcacatgtatacatatatcaaaacatcccatttaacacatgaaattttttttgagacggagtcttcctccgtcacccaggctggagtgcagtggcgcgatcttggctcactgcaacctccaccttccagtttcaaacgattctcctgcctcagcttcccaagtagctgggactacaggcacccaccgccacgcctggcgaattttttatttttagtagagaaggggttttgccatgttggccaggctggtctcgaactcctgacctcaggtgatctgcctgcctcagcctcccgaagtgctgggagccaccgcgcccagcccaacacctgcactttcatacatactttaatgtttacatacatttaaagaaagacaggccgggcacagtagctcaagccaagacgggaggatcacttcatcccaggagttcgagaccagcctgggcaacagagtgaaaccccatctttataaaaaatgataaaactagctgagtgtgtccctgctacgtgggaggctgagattacagcatcatttgagcccagaattttgagggagcagagaaccaagaatgtaccactgcacttcagcctgagcaaccgagtgagaccctgtcttgaaaaaaaaaaatagataaaataagaaagagaaaagagggccagacgtggtggttcacacctgtaatcccagcactttggggggccgaggcaggcgcatcacctgaggtcaggagttcgagaccatcgtggccaacatggtgaaaccccgtctctactaaatacaaaaattagccgggtgtgttggcaggtgcctgtcatcccagctacccgggaggctgaggcaggagaatcgcttgaacccaggaggcggaggttgcagggagccgagatcgcgccactgcactccagcctgggcgacagagcgagactctgtctttaaaaaataaaaataaaaaataaaaaagtgagacaggaggaagaagttcaaggctctttacagcctgtgactgtggtttataggaacagtgtcttactggtaaattgccagcacactagatctgaagtcttctccccacacacacacacacaattcgtagatgagatgctgaatgggataattggcttgatttaatgatgacgcatgtatacatatgtcaaaacatcccatttaacacatgaaattttatttatttatttatttatttgagacggagtcttcctctgccgcccaggctggagtgcagtggcacgatctcggctcactgcaacctcctcctcctgggttcaagtgattctcctgtctcagcctcctgggtagctgggattacaggcgtgtgccaccacaccacacccggctaatttttgtatttttagtagagatggggtttcaccgtgttggccaggctggtcttgaacttctgacctcaagtaatccacccgtctcggcctcccaaagtgctgggattacagccgtgagccattgcgcccagccttgctgtgaaattgtttttctttttttttttttttttgagatgccaaaggcgcctgcccccacgcctggctaattttttgtattttttttagtagagacagggtttcactgtgttagccaggatggcctcgatctcccgacctcgtgatccacccacctccgcctcccagccgtgaaatgttcagacccaggaacttttctcctccttgtcacctcttaccttcccctgcccacccagggacaaagctggcggctacgggatccaggccctgggcggcatgctggtggagtccgtacacggggactttctgaacgtggtgggattcccgctgaaccacttctgcaagcagctggtgaagctctactacccgccccgtccggaggacctgcggcggagtgtcaagcacgactccatcccggccgcggacaccttcgaagacctcagtgacgtggaggggggcggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaaggtacctgtgtctgtctcctcaggccacatttcacaaatgagcctacacactcggcttaaatcaaagggaatttacttctcactgtcctggaggctggcagtctgaggtcaggttgtctcagggccatgctttctccgaaggttctaggagagggtccttcctgcctctcccagctcctgacagctccaggcatccctgggcttgtggccgcatcactccagtctctgccacgtcctccacgtggcctcatccactgtgtctgtgtctcctcctctgtctcttagaaggacacctgtcattggacttggagtccacccttcttcgtgatgatttcctcttgagattcttaattacatctgccaagacccctttttaaaacaaggtcccattcacagattctggggatcaggatatggacagatctttcaggaggaccacagttcagtccactacagatgtatccagttccttctggaggccccaggggagggtccttcctgcctctcccagctcctgggggctccaggcatccctgggcttgtggccgtatcactccagtctctgcctttgtctccacgtggccttctcctctgtgtctgtgtctcttctgtctcttagaaggacacctgtcattggattttgaggtctccctaatccactgactccaactcatctgaagtcccctagcttacttacgtctgcaaagacccttttttctttttctcttttttttgtttttgtttttgtttttgagacagagtctggctctgtcatccaggctggagtgcagtggcatgatctcggctcactgcaacctctgcctcccgggttcaagcgattctcctgcctcagcctcctaactgtggtcctcctgaaagatctgttcatagcctgatccccagaatctgtgaatgggaccttgttttaaaaaggggtcttagcagatgtaattaagaatctcaagaggagatcctgagtagcctcaggagtagcctcctgattacaggcgcccaccaccaagcccggctaatttttgtacttttagtagagacagggtttcgctatgttggccaggatggtctcgaactcctgacctcagctgatccacccgcctcggcctcctaaagtgctgggattacaggcgtgagccagcgcgcccggcctgaggccccatctttcagctgttctgttcaggggcccctcacggtggcagcctagaagggatgcagccctcccaacaccaggggtccctcacagggcgtcctccgggaagcagaggtggggatgtcgggtgcaggagggacgcaggctttgggagacagggagacgggctgatgacacctcctgccattcatcatcaggagagagaacatgcagtgaataaggaataaaggtggttacagcacattccgtctgtgcctctaatttaccaagtggtgattattaaatcaccaccaggtggtttataaacaacagacattgattctcccacagtcctggaggctggaggtccaagatcaacgtgtgggcagggctggttcctcctgaggcctctctcctgggcttggagatgctgtcttctccctgtgtcctcacagggtcgtccctgtgtgtgtgtctgtgtcctcatctccttttcttatagggaccccagtcctattggattagggtccacccaaatgacctcattttacctgaatcacttctttaaaaccctgcctacaaatacagtcacatcctgagggactggggggattaggagttcaacatctgggttttgaactcagtccatatcggcagcatgttgatttttctcccatgggctagtttttctgcatgatattcgttgatgtgctttttccttgtgtacaccttgttttatagctggggacttgatcctataaatccccaccgttctctgtgaaagaaggctcaatggccaagttgtatacttccgacagcgttggcctccatcttttgagtctgtgggagtagaaagtactggacaagggacttaatgagtctctctgcacttgcttttaacagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggtgacaggacccagcgggttttgctctgaggatctttgcaggtggaagtcactgagggaaggtgacctggagcctgggcagagcgaggaaggaggcccacaccttctgtccctctgccctcaggaatgctgcttttcccgaaaggttgagaagcagagggtgaatgacagagagggaacagtggcagccgcgagcacataggagaagcgtgacctccttatgggctctagtctcaaaggggctgtatcagtccatgttctcctgagaaacagaacccaatacggtgtacacagacattgatttagttgcttatttatttttatagacaaataacgtagatggatgggtagacagatacatagatagatgataaatgcatagatacattgatatagattgacgatagagagatgacagatacatagatgatgggtagagttgatatataaatggatggatggatagatggatggatggatggtaggtggatagatgggaggaaggatggatggatggatggatggatggtaggtggatagatggatgggaggagggatggatggatggatggatggacagatggattgatcaatggatggatagatacatggatgggaaggtggatggattggtggatcagtggatgggtggatggatgggtgggtgggtggatggatagatggatggatggagaggtggatggataaatggaagggtgggtagatgggtgggtaagtggatggatgggtggatggatgagtgggtgagtggatagatggatggatgtgtgaatggaaggatgtgtggatggatgggtggatgactggatggataaaggtgggtagatggatggatggatcgatgaatcggtggatgagtgcatagatgggtgggtaagtggatggatgggtggatggataagtgggtgagtggatgggtggctggatggatggatggacggacagatggatggatggatggatgtgtggatggatgggtgagtggatagatgtgtggatagatggatgagtgggcgtgtggatgggtgggcgtgtgaatggatggatgagtggatggatgggtgcacggctgggtggatgattgggagtgtgggtgaatagacggatgggtgggtggacagatggatgggagggtggatgaacagatatatcagtggatcggtggttgggtagctgggtgggggaatggatggatgaatgggtaggtgggtggttggatgggtggatggatgagtgggcatgtggatgagtgcatgaatggatggacgggtgcatggctgggtggatgatggggagggtgggtgaacagatgggtgggtgggtgggtggatggatggatggatgagtgattggatgggtgggggaatgaatggataaatggatgtggatggatggatgcatgcatgggtggatggatcagtggatccatcagtggatgggtggatggatgggtaggtgggtgggtggatggatggatggatggacagatggatggatgagtgattggatgggtgggggaatgaatggataaatggatgtggatgtatggatgcatgcatgggtgcatggatcagtggatccatcagtggatgggtgaatagatggatgggtaggtggatggatggatgagtgggcatgtggatgggtgggcgtgtgaatggatggatgagtggatggatgggtgcatggctgggtggatgattgggagggtgggtgaatagatggatgggtgggtggacggatggatgggaggatggatggatagatgtatcagtggattgctggatgggtagctgggtgggggaatggatggatgagtgggtagatgggtggatcggtggattggatgggtgggggaatgcatagatgagtgatgaatgggtggatcagcagatgggtgggtggatgactagatgggtgggtgagtggataactggatgggtgggtgagtgggtggatggatggatggatgacaatgtgttttctgaattgaacagaactcttcagcatggtgctagaatagagagcacatgaccaagtccttgagtagcctgggaagggcaggacaacagatgacacctgggcagaggtggctgtgcttctgtgattaggagacaaagcatgccctggttgaggctccaaaggctgtgcccttaccacagagacatgtgactatatccttagaggctggaacatagaagccagaacatcttccccagccagagcagttcaggaccattctcccgtattgaaaataatgatgaataggccacgcctgtaatcccagcacttggggaggccaaggcaggcagatcacgagttcaggagatcaagaccatcctggctaacacggtgaaaccccgtctctactaaaaatacaaaaaattagccgggcacggtggcgggtgcctgtagtcccagctactcgggaggctgagggaggacaatggcatgaacccaggagacggagcttgcagtgagctgagatcgtgccactgcactccagcctgggggacagagtgagactccatctcaaaaaaaattaaaaaattaaaagaaagaaaataatgatgaatatggagaaaggcttttcatcaccggcaccatgcaagcttgttccaactccttttgacaacgctttgtgcagttgagtcctaggagcagttccacgtctgcagaggctgctcctgcttcaccataggtctcatcatttattcatgatgaaaataaatgtcatctatctgactatagcaaaccgtacactcagggtcagctcggtgggaaaacagtaacatttcatcattaacatgaacacagggctgtttcttacataggaggaccggagtggtgcgaggccatctgtttccatatacgggtctccaccaacaacttctccaccttccagcctcccattctgtgggagggggcatcctggaagggagcttggggactgggtctatggacagctgacctgggcatgaagtgggtggagaatgaagttccctgtatcatttggggctctccagggtaacagaacccctaggatataacctaggagatttatcttgaggacttacgtgattgtgtaggctggcaagtccaaaatccacagggcaggccaggaggctggaagctcaggcaggagctgctgctgccatcttcaagtggaatttctcctccaggaaagcccaatgtttgcttctggggttttcaatgagctggatgaggccaatgcacattttggggggttaatctccttaaagtcaaactgatggtagatgcaaacgccagctacagcacacctccacagccacatctagatgggtgtttgcctgcataactgggaacttgagcgtggccacgatcatgaagaaaggatcagcctcagtgggtaacagttacagcagttgacagctggggcgtggtggctgctgttttcctgcccagctgaccctgagtgtacagtttgctatagtcagatggatgatgtttattttaacatctcaatgatgcatcccctatggtcaggtttccttgagtgtacggtttgctatagtcagatgggtgatgtttattttaacatctcaatgatacatcccctacggtcaggtttccttgggttttctcgttaggaggtcacacgactgtccccatttctccaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggtagcataacacccccgcggacacctttccgtctagcgtgcattttgctaaaacactttgacacacagatcagtaggcaccttgaccagtctgtctccagtctgacagatcccaaaggcttggctcgttctgcctggagaacttagtgccgtggctcttgtgtcactcagccctggaacaggtgcaacttagacatcctccactgttatccagcagctgatgaaaatagaatttcctcctagaaacaggtttgaaggccatgctcaggggctcacacctgtcactcccagcactttgggaggccaagttgggaggatgatttgagcccgggagtttgagaccagcctgggcaacatagtgagacccccatctctacaaaaaattaacagttaggctgggcatggtggcatgagcctgtaatcccagctagtttgggaggccaaggtgggctgatcacctgaggtcaggagtgcgagaccaacctggccaacgtgctgaaaccccatctctactaaaaatacaaaaaaaaaattagctggggatgatggcgcgtgcctgtagtcccagctactcaagaggctgaggcaggagaatcacttgaacccgggatgtggtggttgcagtgagctgagatcacgccactgccctccagcctgggtgacagagcgaaactccatctcaaaaaaaaaaaaaaaaattaacgattagccaggtatgattaggcagctactttgggaggcccaggtgggtgggaagatcacttgaacctgggaggtcaaggctgcagtgtaagccgtgatggtgctgctgcactccagcccgggtgacagaacaagactctgtctgaaaaatagaaataggaaggagttggacaggctgccttaaatgaatgccctgtttcttctttgcttcaatggaactgacacttgcttatctgaggccgctgtttgcaaagcgctccctgcatcctctcgcccctccttcccctttccccgcccagaaccttcctgaggtggacgtgtgagatatggtggggtccgtggggcctgtgcagatgggtgggtctcggtctgcagggctgtgccagccaggcgtggggagtctgctgtgggctcggctggccgtggcctcatgcctccttggcagcgctggccgagcttctgtggcagtgagcacggagtcagggtgtgtgtgtgtgatgcagagatgagccccagggagccgggggcttcctgcagatgttggggagagacatacagacagggagacacagagagagagataggcagacagaaagatagagggagacagagacagacagagatggaggcagacagagacagggagatagagggagacagaaacagggagacagaaagacagagacagagatagagtgagacagacacggagatgggagacagatagtgagatagggagagagatggagagacagggagacttgagagacagagggaggcggagacagagatagggagacagaaacaaagatggagacagacagacacatagagggagatgggagacagagacagggaggcttggagagacagagatagaggcagatagagacagaaacaggagacagacatagagacagagacagagggagatagaaagaaacagagacaggagacagaaacagagagagagaaagaggaagacagagacacacagacggagacagagacagacagacagagaccaagggagaaagagtcagagagagaagccagtggtggagaagccgagaggcacggacaggggccctgagctggcgtgagcagccagcgtgggcatcgcagaggacagatccctgagccccatgattgccacccacgcaggggagggccggggagcccccgcgagatttagggagccaggatggagaccggctgtcctgctgggagcggggctcagaagcatcctcagctgggcttgcttgccctgcagggacgggatgtccaggcgaaccctggacacagcactgagccaggatgagcctgggctcctctgggacccggggtaggtgccactggggggacttggagaagctcggaggagcttctcctctgcacaccagaattctcggaggagccccctctgcacaccgcaccattgtggtgaaggctgagccggggcacctgcagagacattgtggcttctctcctggttttctccagtgaggtgtttgtgggccacccggagcctccagggtgaaaagctttattgtgaaaagcctactgcgaaagtcagacgcttggagttcaggctgtggtgtggaccaagtgattccaaggagatcgtccaccactttggggtcctctgtccccagccagcccagcccccacacagacaagagtagcccacacagctgtggcatgaagcccgctctgcagcccaggcgcggctgagcccccacgctctggagccctgcacttctccccccgacccccagggagaggctgggcgagccctcgccccgtgttctctggtgcccctaagcacctgctgtgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggtgggtggcccccccgccagggctctccttactttcgtttattaagccacaggtatcttccctgctcaggacacctaccaactgcctttttccattgacaaacctgataacgacctgaaccgggccaggctgagtcccagatcatgggtggatattcccaagttccaggaggaccccggggatgcctaaatgcccccctagaaactccggggccctctcttttggctgcggagctgaggcagagcaccttggaacccctggattcccctcagcaagtctgattatatcctgactcaccctccaccccaccccagccctggacagtgggtggagcagtagacacattcccaagggctgctgggggatcggggcctgggacgattctcacaccatcagcttacatttccccaacctctgaatgcctctcctccttgtggtccagagtggctgctgtagcaccagccatcgtgtctgcatccccatggcaggaaggagaagggaggagtacagcccccacccctgggcagaaaggatttccctgtaggtctgtgccccctacacgtggcccagagtggctgctgtagcaccggccattgtgtctacatccccacggcaggaaggagaagggagtacagccctccacccctgggctggaaggatttccctgcaggtctgtgcccccacactcacctgcttgtacagtcttgtctgggataccagcgagctccccaccactggctttcccttccagcatgggaatcaatgccatgcccttgaacattacttctgccccagttgagctttggagagtcgtcagagttccatagacgacccagccacagagcatgcatttgcttccccgcaggctgcacgggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgagccctcctcctgttcaccctgctaaccttttccagactgcagcatctctttctagacagagggcatggctgtgtgtgcacctgtgtttctgcctgggcgtttccatggtgggtatgtgtgtgcaaatgggactgtctacggtgcttgtgtgtgtgtgtctctctgtgtgcatgtgtgtggtatgccctggagcatacctgtgacatggagcatgtctgtgcgtgagcatgtctgtgtgtgtgtgtgtctgcatccgcatgtgtgtgcacgtctctggtgtgtggttgcatatgtttctgtgagagtatgtgtgtgtgtctgtgtgggtatatgtgtgcatgtctgtgtgtgtgtgtctgcatctgtgtgcatgctgtgagccggtgggtgtctgtgtgcatatgactgtcgtgcttgtgtgtctgtgtgcatgtgtgtgtgtgtgcatgtctgtgtctgtatctgtgtgcatggtgtgtgtcttccgtgcatatgtaactgtgtgtgcacgtctgtgtagtatgtccttgtgtgtgtgtctgtgcatgagactgtgtgtccacgtgtctgcaagtctctgtggtgtgtggttgcatatgtttctgtgaggtgatgtgtgtgcatccgtgtggatatatgtgtgcatgtctgtgtatgtgcgtctgtgtgcccgtctgtgtctgcatttgtgtgtatgctgtgtgctggtaggtgtgtgtgtgtatgtgactgctgtggttgtgtgtccctgtgtgcatgtgtctgtgtgtacgtctgcatctgtgtgcatgctgtgggccggtggttgtgtgcatatgtgactgctgtggttgtgtgtctgtgtgcatgtgtctgggtgtgcttgtctgtgtgtctgcatctatgtgcatggtgtgtgtctgtgtggatatgtgagcatctgctgtgcttgtgtctgtgtctctgtgtgtttctgagtctgtgtgtgcacatctctgtgtggtatgtccttgcatgcgtgtctgtacgtcagaatgtctctgtgtctgagtccgtgtgtgtgtgtgcacctctgtggtgtgtatgtctctgagggtatgtgtgtctgcgtgtctgtggatatatgtgtacatgtctgtgtgtgcatgtctgtgtgcccatctgtatctgtgtgcatggtgtgtgtgcatgtcactgctgtgcttgtgtgtacgtctgtgtgtgcatgtgtctgtgtgtgcatgactgactgtgtgtggtatgtccttgtgtgtgcgtgcgtaagaatgtgtctctgtgtctgcatctgcgtttgtgtgtgtgcaactctctgtggtgtgtgcttgcatatgtgtgagggtatgtgtgtttctgtgcgtctgtgtgggtatatgtgtgtatgtctgtgtgtctgcgtctgtgtgcctgttggggtatctctgtgtgtccgtgcgtgtgcccatctgtgcatgtctgcatccgtgtgtgtgtgcctgtcgctgtatctgtatgtccatgtgtgtctgcgtgtccatctgtgcatgtctatgtttatgtgcgtgtgcctgtctgttggtgtatctgtatgtccgtgtgtgtgtgtgcccatctgtgcatgtctgcgtctgtgtgtgcctgtcactgtatctgtatgtccgtgtgtgtgtgtgtccagctgtgcatgtctgcgtctgtgtgcgtgcctgtctgttggtgtatctgtgtgtccgtgcgtgtctgtctgtgcccatctgtgcatgtctgcgtctgtgtgtgcctgttgctgtgcatgtctgcgtctgtgtgtgcctgtcgctatatctgtatgtccatgtgtgtgtgcccatctgtgcatgtctgcgtctgtgtgtgcctgttggtgtatcactgtgtgtccgtgcgtgagtgtgcccatctgtgcatgtctgtctctgtgcgcgtgtgcctgtcactgtatctgtgtccgtgtgtgtgtgtgtgcctgtcttgctgtatctgtgtgtccatgtgtgtacctgtcagtgtatctgtgtcctgcatgtgtccgtgtgtgcatgtcttgtggcgtgtgcttgcatgtgtgcctttgtgtctgcatttctgtgcatctggatgggtatatgtgtgtgtgcctgtgtctgtgtctgtgcgtccgtgggtctgcctgtgcgtgtctctctgcgggtccacacagacacgagggcatctccaaacaggtggacaaggctgggcacagtagctcacgcctgtaatcccagcactctgggaggctgaggcgggcggatcccctgtggtcaggagttcgagaccagcctggccaacatggcgaaaccccatctctactaaaaatacaaaaattagccgggcgtggtggcgggcgcctgtaatcccagctactcaggaggctgaggcaggaaaatcgcttgaacctgggaggcggaggttgcagtgagctgagatctcaccactgcactccagcctgggcaacaagagcgaaactccatctcaaaaaaaaaaagacaatgataataataatgataaataaaaataaacaggtggacgactgtgtgaagttatcatcagtgcaagtagccgagacgtgaggggagtggagatggggaacagccgagatcagcattcatgggcatccacggtgccgaggtcacggaaggaactgacccgagagccgtcacagtgtggccttaggttagacttgaaggagaacttccaggtggcagctgctgaggccaggacggattgacaggagacgcctggaatcccagccctctgggaggctgaggcgggtggatcacctgaggtcaggagtttgagaccagccagagcaacatggtgaaaccccatctctactaaaattacagaaattagccaggcatggtggcgggtgcctataatcccacctattcaggaggctgaggcaggagaatcgcttgaacccgggaggcggagcttgccgtgagccgagatcgcgccactgcactccagcctgggcaacacagcaaaactccatctcaaaaaaaataaaaaaataaaaaaagagacagctgacgtgctgtaactcagcaccatccgacagcggccaggcctgtgggcacaggtgctggggacctccacaaccctcccccagaggttcctggatgcttttctcgtttttaaaaaaacaaaacgcaaccaccctacagctcctcctgcaggacatcatgatagctgtgcttctgatttgccagatctgcagagacagaaatgctgaaatttatttatgtttgaatggtgtctcgctctgtcacccaggctggagtgcagtggcgtgatcttagctcactgcaacctccacttcctgggttcaagggatcctcccacctcagcctcccgagtagctggggtgacaagtgcccgccaccacgcctggctaacttttgtatttttagtacagatggggtttcaccatgttggccaggctggtctcgaactcctcacctcaggtcatccacccgtcttggcctcccaaagtgctgggattacaccccgcccggccggaaatgctaaagtttaaaatcatgagccctgaaagagcaccttctcctcgcagctgggggaaaacagctctggagacttcccaccgcacactctcccgccccttctttcccctcatgcaactcacagcttgctatttatcctctccctgtcctgcagaccggaggtctgagatcaaggcatctcagggctgtgctccctctggaggctctaggggaggatccttcctgcctctcccagctcctgggggctccgggtgtccctgggcttgtagccgcatcactccagtctctgcctccatctccacgtggccttctcctctgtgtgtctcctcttctgtctcttagaaggacacctgccattgcatttagggcccaccctactccaggatgatcccatctccagatccttaattacatctgcaaagaaactttatccaaatgaggtcccattcccaggttctggggcttaggacttggacagatcttttggacgtcaccacccaacccattgcagttgtgtttgattctttctgagaggctctaggggaggatccttcccgcctcttccagctcctgggggctccaggcgtccctgggcttgtggccgcatcactccagtctctgcctccgtctccacgtggccttctcctctgtgtctgtctcctcttctgtctcttagaaggacacctgtcattggatttaggggacaccctactccaggatgatctcattttgaaattctttactcaatgacatccatagagaccctatttccagataaggtcccattcccagcgactgagggtcagcacctgaatatatcttttaaggggacaccattcactgcactacagcagaccatctttttatttcagcaattacagaggggcgtgcagctacatgcgccccccgcaacaggcaaccctcctggggcgcctgaatcaggggatcaccagagaaggccctgccattgcccactcaccggcagtgcggccccgactctccctggcacacgcccatgtgcgccgactctgcctgcctcgcccaggtgctgcccctgaattccctgcttttttcctcccttgccttcttgtcgcccaggctggagtgcgatggcgcgatctcggctcactgcaacctccacctcccaggttcaagcgattctcctgcctcagcctcccgcgtagctgggatgacaggcgcccgccacccctgtccagctaatttgcatttttagtagagatggggtttcgccgtgttgcccaggctggtctcgaactcctgagctcagacaatctgcccacctcaggctcccaaaatgctgagattacaggtgtgagccactgtccccagcgttttctcagcccgagtcaaaccgcacgggcgtgacatcactaaccagctcctcatggagctctgttcaagtccccacggggatgtacttcaggaagacccattcccgcccacacccctctcttctctgtccctgatttaggatgcgggtggccgtcccaggatctgtccggggaggactgcttcttccatacctgacggacgtatctcgttttgtctttaaaccaggtgactttttcagggaccccctccccagcgctgagctgtacgtcctgtgccggatcctgcatgactggccagacgacaaagtccacaagttactcagcagggtcgccgagagctgcaagccaggtgagagcccatcgtcaggttagctgtttttgttaagacgtagtattttgggttcaagttttacaaggaggccgggcgcggtggctcacgcctgtcatcccagcgctttgggaggccgaggcgggcggatcacctgaggtcaggagtttcagaccagcctggccaacgtggtgaaaccccatcgctactaaaaatacaaaaattagccaggcgtggtggctcatgcctataatcccagcactttgggaggctgaggcaggtggatcacccggggtgagcagttcgagaccagcctggccaacatggtgaaaccccgtctctactaaaaatacaaaaattagccaggtgtggtagtgcgcacctgtaatcccaggtacttcagaggctgaggcaggagaatcacttgaacccgggagctggagactgcagtgagccgagatcgcgccactgcactccagcctgggcgacggagtgagattcggtgtcaaaaaagaacaaccacaacaaaaaaagaattggcttatgtgactttggaggttggcaggtccagcgtctgggtgagaggcccgctaaattgtggagggtaaatctgctgtatttaaagttggccagtgtggccaggtgtggtggctcacgcctgtcatccccgcacttcgggaggccgaggcgggcggatcacctgaggtcgggggtttgagaccagcctggccaacatggtgaaaccccgtctctattaaaaacaaacacaaaaaataagccgggcttgatagcgggtgcctgtaatcccagctactcaggaggctgaggcaggagaatcgcttgaacctggagacggaggttgcagtgagccgagactgcgccaccgcactccagcctgggtaacagagcgagactccatctcaaaaaaaaaaaaaaaaaaaaaaaagaaaatcctaaagagaaaatatatttactattcgtgaagttgaagtggctcatgataaaagtcttcattcttgaggaggtcttcacactgaggaggctgcagaggaggaagccgtgggctggtgttgctgtctcaggggtggccgaggcagagggaaatccacgcatgagtggactctgcagctggatctaatctgtgtgtttctacgcagacacacgtgcacacacacacagcacgcaccatctcggctcaaagccttcacatcaggtttctcccccgtccacccaggctgctcctggagcccagtggggctgctggaaaccctggctccaggggttcgggccagggctgcatattgggtttccacagttgaaccagctggccctgagggaatctgacgggcactcagcctccctcaagagttcagcgttgttgctccagtgagaattcctggaatatttgcagacaacggttaattatcttcacagagccagggcctggcacctgcgcgttgaaacaggactccccataggctcaaatggtcaagagacttccattcttctctccctctgtctctccttctttctctctttctctgtgtatctctcttcttttttttttttgagacggagtctcgctctgtcgcccaggctggagtgcagtggcacgatcttggctctccgtaacctccacccccagggttcaagtgattctcctgcctcagcctcccgagtagctggattactggcacataccaccacgcccggctaattttttatttttaatagagacagggtttctccatgttggtcaggctggtctcgaactcccaacctcgggtgatccacccagctgggactcccaaagtgttgggattacaggcgtgagccacctcgcccggctctattatattttttgagacgaggtctcactctgctgcccaggctggtgtgcagtggagcagtcacaggtcactgcagccttgacctcctaggctcaagctgtcctcccacctcagcctcccgagtagctggaagtacaggcatgcatcatgcatcaccatgcccagctaattttttaagaagttttttctgagaccgggcacggtggctcacacctgtaatcccagcactttgggaggccaaagcgggcagatctcgaggtcaggagttcgagaccagcctaagccacgtggtgaaaccccgcctctactaaaaatacaaaaattagtccggcgtagtggtgcacgcctctaattctagctactcaggaggctgagagaggacatcacttgaacctgggaggcgaaggttgcagtgagcagagatcgcgccactgcactccagcctgggcaacacagcaagactccgtctcagaaaaaaaaaaaaaagttttttgtggagataggagtccccctctgtcacccaggctggagtgcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagtgcagtgttgtcatcatagttcactgcagccttgacctcctgggctcaagcgatcctcctgcctcagcctcccgagtatttgggagtagcagcatttggctggagtgcagtgttgccatcatagttcactgcagccttgacctcctgcactcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggactgcagtgttgtcatcatagttcactgcagccttgacctcctgggctcaagcgatcctcctgcctcagcctcccgagtatttgggagtagcagcatttggctggagtgcagtgttgccatcatagttcactgcagccttgacctcctgcactcaagcgatcctcctgcctcagcctcccgagtatttgggagtagcagcatttggctggagggcagtgttgtcatcatagttcactgcagccttgacctcctgggctcaagcgatcctcctgcctcagcctcccgagtatttgggagtagcagcatttggctggagggcagtgttgccatcatagttcactgcagccttgacctcctgcactcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgggctcaagcgatcctcctgcctcagcctcccgagtatttgggagtaccagcatttggctggactgcagtgttgtcatcatagttcactgcagccttgacctcctgcactcaagcgatcctcctgcctcagcctcccgagtatttgggagtagcagcatttggctggagggcagtgttgtcatcatagttcactgcagccttgacctcctgggctcaagcgatcctcctgcctcagcctcccgagtatttgggagtaccagcatttggctggagggcagtgttgtcatcatagttcactgcagccttgacctcctgcactcaagcgatcctcctgcctcagcctcccgagtatttgggagtaccagcatttggctggagggcagtgttgccatcatagttcactgcagccttgacctcctgcgctcaagcgatcctcctgcctcagcctcccgagtatttgggagtaccagcatttgttatcatgccctgttagggttttttaaattttgtagagatgggatcttgcgatgttgcccaggctacccttcctgggctcaagcgatcctcctgcctcagcctcccaaaatgctggggttaaagacatgagccactgcacccggcctctgtctctctttctctctcttctccctcttcctctctgtctcctcctctctgtgtctttttaggtatctcatctatcatcatcaatctctgtttctcttctctcctccttcctcctttatcttctctgtctcttcctccctctctccaccctgtctctgtctctctttatacatctatcatccttttttaaaaaaaataaaatagagacagggtctcactatgttgctcaggttggtttcaaactcctgggctcaaaccatcctcccacctctgcctcccaaagtgctgcgattacaggtgtgagccactgcgtctggccttctaacaatgctccgtcacctgtcatctgtctatcatttattatctatccatccatccatcatctacctacccatcatctaccatatattcacccatccatccatctcatccatgcatccatctatccatctattcatctatctacctatcatctaccatctattcacccatccatccatctcatgaatgcatccatctatatccatccattcatctacctacctgcccatcacctaccatcaatacacccatccatctcatccatctatccatccattcatctacctgcccatcatgtaccatctattcagccatccatccatctcatccatgcatccatctatccatccatccatctacctacctacccatcatctaccatctattcacccagccatccatctcatccatgcatccatctatatacatccattcatctatctacctacccatcatctaccatcagttcacccatccatccatccatctacccatcatctaccatcagttcacccatccatctcatccatgcatgcatccatccatccatccatctacctacccatcatctaccatctattcacccatccatccaatccatgcatctatccatccattcatctacctacccatcatctactatctattcacccatccatctcatccatgcatccatctattcatctatctatgtacccatcatctaccatctattcacccatccatccatctgttccatgcacccatctatccatccattcatctacctacccatcatctattatctattcacccatccatccatctcatgcatgcatccatgtatctatccattcatctacctacctacccatcatctaccatctattcactaatccatccatctcatgcatgcatccatctatccatccattcatctacctacttaaccatcatctactatctattcacccatccatccatcacatccatgcatccatctacctacctacctatctattcacccatacatccatctcatccatgccatctatccatccatccatccacctacctacccatcatctaccatctattcaagcatccatcacatccatacatccatctatccatccactcatctatctacgtacccatcatctaccatctattcacccatccctccatccatctcatccatgcatccatctatccatccattcatctacctacctacccatcatctaccatctattcacctatccatccatctcatccatgaatccatccatccatctacctacctacccatcatctaccatctattcacccaaccatccatctcatccatgcacccatctattcatcttcctacctacccatcatctaccatctattcacccatccatccatctcatccatccattcatctatctacccatcatctaccatctattcagccatccatccatctcatccatgcatccatctatacatccatctacctacctacctacccatttattcacccatccatccatctcatccatgcctccatctatccatccacctacctacccatcgtctaccatctattcacccatccatcacatccatacatccatctatccatccattcatctatctacgtacccatcatctaccatctactcatccattcatccatccatccactcatctacctacccatcatctaccatctattcacccatccatctcatccatgcatccatctatccatccatccatctacctatgtacccatcagctaccatctattcacccaaccatccatctcatccatgcatccatctattcatcttcctacctacccatcatctaccatctattcacccatccatccatctcatccatacatccatatatccatccattcatctatctacctgcccatcatgtaccatctattcacccatccatccatctcatccatgcatccatctatccatccattcatctatctacctacccatcatctaccatctattcacccatccatccatctcatgcatgcatccatctatccatccatccgtctacctacctacccatcatctatacacccatccatctcatgcatgcatccatctatctatccactcatctacctacctaaccatcatctactatctattcacccatccatccatcacatccatgcatccatctatacatccatctatctacctacctacctattcacccatccatccatctcatccatgcctccatctatccatccacctaacgatccatcatctaccatctattcacccatccatcacatccatctatccatccactcatctatctacgtacccatcatctaccatctgttcacccatccatccatctatccatccattcatctatctacgtacccatcatctaccatctattcacccaaccatccatctcatccatgcacccatctattcatctacctacctacgcataatctaccatctgttcactcatccatccatctcatccatgcatccatctatccatccattcatctatctacgtacccatcatctaccatctattcatccattcatccatctatccatccactcatctacctacccatcatctaccatctattcacccatccatccctctcatccatgcatccatctatccatccatacatctacctacgtacccatcagctaccatctattcacccaaccatccatctcatccatgcatccaactattcatcttcctacctatccatcagctaccatctattcacccatccatccatctcatccatacatccatatatccatccattcatctatctacctgtccatcatgtaccatctattcacccatccatccatctcatccatgcatccatctgtccatccattcatctacctacccatcatctaccatctattcacccatccatccatctcatccatgcatccatctatccgtccattcgtctacctacctacccatcatctatcatctatacacccatccatccatctcatgcatgcatccatctatccatccattcatctacctacttacctaaccatcatctactatctattcacccatccatccatccatctatacatccatctatctacctacctacccatctattcacccatccatccatctcatccatgcctgcatccatccatccatccatccacctacctacccatcatctaccatctattcacccatccatctcatccatgcattcatctatccatccattcatctatctatgtacccatgatctaccatctattcacccatccatccatccatctcatccatgcatccatctatccatccattcatctacctacctacccatcatctaccatctattcacccatccatctcatccatgcatccatctatccatccatctacctacgtacccatcatctaccatctattcacccaaccatccatctcatccatgcacccatctattcatcttcctacctacccatcatgtaccatctattcacccatccatccatctcgtccatgcatccatctatccatccgtctacctgcccatcatgtaccatctattcacccatccatccatcacatccatgcatccatctgtccatccactcatctacctacctacccatcatctaccatctattcacccatccatccatctcatacatgcatccatctatccatccatccatgtacctccccatcacttaccatctgttcatccatccatccttctcatccatgcgtccacctatccatacatctttctacctacctacccacccatcatctaccatctgttcatccatgcatccaggagaaccggaaaaggcccaggtgatgcatccatctatccatccatctttcgatcaaatctccttctccctgtctgtccgccctgcatcaagtctctgtctctctcccctcccctacctgtgtgggccccctggccaagggttctcagcagcctctgctcaccgttctgagctcctgttgcctgctgtgtcccctgtgtcctgctgaaggatccccgcctggctggccaggactccagctctctgctgtctccctcaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagc

SEQ ID NO: 4161 - DNA, 74535 bp, human
ggaagggcagccgtctgccgcccacgaacaccttctcaagcactttgagtgaccacggcttgcaagctggtggctggccccccgagtcccgggctctgaggcacggccgtcgacttaagcgttgcatcctgttacctggagaccctctgagctctcacctgctacttctgccgctgcttctgcacaggtgagccgccgagctggacttttatgcttgtcctgcactgtcaagggagaagacagggtcgctgggagggtccgtgtacggtgagaacatgggggaagacggtgcaaactccatgaggcgtgttctcctcacgctagagcagaccaggagtgcaaatttcctgggaggaagactttgcacagccgcttcgtcacttaggggagaaatgctcaaattttccagggctgcaagccacccttcctttaataactcattccatgaactttcagaggccgaggtgggcggatcacgaggtcaggagttcgagaccatcctggctaacacggtgaaaccccgtctctactaaaaatacaaaaattagccaggcgtggtggcaggtgcctgtaatcccagcactttgggggaccgaggtgggtggatcatctgaggtcaggagttcgagaccatcctggctaacacggtgaaaccccgtctctactaaaaatacaaaaattagctgggcttggtggtgggcgcctgcggtcccagctactcgggaggctgaggcaggagaatggcatgatccctggaggtggagcttgcagtgagcagagatcacgccactgcactccagcctgggcgacagagcgagactctgtttagaaaaaaaaaaacaaaaaaaaactcattccatgaaatgcgcctctcttgaggttaaccttagagagggtaagcagctgcggctgctgcacgtaacccatttacgcctgagattgcagttttttcaatgtttgcaatgagaccttggcgatgaccttgagccgtgggatataaataactcccaaatgcttagcgttccaataatggaagagtaagcataaattaaacgggttttaaagccctatgggtgcctggatgagcacggtggcccctcgtcaccccctcggtgccagggagaccccagacccgggtctcacggccacctcagacctcatttgtacaggtccgcttagaaaccccaattccttgggtcttgtcagatctgtcccctaaaaagctgagaaaaggcagagggagctgctctgggaatttcaggccacacacaacaaggcctgctgtggcgctttaggtcccatttctataaaggggaaccatggtcacgtggctctgttcccaaaaagaaaagggtttgtgtgtgtgtgtgtgtgtgtgtctgtgtgtgtgtctgtgtgtgtgtgtgtgtgtgtggttgtttcttcccatgttgttatctttacgtaacgtggatgagaagtctgaagcgcgagagccctaagtgaaaaccgctgaggagctgaagcccgtggggaagcaggtgcacctgactgcgccgttcaatctctccttcccgttccgttcctccttgcatagcccacttgactttggcaagcagcgccagatagtagcatattttgtgtttacggcggtgacagacgcctgtaatcccagcactttgggaggccgaggtgggtggatcacttgaggtcaggggtttgagaccagcctggccaacatagtgaaaccccgtctctactaaaaataccaaaattagccgagtgtggcggcgggcacctgtcatcccagttactcggcacgctaaggcagcagaatcacttgaacccaggaggcggaggttgcggtgagccaagatcgcgccactgcactccagcctgggtgacagagtgagactctgtctcaaaaaaaaaaaaaaaaaaaaaggaattatcccacattggaaaagcagtactttcatttaggcactgccagacaggtgccagcgtcctacgtgcaccaggatgctgccccttttcccaaatattggcctcccccaccccacaagaggacaattaggtcagaggctgagagaggcgtgcatgggacgtacgggacggtgggcaaccctgtgtttgtaaaagcacatgcttttcagatgccttctgccaggtccccgcctggctgcaccattcagactgaccaaccttggggtgggtgggagaggtgaggtccccttggagaaccacagagacgctccctccctccaaccctacccacactgcagttctgagtttgtcccttaaagttccagggaagaagcgatggcttaggattaacaacagcagggtagctgttgccagtggtgcatacgtacagccctgcgcttggagaggccctttccccgggcagatggccccctctcgtctgagtctctctcctgcgccctctccttcagccctgcctctccatcaggacctcctcattggctgtgtctgggcatggtccccaacctccctcccccagcccctcttctgtccctagaggcagtggggtgggcggggcagggtccagggatcccagtgtccacctggaaccctgctcttcctctctcgggttaggagattctgcacggcccctgggagacacacaacaccctgcctacacctgttaaggtacggaaagggcgtgggcgtgatgggtgcccccaggatcacccccaaggaccagactgagctcaggggactgcagggagtgttctgcggttcacaatgtcgctccctagtgatgcagtatctgtgttcacttaggataaagcaacagatacacctatctgtgtgtgtgtatatatatatgtattacatatataattatataaataattatatataaataatatataatatataaatagtaagtatataaatatatatgtaaatatatataaatatataatatatgtaaatatattgtatataaatatatatgtaaatatatataaatatataatatatgtaaatatattatatataaatatatatgtaaatatattatatataaataatatacaaatatatatgtaaataataaatagataagtatataatatatgtaaatatgtaatatataaataatatataaatatataatatatttaagttataaatatataactatgtaatatgtaaataataaataatatatgaatatataatatatttaaataatacatatataagtatataatatataaataataaataatatataaatacataatatatttaaataaatataagtatataatatataaataataaataatatatgaatatatagtatatttaaataataaatatataagtatataatatataaataataaataatatatgaataatatatttaaataatgaatatataagtatataatatataaataatatataaatataaaatatatttaaataataaatatgtaaataataaatatgtaaataataatatataaatatataatatatttaaataataaatatataagtatataatatatttaaataataaatatataagtatataatatataaataataaataaaatataaatatacaatacatttaaataataaatatataagtatataagatataaagaataaataatatataaatatacaatatatttaaataataaatatataaatatataatatataaataataaaaaatacataaatatatgtttaaataataaatatgtaaatatgtaatatatgaatatatatatattatttttggcaatctcttttatttgcctcaagaaagcacactcctcagaagattttttcagaagctgatgtgtgtttttgttggtttgttttacactttttacttccataggttttggggaaacacgtgccatttggttacacgaggaagttctttagtggtgatgtgtgagatttcagggtatccgtcacccaagcagtatacactgaacccggtttgtggccttttatccctcatcctctccccaatctttgccctggagttcccaaagtcctttgtgtcattcctttttttttcttttttctttctttcgtttttttttttttttttttttttgagacagagtttcactctgttgcccaggctggagagcagtggcgcgatctcggctcactgcaacctccttctcccggattcaagcgattctcctgcctcagcctcctcctgagtaactgggattacacgcatgtgccaccacacccggttaatttttgtatttttagtagagacggggtttcaccatattggccaggctggtctcaaactcctgaccttgtgatctgcccacctcgacctcccaaagtgctgggatgacaggtgtgagccaccgcatccggccgttgtggcattcttatgcctttgcatcctcatagcttagctctcacttatgagtgagaacatacgatgtttgggtttccattcctgagttacttcacttagaataatagtctccaatctcatccaggccactccaaatgctattctttttcatgactgagtagtattccatcataagtatatgtatatatatatacacatcatatacatctatacatatatgtgtatatatacacatatacatctatacatatatgtgtatatatacacatatacatatatacatatatgtgtatatatacacatcatatacatatatacatatatgtgcatatacacacatcatatacgtatatgtgtatatatacacatcatatacatatatgtgtatatatacgtgtgtgtatatatatggcacacatatatatgacatatatgtgtgtgtgtttgtgtgtgtgtcagtgccggcatttatatatataaatacaccacagtttctttatccacctgttgattgatgggcatttgggttggttccacatttttgcaattgcaaattgtgctgctataaacatgcctgtgcaagtatctttttcgtataatgagttactttcctctaagtatctttttcatataatgagttactttcctctacctagatacccagcagtgggattgctggatcaaatggtagttctacatttagctctttaaggactctccacactgtcttctatagtggctgtactagtttacgttcccaccagcagtgcagacgtgttccctgttcgccacatccacactagcatttgctatttcttgatgttttgattgtggccattcttgcaggagtgaggtgatgtcacattctgcttttgatttgcatttccctgatcattcgtgatgttgagcgtgttttcatgccgctgagccgggctgggaccttgaggactgcgttgatgcttttgtgcagagtgccctgctccaggggaaaggtgctggtgccctgagcagagggactttgtggaagcaggatgtgtgattttctagccaagaaggtctccatgggagggaggagtcctatgagactctccatggctgggcagggagtggcacagacagaagcaggtggcaggtgccaggctgtgttggtttcggatgatgagttggtggaatggcaatgtgctgtccaggctccccaggagttcatgagctgggggtgggctgagcatgctaacccctcgggctgggcacagtcaggctgggagggggcctggacattgtttacgggggaccctgtaagcagggggacccctgatggagagggcatgcaggaagatggggcaaggacagatcttgggatagaaccattcatgagacacaaaaggcacaggctgtctgctggagcactagtgacatttggggcgggggaattccctgtggtggggccatcctggggattgtagggtgtagagcagcgtccctgggctccagccacaaggtgccaggagcacccacagttgtgacaatcagaaatgtctccagatattactcaatgtctccaggtagcaaaatcacttgctcatctatcactgtcttaaagatagatgggtgacaaattagatagatagatagatagatagatagatagacagacagacagacagatagatagaatcgataaatagatacatagaatagatagatatatacatacatacataaattagataggtacatacatacatacatacatggataaatagattagatagatagatacatagatacatgcatagattagatagatagatgatagattaaagagatatatagatagatgagagatagaatagacaatacatacatagatatagatagataatggtgatgatagacagatagatatatagataatagagatagatagaaaagatacatacgtaaattagatagatatatacatacatagattagatagatacatacatacatggataaatagattagatagatagatatatagatgcatagattaaatagatgatagattagagagatacatagatagatgagagatagatagataggatagatagatacacacatacatatagatagataatggtgatgatagagagatagatcaatcagatagatagatacatagatagaatagatacatacatatgtacgtacataaattagatacatatatacatacatacatagattagataggtagatacatacatacatacatggataaatagattagatagatagatacatagatacatacataggtgcattaatagattagagagatagatgatagattagagagatacctagatagatgagcaatagataagatagatagatatgtacatacatatagatagatgacagatagatagatagatagatagatagatagatagatagataatggtgatgataggtaatagagatagatagatacatacatagatacatggatacatagatagatagatagatagatagatagatagatagatagatagatagatagatagatcatacatacatacatacatacatacatacatagatgcatagatacatagatacatggatacatagatggatgacggagagagagagagagaggagagattctctatactaaaagcaggatctttccacgtcaacactatagacatttggggccgggtgattctctgtggtggggccatcctgtgcagtgtaaggtattgagaagcatccccgggatccacccaccagatgccaggagcacccccacagttgcgacaaccagaactgtcctcagacattacccagtgtgccgtgatgagaaaaatcacccctagttgaaaccactgtcaaatggtaggcagataaatgatagagatgagagataaatgctagaaaggtatagatagatgacagacagagaagattaataaataaatagatataggtgccagagagctagatatgatatatagataaattgataaatgatagatatgatagatagatatagatggatagatagtcactaacagagactctctcatgctcaggcagggtgtcagcctcagcactgctgccatgtagggctggaggattctctgtgttgagcctatcctgtgcactgcagggcactgagcatcttcccaggctccacccaccacgccccaggagtacaccctccagttgtgacaccccaaactgcccaagatatagacaagcatccccactggaacagaatctcccgcaattctgaaccacagggtgagaggcaggcaagataagacaagatgatccttccagagacctggaaggagaagcaagatcatgtcccatcccccaggtctcagggagagaatgggctgggtcaagggactctggatcacttccttccatttctccatctcccaatgtgctgtatgcatgctcttgttactataataaagtaagtagaattgaagagactctgtcgttacaagccacacatgtgtagattaagcagatattccctgtgcaggtcaggtctcaggggaaatggaggatttattctccacctttccaagaccaagggccccgctgtgtgtacgtgttattctcatcaaacatgcttatctgcccgaggactaaatgctggcttccacatgtgacatttttacttgcaaaactggatcaatggggagcgtcatttatactgtcccatgcaacaaagggaactgaaaaagtgcaggaatgaggagactcaaatccacgcacattcagagactccaatccacactcaaagagactcaaatccaactcattcaaagagactcaagtccacactcattcaaagagactcaaatccacactcattcaaagagactcaaacccacacgcaatcaaagagactcaaatccatactcattcaaacagactcaagtccactcattcagagactcaaacctacacgaattcaaagagactcaaatccacactcattcaaagagactcaagtccacaatcattcaaagaggctcaaacccacacgcattcaaagagactcaaatccacactcattcaaagaaactcaaatccacactcattcaaagagactcaaatccacactcaatccaaagaccagagccagcctcttggaagcacttgctcctccgggcttccctgggacgtttaaagtggttttgaagatgtcgtatgaggatgaatgcaagactttgagttcacacggtgctgactggcagcgcctgctgctcagagctgtgatggcctcctcaaggggcagttgtgcagcagtagctctgatggaatctccaggaacccactctccagcaaggagccctgtcacatgcatacctgcatgagcctctcagccagtggttgaaatgggcatgttgcagacagcctctctgtgagatgcaatagatgaaacctgaggctcagtgaagctggaggcctcccaggcactagctgctcagtgaaggcgctgttgtccatctacagtgtccatatgtccatcacaagctcttggcatgaacacaggaaacttctaggatactcaggctattaccctggggttggaggcattctgtctccaggtatttatttatcactcatctgttcttggggtggaggagaatgagactactcctgcactcaggacagggacagaccagcaggtggccacacgtggaatagaaacaggagataccccttcagtctcagccacagggaatgaatgagcagggtccctgtaggggctgtgactttgtagatgagagaccagaatagattaacatggcctcagtactgtttgttggatggttgaatggatggctgcataaatagatgggtgaatgaataaatgaatgaatgagtgaatgagtggattagtacattagtgagtggatggatggatatgtagacaggtgaatgaagagtggatgaatggatgaatggatggatggatggatggatggatagatgagtaaatggataaggaatgaatgagtggatgaatgaatgaatgaagggatgattggatggatgaatgaatgagtagatgaatgaataaatggatggatggatgaacagatggatagataggtggatgaataaggaataaatgattgaatgaatagatacatgaatgggtgaatgatagtgggtgtattgataaatgggtggatgactgaatggatggattgaaggatgaacggatggatggatgagtggatggataaggaataaatgaatgaatgaatagataaatgaatgagtgaatgaatggatcatgaataaatgaatgggcaaatgaatagtggatgtatggataagtggatggataaacggatggatggatggatggatagatgagtggatggataaggaatgaataagtggatgaatgaatgaatgagtagatgaatgaataaatagatggacggatgaacagatggataggtaggtggatggataagaaatgaatgaataggctgggcgcggtggctcacgcctgtaatcccagcactttgggagtctgaggtaggcggatcacctgaggtcaggaatttaagaccagcctggccagcgtggtgaaaccccgtctctactaaaaaatacaaaaattagccaggcgtggtagtgggcgcctgtaatcccagctacttgggaggctgaggcaggagaatcccttgaacccgggaggcagatgttgcaatgagccaagatcgagctgttgcacatcagcctgggcaacaggagtgaaactcggtctcaaaaagaaaagaaaagaaaagaaatgaatgaatagatgaataaatgatttagtgaataaatagatgctgaatgaatgcgtgggtaaatgaatgagtgaattcatcgatgcatgaataaacacatggataaatgaattaatggatggatgagtaagtaaatggatgaatgaatgagtagatggctgtatagatggatagatggatgaattggatggatggatggatggatgaatgctgaataagtggatggataaggaatgaatgagtggataaatgagtggatgcataaatgaattactgaataaatgggtgaatgattaaaggcataaatgaatgaatggatgaatgagtgagttttggatggatgagtggtggatgcatccatccatccatgcatggatgactgaatggatggatggatggataaatggatggatggatgagtggctggataaggaataaatgagcgaatgaatgaatgaatgaatgaatggatgcatgaataaatgaatgggtgagtgaatagtgggtgtattgataaatggatggatgactgagtagatggatggatggatgaatgaatggatgggtggatgagcggctggataaggaatgaatgaatgagtgaatgaatggatgcatgaaagaatgggtgaatgaatagtggatgtatggataaatggatggatggatgaacagatggatggatgagtggatggataaggaatgaatgagtggatgaatgaatgaatgaatgagtgaacgaatggattcatgaataaatgaatgggtgtctgaatagtgggtgtattgataaatggatggatgactgagtagatggatggatggatgaatagatggatggatgagcggctggataaggaatgaatgaataaatgaatgagtgagtgaatggatgcatgaataaatgaatgggtgagtgaatagtgggtgtattgataagtggatggatgactgaatggatggatggatggatgaatggaaggatggatgagtggatggataaggaataaatgaatgaatgaatagatgaatgagtgaatgaatggatgcatgaataaatgaatgggcgaatgaatagtggatgtatggataaatggatggatggatggatggacagatggatggatgagtggatggataaggaatgagtgagtggatgaatgaaccgatggataaatgaatgagtgaatgaatggatgcatgaatacatacatggataaatgaattcatgggtggatggatggatgaatggatgaatggatggatgcatgattgagtcaataggtgaatagacggatgaaacaagaaaggagctgatttccagtcaattgccccgaattaatgcatactgtttctgaggctttggggagaatctttcctgcgtctctccagcttctgatcctctgccatccttgacgtccctgggcttgggaatgcctccctccaatctctgcctctgtcttcacacagcaatcttccctctgtgcatgtctgcgtcccagtctcttcttagaaggaccccagtcccataggattaagtccccacccaaatgcagtatgatgtcatcctaacttacaccttaatcccatctgcaaagatcctatttccaaataaggtcctatattcacaggtacctatgttgaggctttgaatgtgtctttcaaagggatgcaatccaactcaaaacactctccaaacaaattcttcacaaaacactgagctccttggcctaatcagaggaggagagaggatttattgcaccaatagggattttggggggtccccactcaaaccctctgcactgctgtggagcacaactccctgcaaggtgacagaccctggctacaggactatgagagggtgaagaagctgcccccaccctgagaccaccttcttgagcagctgaatggacacagaccctcactgtagacaggtgaatgaatgagtggatggatgggtgggtggatggatggatggatggatggatggatggatagatggatggatggatgagtggatggttgaatggatgagtggatggatggatggatggatggatggatggatggatggatggatgagtggatggatgaatggatgagtggatggatggatggatggatggatggatggatggatggatgcatggatgtatggatggatggatgaatggatgagtggatggatggatggatggatggatggatggatggatgaatggatggatggatggatggatgtatggatggatggatggatgaatggatggatggatggatagatggatgaatggatggatggatggatggatggatggatggatggatgcatgcatggatggatggatggatggatgaatggatggatggatggatggatggatgcgtggatgtatggatggatgagtggatgaatggatggatggatggatggatagatggatgaatggatggatggatggatggatggatggatgcatgcatggatggagggatggatggatggatggatgagtggatggatggatggatggatgaatggatggatgcatggatggatgaggaatgaatgagcggatgaatgagtgaataaagggatgagtggatccgcagaagagaggggggtaagcagctggcaagtgtgacaagcctactgtgtacaaagggacattctcaatgctccccccacaccatcaaactcttgaaacaaccctgagtacaagacccaattctaccccatcgctacattgcagatgagaaaatcaaacaggaacggggttacggggagacgtgtagacactccaatgccaaaaaactcagtcaccaaaataaatactgctgttttatttgttttaatttattgaggtgaaattcacataacaaaattcaccatctttgccgggcacagtggctcatgcctgtaatcccagctctttgggaggccaaggcaggtgggtcacttgaggtcaggagttccagaccagcctggccaacagggttttttagtgaaatcctgtctctactaaaaatacaaaattagccgggcgtggtggtgcggcacctataatcccagctactggggaggctgaggcaggagaatcgcttgaacccgggaggcggaagttgtgatgaacacagatcgtgccactgcactccaggctggacgacagagggaggctccgtctcaagaaataaataataataataataaatttaccatcttcaatacaacgcagtggtatttagctcgttcagagtgttgtacaatcatcacctctgtgtacttccaatacatttttatgacgctcagaaggagacctgtacctatttgcaatcgctcccacttctcccttccctcctccctctggcaatcacaaatctgcaatatttttcagcctaaatgggaagaaagtattgataccgctacaatatggatgaacctcaaaaattctatgctaaatgcaagaattgtgaaactcagagaatattggggaccagggagatgattagggaccaaggagacgattaggtaccagggagaatattggggaacagggaagattttagggactaaagtgacaccctttgagaaagctctgctgacatccccattttgcttaggggaaactgagggacacagaaaggaaggcacaccctcacctggctggggcattacctccaactgcaccagccacaaaggtcacacccttaactgctactccaaactatttgctatatcttttttttatttttttcaatttttgttttatttatttatttatttatttatttatttatttatttatttttggcagtgggggatggagtctctctctgtcgcccaggctggagtgcagtagtgcaatctcggctttctgcaacctctgcctcccgggttcaagtgactctcctgcctcagcctcccgagtagctgggattataggcatgtggcaccatgcccagctaatgtttgtatttttagtagagatggggtttcgccatattggacaggctggtctcgaactcttgacctcgagtgatccgcctgtcttagcctcccaaagtgctgcgataacaggtgtgagccaccacgcccggccttaatttttatttttaggggcagagtcttgctctgttgcccaggctggagtgcagtgacttcatcatagctcactgcagcctctaactcctggcctcaagcaatccttccacctcagcctcccaagtagctgggattacaggcactgaccacgcccggctaatgaaagtgtcttgctatgttgcctaggctcatcttgaactcctggcctgaagccactctcctgccttggcctcccaaggtgctgggactagaggcatgagacaacgtgcctggccagtgtactataattatcgcatcttggttgttgaatctctgtgcgtgcacgacgattccgagccttgtcatctgaggattgcatttaaagttacaatacacacgtgtgtgggaggtgaggaaaatattctgaaactacatcgaggtattggctgcacggaggcatgaatgcaataaatccccctgaggtattccgtttacaatgattgatttcattatgtaaacctcacctttttttttttaagcgagaaaaagagggcggggcatggtggctcacgcctgtcatcccagcactttgggaggttgaggcgggtggatcacctgaggtcaggggttcgagactagcctggctaacatggtgaaacccccgtctctactaaaaatacaaaaaattagctgggcatggtggtgcatgcctgtaatcccagctactcgggaggctgaggcaggagaatcacctgaacccgggaggcggaggttgcggtgagccgagatcgcaccattgcactccagcctgggcagcaagagcaaaactccatctcaaaaaaaaaaaaaaaaaaaaaaaaagagagcgagagagaaagagaaagacataagaaaaaataaccatgcaataccccttgtctcacttcctcattctgggctataaacactcttcgcgggacccttttcgggctgcacaggaattaggaggttgtccgtcacgctcaccggaagcaaaggaaggggagtttctgaaacctccaccaaataccaccaaatacccagctgaggtgcggctgactggcttccttcaccccatgcaactcacttctaagtaaacacaccttcctttgccgtttctaagcactcatgcaaatgactgacggtccacattcctgcaggcagggtccaagtgaattgacttcctgcagacaaatgcagagtgtcctccggcctgtgactttgatgccaaggttcctgctgatgccagggtgacagtggttgcaagccgtgttccatgctgggtactcaatgatcttagggtttgtccatactgggacggattaaagtggagcataaggattacagtggaccataagagaggggtgatggatcagagagaatattggggaccagagatattattggggacagagagaatattagaaatcagagaggataaaggccgggcgcggtggctcatgcctgtaatcccagcactttgggaggccaaggcgggcggatgacgaggtcaggagatggagaccatcctggccaatatagtgaaactccgtctctactaaaatacaaaaattagctggacgtggtggagcatgcctgtaaacccagctctgtaatcccagctactcaggaggctaaggcaggagaatcccttgaaccagagagttggaggctgcagtgagctcagatcgcaccgctgcagtccagcctggcgacagtgtgagactctgtctcaaaaaaaaaaaaaaaaaaagaaaagaaaaatcagagaggatattggggagcagggtgatgattgggggccaaggagatgattgggggccaaagaggtgattggggaccaggaagataattaggtaccaaggagatgattggggatcaaggagattattggggacaagggaaattattgggaaccagggacatttgggggtactatggagattattggggaccagagacaatattagaaatcagagaaaatattgaggatgagggagattattggggatcagggagattattgggagacaagaagatgattgaggaccagagataatattagaaatcagacagaatattggagaccagggagattattagagaacaaagagatgactgaggatcagagagaatattgggatcagagagattattggggatcagggagaggattggggaccagagaaattattagggaccaatgagataattgaggatcggagataatattggggatcagagagattattggggatcagagagatgattggggaccagagagaatattggggatcagggagattattagaggctaagaagatgattggggaccagagagaatattggggaccagagagattattagagaccgaggagatgattggggatcagagagaatacttgggaccagagataatgttggaaaccagggacattattggggttaagaagatgattgaggactagagacaatattagagatcagagagaatattggagaccaagcagatgactggggaccagagagaatattgggatcagagagattattggggatcagaaagatgattggggaccagacagattattagggaccaaggacataattgaggagcacagagaatattggggaccacagagattattgggggtcagaaagatgattagggaccagagattattagggaccaaggtgataattggagatcagagagaatattggggaccagagagattattggggaccagagagagatgattgaggaccagagagattattagggaccaaggtgataattggagatcagagaaaatattggggaccagagagattattggggaccagagagatgattggggaccagagagactattgggaaccagggagatttttggggaccagagagattattagagatcaagaagatgatggggatcagggagattattagggaccaagtatatgattggggatccgagaaaatattgggaactagggagatttgggggagatcagagacaatattagaaatcagagaaaatcttggggaccagggagatgattggtaaccagagagatgattagggaccaaggggatgattgtggatcagagagaatattggggaacagagataatattagaaaccagggaggtgattgggagccaagaagataattggggattagagacaatattagaaattggagagaatattggagaccaaggagatgactggggaccagagagaatattgggaccagagagattactgggaatcagaaagatgattggggaccagagagattattgggaaccagagagaatattgggatcagagatattattggagatcagagagaatattggggagcagggagattattggggaccagagagaatattggggaccagagagaatattggaatcagaaagatgattggagaccagagagattattagggaccaaggagataattggagatcggagagaatattggggagcagggagattattagggaccagagagattattggggacaagagagaacattgagactcagagagaatattgaggctcagagagaatattgagatctcagagattactggggatcagggaggtgattggggaccagagagattattagggaccaaggagatgattggggatcagagagaatattggggagccgaaagattattggggaccagaggaatattggggatcagaaatattactggggaccagagagattagggaccaaggagatgattggggaccacagagaatattggggatctgagaaaatactgaggaccagggagattactgggggcaggaagattattgggggccaaggagatgattggggatcaggaagattattgcagaccagataaaatattggggcttaatggaagtattggaaattagacaggctttgggagttaggcaggatttgggggactagaaagattttggggaaccagaaagaatactggagactggaaagattattgtgaaccacagagaatattgaggattagagagaatattggcggccagggagaaccaaacagatttgaggggactggagagattttagggaaccagagagaagattggggacaaacaagatgatcagggcccagcaaggatattgaggatcagggagaccattgggcccagcaagaatattaaagaccagaaagattttggggaaacagacaggttttgggggactagggagcttttggggaatcagagaatattacagaccagagagattattattttttattatatatattaaatatttaatattttattatattattattatttttttttttttgagacggagtctcgctctgtcacccacgctggagtgcagtggcacagtctcagctcactgcaagctccgcctcctgggttcacgccattctcctgcctcagcctcccgagtagctgggattgcaggcacctgccaccatgcctggctaatttttgtatttttagtagagacggggtttcaccatgttggccaggatggtctcgaactcctgacctcaggtgatccacccatctcagcctcccaaagtgctgagatgacgggcgtgagccaccgcgcccggccaagattatttttatttatttttttatttttttttgagatggagtttcgctgttgttgcccaggctggagtgcagtgacaaaatctcggctcactgcaacctccgcctcccaggttcaagcaattctcccgcctcagcctcctgagtagctgggattacaggtgcgcaccaccacgcccagctaatttttgtatttttagtagagatggggtttcaccatgttggccaggctggtctcgaactcctgacctcaggtggtctgcccacctcagcctcttaaagcgctggaatgacaggcgtgagccaccgcgtgtggccgagagattactaagaaccagaaaatattgaggaccagggagaatattgggggccagatattactggaaaccagagacacgtgtgaagattgaacttcccttaaatcttctgagacctcgcttgggtctgagcatgcttcctgttaacattacctggccccacaggctcaggcagaaggaccctgacaccaggcttcttctctgccggagctcaacagactcactcactgcagatcctcttttcccactgaaattagtttccattttgctcagagccctcagatgacttccttaataccttccagttcatcctgagactctggagggtggaacagcagtctaaggccatgtactggggactgcccacaaggcacacagaggcggacaaggttgggggtgtttgtgggatggggcgggggcccaagctgaaggctgaggtggtttaaaagccagaccttgattctcctggaggctggacatcaggtgtggacagggctggttcctcctgaggcctctctcctgggcttgtagatgctgtctcctccctgtgtcctcacggggtcgtccctctctgtgtgtctgtgccctcatctcctcctcttatgagatgtcttagtccatctcaggctgctaccacagaataccatagactgggtggcttagaaacaagagacattgattctcccacagccctggaggctggaaatccaagattaaggtgtgggcaggggtggttcctcctaaggcttgtctctttggcttgtagatgctgttttctccctgtgtcctcacagagtcgtccatctgtgtgtgtctgtgtcctcatctcctcttcttatgaggtgtcttagtccacttcaggctgctaacacagaataccatagactgcgtggcttatacacaacagacattgattgtcccacagccctggaggctggaagtctgagatcagcgaacgggcagggctggttcctcctgaggactctctccttggcttgtagatgacgtcttccccctgtgtcctcacagggtcgcccctctgtgtgtgtctgtgtcctcatctcctcttcttatgagatgttctcgtccatttcaggctgctatcacagaataccatagactgcgtgacttatacacaacaaacgttgattctcccacaatcctggagctggaggtctgagatccaggtgtaggcagggctggttcctcctgaggcctctctcctggacttggagacgccatcttctccctgtgtcctcacaggatcatccctctgtgtgtgtctgtgtcctcatctcctcttcttatgagatctcttagtccatttcaggctgctatcacagaacaccatagactgggcggcttagaaacgacagacattgattctcccacagtcctggaggctggaagtctgagatccaggtgtgggcagggctggttcctcctgaggcctctctcctgggcttgtagacaccgtcttctccctgtgtccccacagggttgttctctgtgcttatatttgtgggagaggggtgaagaagggaggaatggagggagggagagaaggagggagtacgtggatgctctgcggtctcttcctgttttttttttgttgttgttttgtttttctgaggtggagtttcactctttttgcccaggctggagtgcagtggtgcaacctccgctcactgcaacctccgcctcccaggttcaagcgattctcctgcctcagcctcccaagtaggtgggattacaggtgcctgccaccgcgcctggctaatttttagtattttttttttttttttttagtagagacagggtttcaccatattggccaggctggtctcgaactcctgacctcaggtgatccaccaccccccgacccctcggcctcccaaagtgctgggattacaggcatgagcccccatgcctggccctcttcctgttcttataaggaaatttgtctcatcatggagcatctctgctgtaaactcatcccaccctaatctcccccagagctctcacctcctgacagcatactgaggtttagggttgaaacctatatattttggggtgatataaaccttcagacaatagcagtgagtaagagccagagggtataggatttctttttggggtgatgaaaatatcctaaatggctgggtacagtggctgatgcctgtaatcccagcactttgggaggccgaggcgggtggatcacgtgaggtcaggagttcgagaccagcctgggcaacatggagaaatcccatctcttctaaaaatacaaaattagccgggtgtgatggcgggcacctgtagtcccagctactcgggaagctgaggcaggggaatcgcttgaacctgggaggcggaggttgcggtgagcagagattgtgccattgcactccagcctgggcaacaagagcaaaactgtctcaaaaaaaaaaaaaagaaagaaagaaaatatcctaaaatagactgcggaggtgtttgcacaacttaacgttctaaacccaatgaactgtagatgggtgaattgcatgctgtaggaattctatctctacaaagttgtttttatctttaaaaaataataataataaaagaaaagaaaaaggcaggttgggcgcggtggctgatgcctgtaatcccagcactttgggaggccgaggtgggtggattgtttgaggttaggagttcgagaccagcctgggcaacatatggtgaaaccccatctctactaaaaatacaaaaattagctgggtgtggtggtgggtgcctgtaatcccagctactctactcgggaggctgaggcaggagaattgcttgaaccagggaggctgaggttacagtgagctgaggtagtgtcaccgcacttcagccaggacagcagagcaagtctctgtcaaagggaagggaaggggaggggaggggaaggggaggggagaggaagacaggggaaggggagggggagggggagggaaagggaaagggaaggaaagggaaagggaaggaaaggaaaggaagggaagggaaggaaaaggaagggaggggaggaaaggaaagggaagggaagggaaggaagggaaggaagggaaggaagggaagggaagggaaggaagggaaggaagggaaggaagggaagggaagggaaaggaagggaagggaagggaggggaggaaagggaagggaagggaaaggaaaaggaagggaagggaggggaggaaagggaagggaagggaaaggaaaaggaagggaagggagggaagggaagggaagagaagggaaaggaagggaagggaagggaggggaggaaagggaagggaagggagggaagggaaaggaaaaggaaaaggaaaggaaaaggaggggaagggagggaagggaagggaagagaagggaaaggaagggaagggaagggaggggaggaaagggaagggaagggagggaagggaaaggaaaaggaaaaggaaaataaaagggaagggaaggaaaggaaagaaatggaaaggaaaggaaaaggaaaggaaaggggcgggtgtccataccaagcacagaacccagctgtggtaggcagagagaagagccagcctgagcagacatcaagattaaacagaattgtacttacctgtgcaggtgttggatgtggggagataatccatcttggtttgccctggatttataaggtattttcaggacacaagaacctcagggctaaaagtgggacaattaaaggaaaacgggcacaagttgttaacgctatgtgtagtgggttcaatggtgcgtacctgcaaaagataggaccatgccctaaccccctggaacctggaaacaggactttgtttgctgaaaaagtctttgaagatgtgatttaagggtttgggatgagatcatcctggattagggtgggcccaaaatccaatgacaggttcacttctgagagacagaagaggagacacagacacagaggaggaggccatggggagacagaggcagagactggagtgatggggccacaagcccagggacgcctggagcccccaggagctgggagaggcaggagggatcctcccttagagcctcccagaaggaactggatacaattgtagtggattgaatagtggccaccagaaacatttgtccatatcctaatgctcagagtctgtaagaccttatttggaaatagggtctttgcagatgtcattaagttaaggaccttgagattggatcattctggattagagtgggcccaaaatgcaatgacagctgtccttgtaagagacagaagaggagacacagacacagaggagaaggccacgtggagacagaggcagacactggagtgatgcggccacaagcccagggatgcctggagcccccaggagcttggagaggcaggagggatcctcccctagagcctccacagggaggatggttgatatggtttgactatatccccacccaaatctcacctggaattgtaataatcttcacgggtctatgtttattgcagcactatttacaatagcaaagacttgggaccaatccaaatgcccatcaatgatagactggataaaaaaaaaagtggcacatagacaccatggaatactatgcagtcataaaaaaggatgagttcatatcctttgcagggacgtggataaagccagaaagtcactctcagcaaactaacacaagaacagaaaatgaaatgccgcatgttctcactcataagtgggagttgaacaatgagaacacacagacacagggaggggaacatcacacaccggggcctgttggggggtgggggggcaaggggagggagagcattaggacaaatacccaatgcatgtggggcttaaaacctagataatgggttgacaggtgcagcaaaccaccatggcatacggatacctatgcaacaaacctgcaggttctgcacatgtatctcacaacttaaagtaaaattaaataataataataataataataataatttccacatgtgaagggcaggaccaggcagagataattgaactttatgggcagttttctcccatactgttcctgtgagagtaaataagtctcaggagatctgatggttttataaaggggactttccccttttctcttgcttgccaccatgtaagacatgactttgctcctcctttgccttccgccatgattgcgaggtctccctagccatgtggaactgtgagtccattaaacctctttcctttataaattacccagtcttgggtatgtctctttttttttttttttttttgagacggagtctcactctgttgcccaggctggagtgcaatggcatgatctcagcccactgcaacctccacctcccaggttcaagcgattctcctgcttcagcctcccgagtagctgggatgacaggtacccaccaccacgcctggctaatttttgtgtttttagtagagatggggtttcaccatgttggccaggatggtctcaaacgcctgacctcaggtgatccacccacctcggcctcccagtgcgctgggattacaggcttgagccactgcgcccagccaggtatgtctttattagcagcgtgagaacagactaataccgtgggcctgcctgcaccttaatctcagactcttcacctccaggactgggagatgatgaatttctgttgtttaagtacccccagtgtggggtcattgtttgctatatccccaggacactcttacacaggagaccctggacaggagacccccccgccagcctgggagcctcttctctttgcttacatatctggtgtgatgagccctggaccaaggagctaggaaaaaaaggcagaggaacaggtgggcccccatatcaccgaaggcagaacacttgctcacctggaattccagaaggacacacctggccattgtgggtgttgtcagcgagtgatgtgggacagacgagaggactcaggtgggggaagttataaggcaggaggccatgtgtcaatcaggaagaactctcagacaacagacagctaagagaatcgtgtctggagccccagaagggacccagctggccatccgtagacatgccgttgaaggcaatgctcagtgccgtcaagagaatggaaggtgtcaacttaaaatcacgagattggttgggcaaggtggctcctgtctttcaccccagtgctttgggaggttgaagtgggaggacagtttgaacccaggagttggaggctgcagtgggctgtgatcacaccactgcattccagcctaggtgacagaccgagatctcgtcgcttaaagaaacaaaaaatgacaagatgtacacatttggagaggggagcttgatttgtatagcctaacaggctgggaaatgtagcctctggcagaaactaaaagtagacatttcgaagaagaaaagacagagatgggaatttatgttgaatgagatgaccaagcatacttgtattcaacaggttacaggaggagctatgaattttaatgaagggcatcctgacacgtggatacaggacaaacatgcctgtggcagaagttccacattcacttgggggtagagacttttaacctttaatgtgccccaatgaggctgtctatatcaaaaggtgttttctttttttcttttctttttctttttgagacagagtctcactctgtcgcccaggctggagtgcagtggtgcgatcttggctcactgcaacctctgccttccagcttcatgccattctcctgcctcagcctcctgagtagctgggactacaggcacctgccaccacagctggctaatttttttgtattttttagtagagacggggtttcactgtgttagccaggatggtctcaatctcctgaccccgtgatccacccgccttggccttccaaagtgttgggattacaggcgggagccactgtgcctggcctcttttctttttctttttgagacggagtcacactctgttgcccaggctggagtgcagtgacgcgatcacggctcactgcaacctccgcctcccaggttccagcaattctcctgcctcagcctactgagtagcttggattacaggtgcacgccaccgtgcctggcttaatttttgtgtttttagtagagatagggtttcactgtggtcgccaggctggtcttgaactcctgacgtcaagtgatccacccatctcagcctcccaaagtgctggtattacaggcatgagccactgcgcctggctgtcaaaaggggcttccagaacacagaggcactgagtgtgcagcctctgtcaaccatccagaaccagcccattgtcagagtctcttaccaggagaaagtggctgaaattaatctcttgtgcgatcaaagttgtagttatggctggtggagcaggggatccgtgagtgagcatctgtgagctggacgagcttcaccagttttcatattgttcatctccaagccagggctcgttcagctgctagagaaaaacaaaaagcttgtattagtgaggacactggtggtgttcctcgcagctactctcccagagtagtgagtccatcacgctctaagccaggtgtagacagatagatgaatagatatagctattcgatgattgatagatattgaggtagacggatgaatagattagatgatagatgattgatagctagctattgagatagataggtaatacatagatatagatgacagattgacagatattgagacagataggtggtagatgatagatgtataaagatgatagatgagatagatagatagatgatagatagaggatagttagatacatggtagatacaatgaatggatagatacatagatacatagatgatggatggatggatggatgcatagataatatttacatagatggatggatacatagatacatagatgatagagaagatagatagatacatacatagatagatagaatggatagatacatagatacatagatgatagatagataatagagatagatagatagatagatagatagatagatagatagataggatggatacatagatgatagatagatagatagatagatagatagacagatagatacatagatagatacatagatgcatagatagaataaatggatggatggatggatggatggatggatggatggatgaacacatacaggatagacagatggatgaatagatggatagatacatacatgatagatacataatagatacatgatagatacaatgaatggatggatacatagatacatagatgatagaatagatggatggatggatggatggatggatggatgaatggatggatggagggatggatggatggatgcatagatgatagacacatacatggatggatagatacatagatacatagatgatagatagataatagaaatagatagatagatagatagatagatagatagatagatagaatagatggatggatggatggatggatggatgatggatagataaatacatacaggatagatagatggatgaatagatggatagatacatagatgatggatagatagatagatggctagacagatagatacatagatgatagagagataaatagatggatggctagataggtagatacatagatggatagatagatagatagatagatagatagaatggatggatacatagatgatagatagatagatagatagatagatagatagatagatagatacatagatacatagatagatacatagatagatacatagatagatgcatagatagaataaatggatggatggatggatggatggatggatggatggatgaacacatacaggatagacagatggatgaatagatggatagatacatacaggatagatagataatagatacatgatagatacaatgaatggatggatacatagatacatagatgatagaatagatggatggatggatggatggatggatgaatggatggatggagggatggatggatggatgcatagatgatagacacatacatggatggatagatacatagatacatagatgatagatagataatagaaatagatagatagatagatagatagatagatagatagatagatagatagaatggatggatggatggatggatgatggatagataaatacatacaggatagatagatggatgaatagatggatagatacatagatgatggatagatagatagatggctagacagatagatacatagatgatagatagagagataaatagatggatggctagataggtagatacatagatggatacatagataaccaatataaggagtctctcatgtggggataaccgatatgtggagtttctcagcctcagcactgctgacattttggggctggatgacactctgtggcagggccgtcccgtgcagtgtagtgtgttgaacggtgtccctgggctgcacccaccagatgccaggagctcctccaccccgtcatgacagccagagatgtcgctgctgcccagcgtcccctggggaccacagtggccccagttgaaaacctttgatcaacactcagcctggttaatggcagcatgaacgccacctccccagctgactgcctgcagctctgccagcccctggggctttccatggttttagagacactcagcaatactgccagaacatcagagtctgttgtgaggaatcttatgtgacctgccctaggccattgctggatttttcccccaaacccacagggcgtcggggggacaggggcatcgtgatgagaggtcatcaggcacacgccatacggggtgaaagaggtgggggaggcggcagggaggtctcctgagggatggcggtgtgggtcccgcctggtcccgcccggctgcaaagacgtggggtgtgtgttgagtgccagacggggctggcttgattcaggcgtgcctttacatgttatcagccgtgggtctgaccacggccatgccatgacctaatagctaacctcaatttcctcttctgtcaagtgagaaaaacctttactttccctcccgtcaccacaggggtagtgtacccagaagcaggctcaaactcaacatgaagctactcatgaatgtggcagggagacatgggaagtcaggcaggggggcggaaatcgcgcgtcgccaacaggaggggccggcacgtggggactccgccgggtgctgtgaccgggtgccgtcacggccccgagcctcagtttagcaatccacacaacaggtatgtcgccagtactgcagggactcatgagctaccccagctccgaaccaccgtcggcggtcaccggggatatgagcgacagcttttctggctcagtgatgattttcagctaggaaggcttgggtggggtcctggcgtgtctcccgggacaactcctcatccaacgagagatgaggttgactatttccaggactcaggaagtagtgggtgctgactgacaggtgttcaaggacaatgtggaatgtcaggtctcatctcgtccggtgaaatctaggggacttcatcttggacacgcacagagagagcaagtgaggacgcctgccctgatcatgcctctgaacttagaccctccttgcttcgctcagaggcagctgggggtgttgcatgtacgcaagggcttcgggaggcttttggaaacagtagaccacggaactttggggcccatgaggactccgatttgaacaaacagggacctgataccttgagacttgaccaggtctgagttattcttggtggccagctcctaggacccctgaatccatggactcctaggacccgtccattgcctacagaaatgaaaatggccagaaagtggccgggcgcggtggctcacgcctgtcatcccagcactttgggaggcctaggtgggcggatcacgaggtcaggagatcgagaccatcctggctaacacggtgaaaccccgtctctactaaaaatacaaaaattagccgggcgtggtggcgggtgcctgtaatcccaggtactcgggaggctgaggcagaagaatcacttcaaccagggaggcagaggttgtagtgagccaagattgcgccactgcactccagcctgggcgacagagcaagactccatctcaaaaaaaaaaaaagaaagaaagaaagtggccagcaagtgacaaacgtccaaaatgtccagggtccctctgagtcacggagctcatggtgatgtcgtcaagattctggtcaacgtggtagatacatctttacatccaaacacctctctctctcctctgccttctttctttcctggactcctgatacccccagctcagggctgaaaaggaagcattttctcaatggaaaggacaaagaggcagtcttctctcagaagagacatctccatctatagcctggtgggccacaccagttctgtctagaaggacacaaacttctgtcttcttttgtctacccaattagcctcctggctcatcttagaaggggaagggcacaggggagcatgttttaagaaggaaattaagcatcaggcatggtggctcacacccgtcatcccagcagtttgggaggctcaggcaggcgggtcgtctaaggtcaggagttcgagaccagcctggccaacatggcaaaaccccgtctctactaaaaatacaaaaattagccaggtgtggtggcgggtgcctataatcccagctactagggaggctgaggcaggagaatcacttgaacccgggaggcggagcttgcagtgagccaagactgtgccactgcactccagcctgggtgacggagtgtgactctgtgtcaaaaaaaaaaaaaaaaaaaaaaagaagaaagaaattaagatgctttgttcaatgtaaaaaagatattcttttgttacaaagtttagaaatgggaaatgatttttaaaaatgcaatactcaaggaattttacacaggggtagaaatggaaactctacttgcaagtcctcctcctggattcttttgttttttgttttttgtgttttattgtttgtttgtttttgagacgcagtcttgctctgtcgcccaagctggagtgcaatggcgccatgtcggctcactgcaacctccgcctccctggttcaagcgattctcctgcctcagcctcccgagtagctgggatgacaggcgcccgccaccacacccagctaagttttatattttgagtagagatggagtttcaccatgttggccaggctggtctccaactcctgacctcaggtgatcgacccgcctcggcctcccagaaggctttttgtatcttccgaagctagtggataatattctgaaattgttgatgagacacctagcttcatcttcagttgtctgcagacactcatccagtgcctccatgtggagtggttccatttttcagccctgtccttgctggccacgaggaaactcagtccatggacactatctgtggtcattaagacgccaaggccaacggaaaggccggtgacgaggccctctgttgcttccttctcagaaagataaagatctgctttccacagtctcatccgtttttgtgatgggcaagtggccagagtaccacgtcagtcacagaaacccagctcaggtcctctgagacgccctgattcacgtttccaatttgaggttgagcatgagattttcttccttttttttttttttttgagacagagtctctctctgtcacccaggctggagtgcagtggtacgatctcggctcactgcaacctctgcctcccgggttcacgccattctcctgcctcagcctcccaagtagctgggactacaggcgcctgccaccacgcccggctaatttatttttgtattttttttagtagagacagggtttcaccgtgttagccaggatggtctcgatctcctgaccttgtgatccacccgcctcggcttcccaaagtgctgggatgacaggcgtgagccaccacgcctggccaatgcccggctaatttttgtattattagtagagacagggtttcagcatgttggccaggctggcctcgaactcctgacctcaggtgatccgcccgcatcagcctcccaaagtgctgggattacaggcgtgagccacaacacccgacctaattttgtatttttagtagagatgggatttcaccatgttggccaggctggtctcaaactcctaacctcaagtgatccacctgcctcagactcccaaaatgctgggatgacaggcatgagccactgcacccagcctgatcagttttgaccacagagaacatttcaacagagggaagtttccagcacgtgggatccttatggtagcaggaagtgaaacctatgtttaaatttcaacacatgaactgttttgctgtcatgaggtggacagggtcaccactaaaaggctttcaaatccaggtctacatcacatcaggaggcaataagattgaaacagaagcttcaaggggggcaaagaagcatgtggaattcccaaatctttttttttttttgacacagagtcttggtctgttgcccaggctggagtgcagtggcgccatctcggctcaccgcaacctccgcctcccgggttccagcgattctcctgcctcagcctcccgagtagctgggactacaggcgcctgcaactacgcccagctaatttttgtatttttagtagagacggggtttcatcatattggacaggctggtctcgaattcctgacctcatgatccgcccgcctcggcctcccaaagtgctgggattacaggcgtgagccaccacgtccagcagaattcccaaatctttaaagacagttcctttacaggttatttaagtggataattgcctgtaaaacaccaacatgattacagtctattcagttcctccagaacagcgacaaagcagctgtgtttggtttttcttgttttttgttttgtttgagactaagtctcacccaggctggagtacagtggcatgatctcagctcactgcaacctctgcctcccgggttcaagtgattctcctgcctcagcctcctgattagctgggactacaggtgcctgccaccatgcccagctaatttttgtatttttagcagagacggggttttgccacattggccaggctgttctcgaactcctgacctcagatgatccacccgcctcggcctcccaaagtgctgggattacaggtgtgagccaccacacctggctaatttttgtatttttagtagagacggggtttaccacgttggccaggctggtctcgaactcctgacctcaggtgatctgctcgccctggcctcccgaagtgctgggatgacaggtgtgaaccactacgcccagctggcagttgtattttaagtaacaaagctcgtggcatgtcagaaagtgcctgcatctttcaaacttgttcagtagtaacattaaaattattttaggggtgcagagacaaagccatttctgtgagtcccctgaggctgacacaaaaaatgccacaaactggggagttcgacaacaggaatttactttcttacagttccgggggccagaagtctgagatcaaaatgtctcaggtccgtgctccctcaaggagctctaggggagggtccttcctgtctctcccagctcctgggggctccaggcatccctgggcttgtggccgcgtcattccaggctctgtctccgtctccacgtggccttctcctctgtgtctgcgtctcctcttctgtcttttaccagggcacctgtcattggatttagggcccagcctaatccaggagtatctcatcttgagatccttaactcattaaatctgcaaagttcttatttccaaataaggtctcattccaggttctgggctctaggatatggacatatctttccaggatccgctgttcaacccattacaattggatccagttccctccggaggctccttcctgtctctcccagctcctgggggctccaggcatccctgggcttgtggccgcgtcattccaggctctgtctccgtctccacgtggccttctcctctgtgtctgtgtctcctctcctgtctcttagaaggacacctgtcattgcatttaaggcccacccagacaatgcaggattattttctctcaagatccacaacggaatgaatctgcaaagaccctcttttccaaatgaaaccccctccccaaatagcagggctcaggacacggacatatctctgggggccaccatccaacccagcatgggaggccctcgatctgggtttgcaggtggggaaggctgctgagagtagggacaggggcggctcacgtggcagccagcacaggggctcttcggcaaagcgtgttgccgggaggcaaacagggtccccagagagtcagtagaaagaggaacctggctcgcagcggggtcctgtccctggctgagtgtcaccaacactcactctgtgttcgaagtgggggagggaggggaggaggtttgccacccccacccctgccccccgggaggacatgaccaaaacagagataagcaaatccatgttcttgctcgtgtatcttcagtgatgtggtcccactcctcataaacctagacaggactttatttccaaatagaaaaatgaggccaggcgtggtggctcacgtctgtcatcccagcactttgagaggccgaggtgggtggatcacctgaggtcaggagttcaagaccagcctggccaccacagtaaaaccctgtgtctactaataatacaaaaatgagctggatgtggtggcacacgcctgtagttccagatattcaagaggccgaggcaggacaatcgtttgaacccgggaggcggaggttgcagtgaggcaagatcacagcgctgcactccaatctgggtgacagagcgagatttcgtctcaaaaaataataataataatcaataaaaatgaaaactcgccgggcgtggtggctcatgcctgtaatcccagcactttgggaggccgagacaggcagatcacaaggtccagatatcgagaccatcctggctaacacggtgaaaccccatctctactaaaaatacaaaaaattagccgggcgtggtggtgcgcgcctgtaatcccagctactcgggaggctgaggcaggagaatcacttgaacccgggagatggaggttgcagtgagccaagatcgcaccactgcactccagcctgggcaacagagtgaaactttgtctcaaataataataataataaaaaataaaaatgaaaactaagacggggcaatatagtgagacccctatgtctacaaaaataaataattagccagccatggtggtgagcacctgtggtcccagctgctcaggaggctgaggtgggaggatcggttcaggccaggaagttgaggttgcagtgagctatataatgtcaccatggcactctagcctggggcaacagagcaagaccttatgtctccataaataaatacagaaaaacgaaagtgaaaatgaaaacgcatcagaaagtcaaacacaggccaaaagtctgcaaagcaccgtcacagggatgcacagagtgcttccaggggtctgatatttacgtcccttgaagtcggaccgaaaacattcagatgtaagcctggacatggtatctgagaagacacagccacctccttccaagacgtagttcacaagagggccctgggactctccggccagctctgtgagctttggaagatgggcgtagagtctgtcacaggaaggaaggctggatagcagccctgtggtaaagttaaaaggtcaggcttaaaaatccccacctctcccaggacagaaccgagagattcaggccaccctgggccagacaggcggccccagctgcttggcctggaaaaccacccaggggattgtaatgggtcatttccctctggcggggaggttgtgtctcccagaacctcggagcctgggtgctgctgggggctttcctggttttagcacacccaaaatcctatgtccacggcagcccattggtcgtcacaaacagggctgggggtggcggcggctcagagcaatgggcctctgttgacttctaaagaattaacgtggccgggcgcagggcctctcgcctgtaatcccaagactttgggagggctaggttggaggatcacctggggtcaggagttcgagaccagcctggccaacatttagtagaaaccccgtctctaccaaaaatacaaaaattagctgggtgtggtggcgtgtacctggaatcccagctactcgggaggctgaggcaggagaatcacttgaactcgggaggcggaggttgcagtgagccgagatcacaccactgcactccagcctagatgacagagtgagactccgtctcaaaaaacaaaaaaaaaaattagctgggcatggtggtgcacgcctgtagtcccagctacttgagaagctgaggtgggaggatcactagaacccaggagttcaaggctgctgtgagccatgattgtgccaatgcactccagcctgggcaacagagtgagaccctacctcaaaataagtacataaataagagaataagaaaacaattacattaacaataacaccaaaaagaataaaacagttagaaattaatcatgaaagtagatttgtacaccgaaaactaaaaaaaaacattaaaaaacaacaacaggccgggcgcggtggctcacgcctgtcatcccagcactttgggaggccgaggcaggcggatcatgaggtcaggagatcgagaccatcctggctaacacggtgaaaccccgtctctactaaaaatacaaaaaattagctgggcatggtggtacacgcctgtagtcccagctactcgggaggctgaggcaggagaatggcgggaacccgggaggcggagcttgcagtgagctgagatcacaccactgcactccagcctgggccacagagcgagactccgtctcaaaaagaaaaacaaaacaaaacaaaacaaaacaaaaaaacagattcaaaaaattagagatataaataaatagaaagacatcccaggttgcctcttgtcttgttcccaagttacttacggctctgttttggggaaatcatttagaaagttttggtcaggttgtttgaatgtagtattttaaattatagggtttttttgttttgttttgtttttatttcttttttttccttattaatacgtttcacctaatgacacatttcccataagttatagttttaatatacgcagtaaatacatagtacgtgaaacattgcattaaagtttgggcgtaagaggcgatctggtgatagtttgcaggaacataaccagtaggtgtggcaagcattacctcatgcgtaagaaaaggccagggccaccaggcatggtggttcacgtctgtaatcccagcattttgggggccaaggcaggaggatcacctgaggtcaggagttcgagatcagcctggccaacatggtgaaaccccgtctctactaaaaatataaaaattggccaggcgtggtggcacacacctcgtgtaatcccagctactcaggaggctgaggcaggaaaatcgcttgaacctgggaggcagaggtttcactgaaccgagatcgtgccattgcactccagcctgggggacaagagtgaaactgtctcaaaaaaaaaaaaaaaaaagaaaagaaaaagaaaaagaaaaaaaacagagggttgggtgcaggggctcatgcctgtaatcccagcactttggaaggctgaggcgggtggatcacaagataaggagttcaagatcagcctgggcaacatggtgaaaccctgtctctactaaaaatacaaaaattagctaggcattatggcacgcgcctgtaatcccagctactcaggaggctgaggcaggagaatcgcttgaactcaggaggcggaagttgcagtgagccaagatcgtgccactgcactccagcctgggtgacaagagtgagactccatctcaaaaaataacagagggccaggtgcggtggttcgcacctgtcatcccagaactttgggaggctgaggagggcggatcacaagatcaggagttcgagaccaggagttcaagatcaggagttcagcctgtgcaacatggtgaaaccgcatctttactaaaaatacaaaaattagccgggcatggtggcgcgtgcctgtaatcccagctactcaggaggctgaggcaggagaatcgcttgaacctgggaggcagatgttgcagtgaaccaagattgtgccactgcactctagcctgggtgacaagaggaaaactccgtctgaaaaaaaaaaaatacagagttggctgttgcaggtcccatagtgttgggaggtcacctcttgtgggctgtaaccaagatgggctggccctcttcaagttttctttctttttcttttttttttttttttttgagacagagtctcgctctgtcgcccaggctggagtgcagtggcgcgatctcggctcactgcaagctccgcctcccaggttcacgccattctcctgcctcagcctcccgagtagctgggactacaggcacccgccaccacacccggctaattttttgtgttttcagtagagacggggtttcagcatgttggccaggatggtcttgatctcctgacctcgcgatctgcccgcctcggcctcccaaagtgctgggatgacaggcgtgagccaccgcgcccggcctcatcaacagttttctgacactgtgggtgctgtttaaagttcaggagcagcttgagtctccagggcaaaccaggaatcagctcgcagggagcagttggtcttttatttttatccttcatgctctccgtgtctgttggctggcacccggcgggagtgtactgctcatccctctctgcttcttacctcctcagtcctgcttcctgggttcagctgccccaaaccaaatactcacagcttcctggatggcaaggacccgctaggctgcaggtctgacacccacaggcctccaagccggtcccaacaagcccctcgccgccccactgcaccccaaaccaaccatctctcaccagcctggatgctactccacacctcagcaagtccggtaccttcttggagatgccaggcgtaataacaaacagaaaaggccatatttgcttgtcagcatactatttatttatttatttattttgagacagagtttactcgtcacccaggctggagtgccgtggcacggtctcggctcaccgcaacctccgcctcccgggttcaagcgattctcctgcctcggcctcctgagtagctgggattacaggcacccgccaccatgcccggctaatttgtgtatctttagtagacacagggtttcaccgtcttggccaggctggtctcaaactcccaacctcaggcgatctgcccacctcggcctcccaaaatgctgggattacaggtgtgagccaccgtgcccggcctacactccagcttgggccacagagtgagaccttgtcttgaaaaaaaaaaagagaaaaccctaattaacatgctatttaaaaaaaaaaacattgatctctctctgtgatgtttgagtttcttttttttctttttcttttctttttttttttttttgagacggagtcccactctgtcccccaggctggagtgcagtggcgcgatctcagctcactgcaacctccacctcccgggttgaagtgattctcctgcctcagtctcctgaatagctgggattacaggcacccgccaccaccacgcctggctaatttttgtattttaagtagagacagggtttcaccatgttgatcagactggtctcgaactcctgatctcaagtgatccacccgcctcggcctcccaaagtgctgggattacaggcgtgagccaccacgcccggcctgatgtttgcatttctatccatactggtttactagcggagtgactgagtttctaaaatactaatattaaaaatacttggccaggtgcggtgggtgcctgtcatcccagctactcgggagcctgaggcaggagaattgcttgaaccagggaggcggaggttgcagggagccgacatcgcgctactgcactccaacctgggagacagagtgagactccatctcacaaaaaagaaagaaagaaagaaaaaaaactcccaggaagcagtgttgaatatcttcccaagtcctagttacctacaaatgactgctccgtctgaagccgcggctgactgaatgttttaaggggacaccaccttccttcccagcctgttccctccaggaaaatagtagaggacagaggctccaagaagtagatttgggaactgcagacaagttgcttcctgtgaactgagcggagagagagagaaaccctctgagagggcagagggcaggatcccagggagtcgcacccgggagggctgtggctgtggctgtgagccttctcatgtggctccccaacgccaaggcaggcagccactgaacaattgtgaataaccatttcccaccctgtaacgtgctgtctctactgagaagctggcgggggagcatgactccagatggcctcgagatggtctttgggattcaacagcagggagaagccagtggtacccaagttgacgtccattcagcctaggtctcagcagcatcccaagttcacttccattcagcctaggtttcggcagcatctctgacgtctgccttctcccaactgcttcagagtggatgggtagtcagctcggccgccgtaataaaacactgcaaactgggtggactgtaaacaacagacattgtttctcccacagtcctggaggctggaggtctgagatccaggtgtgggcagggctggttcctcctgaggcctctcttgtggacttagagacatcgacttctccctgtgtcctcacagggtcatctctctgtgtgtgtctgtgtcctcatctcctcttcttatgaggtgtcttagtccatctcaggctgctgtcacagaataccgtagactggggggcttatacacaacagacattgattctcccacagtcctggagggtggaggtctgagatccaggtatgggcagggctggttcctcctgaggcctctctcctgggcttggagacgccgtcttctccctgtgtcctcacagggtcatctctctgtatgtgtctgtgtcctcatctcctcttcttatgaggtgtctttgtccatttcgaacgactatcccagaataccatagactgggcagcttagaaacaacaaacattgattctcccacagtcctggaggctggaggtctgagatccaggtatgggcagggctggttcctcctgaggcctctctcctgggcttggagatgccgtcttctccctgtgtcctcacagtgtcgtccctctgtgtgtgtctgtgtcctcatctcctcttcttatgaggacaccggtcctattggatcagggcccactcctggtgacctcattttactgtagttaactctttaaagaggtaacctccaaatacagccacattgtgtggtcctaggggttaggactttaacgtatgaatttgggagggtacaatgcagcctgtaacagacacaacactcagaaaatatatactgagctcgctgtttgtaataaagggctctccctttaatttttaagacagggtcctgctctgtcacccaggctggagtgcagtggtgtgagttcaattcagttccgaacagtgagtacagtgcagttcagctcactgcagcctcaagcttccaaataaaaaactgtcttagcatcatccaatgagtactgactacttttaaatagtgaatacgcagccgggcgcagtggctcatgcccgtaatcccagcactttgggaggccgaggcgggtggatcacctgaggtcaggagttcaagaccagcctgaccaacatgatgaaaccctgtctctactaaaaaaaaaatacaaaaaaaaaaaaaaattagccaggtgtggtgatgtatgcctgtcttcccagctacttgggaggctgaggcagaatcatttgaacctgggaggaggaagtgacagtgagcggagacggtgccattgcactccaggttgggaggcagagcgagactcagtctcaaaagaaaacaaatagtgactatggacatacatatttttaaaaattagtattttcacataaagcataaagtaatatccaatatatccaagagaagctgtccttaagtttaacccattttctaatcctaaactaacccttctgaggcaatggtcccgcatacatggaggccaaactcattttttttttttaaagcctaattgaaaaataccgcattaggagaaaaacacataaaatccccctcggattacctgacctcgctccctggggcccagggccaaaaagaggaagcttttccatctattgttgctctggccagtttcataaccgccatgcaccaagctcagtctgcagatgacagatcgcagctaagagcagcttgctgggtctccggaggctgctggtgtctgtctcaaggtgcggtgcaggcacagccagtgggatttttttcccagcagagcagagagctggccctccactcctgctcctgtgcggagctcactcccatagggcagccgcctctggcccaggaggagggtcccccaggaccccctgcctagcttgacggctgctcagacaagcaccaccagaccagcatcacccaggacgtctgccctccctgcagccaccgttgtaagtcacggggacctgggagtgttcgggtaggagaggctgctctgcagaaataccccagctagcagggcatatccaggccagagacgctgctgaatgccagagaaagccctcagctcagcctccctttggggtgtgtgatttttaacccgggctcaccagagtgctgcaaaaggacacacagcctccaggcaggagctgtgccatttgcacaagctctcgagggtcgcagagagggctgaggttggcctaaaacagacccccttcttgcacatcttcagacgttgccgcaagaaaagagcaaaatcgtcttgtccgttttaacggagattcccagtttgcaagccaattgttcctttgacgaggggtacaggccggcccacgccgagatgctgggttgggtggctctcggatgaagaaagtcccaccttctttaaaatgcgctctcccagaaatcttcttcacacctgtctttggcttttattttgcttttgttttgtggggaggagacgttgttcttggtttttcgctaataaaaatagttcacgtcgactgagtgaggaggaagcagcagccacttttacaagggctttatctctgcgatctttccttccttccctccctccctcctccctccttcctccttcctcctccttccctccctcctccttcctccttcctcctccttcctccttccctccctccctccttcctccttcctccctccccctcccctcccctcccctcccctcccctcccctcccctcccctcctctcctgtcctctcttctcctctcctttctttcctttcttgtctcgcactgttgcccaggctggagtgcagtggcgtgacctctgctcactgcaacctccgcctcccgggttcaagtgattctcctgcctcagcctcccacgtagctgggattacaggcgcccaccccaacgcccggctaattttttgtattttttagtagagatggggtctcactatgttgaccaggctgatctcgaactcccgacctcatgatccacccgcttcggcctcccaaagtgcgcctggcctgatctctgggattttcgaaacttcgtgagacaggtgctgttacaatcatccctgttttaccagtaacggaaactgaggcagacatggaggcgggggtgtgttcaagacctacaaccagaaagaggcagaggtgggcgctgagtgctgctcgttagccttgaaccactgcactggggaattagtgatgaatgatacgtgactgcctttgaaacaaccatgtctcagcccagggcaggtggcctgggctccgtgggccctctctctggaactaggacaattctgtccctcaactgggagcccaacctgcctacccctagtgcttgaggcataactgtcttctatggccagcaatagaaacttgagtcgagctagctgaagtcaaggtggaaattgtcaaattggataattaggatttctatgggggcttcaggcatggctggatccaggagcttacatggttgtcagtttctcctctttctctttctctcttcccacgtttcagccccacctttttctgcctccctcagctgcagggtgtggaatcactggaggaagaccactttctctatagggatggaaagagggtctctggtagcctggggtccccatcttttcagagcagaatcaaatgggaaaagagacaccctctctctcctggcacccacaagttacacctcctgaagggttccgaccagccatgtcagaaacaaatgaccactgcttgagataatttttatgaacagggtgagggtggccccctaactggccaggcttgggccacacccctctcttgggtgattgacaggctttggccacacacccccatcttcagtgattgacaggcttggaccacacccccctatcctcagtgattgaaaggcttggaccacacccctctcctcattgattggcagtcctggagaaccacacagcccagacagggagtgaccccaggggcgaggggtgctgggtgcacagtttccatggatgcagcagagaggtcagggccagtagcaagctggaccaaagtggaccggagggaggcggtggggctaacgtccacactgcccctgccgccttctgtccattccatcactcattcactctgcattctcagagtggcattcattcatgcattcattcatgcattcattcatttactcatttgctccacacattccatcactcattcgctctgcattctcagagtggcattcattcattcattcattcatttactcatttgctccacacattccgtcactcattggctgtgcattctcagagtggcattcattcattcactcatttactcatttgctccacacattccatcactcattcgctctgtattctcagagtggcattcattcattcattcattcatttactcatttgctccacacattccgtcactcattggctgtgcattctcagagtggcattcattcattcactcatttactcatttgctccacacttgtcaggaactagtgggcatcatgcattcactctttcatttattcactccacttttagggagaaaaccctacacgtcattgatttatgtattcacccattcgtttatcaagcaagtcctgtgtgctactcattccttcattccctccacatttgcaggaatgaatctctgtgtgtcattcattaattcccttcacatttgtggggaatccccggatgtcattcattaattccccccacatttgtggggaatatctgggtatcattcattcattctctctacatttgcagaagtgaatctggggtatcattcattcattccccccacatttgcagtgaatatctgggtatcattcattcattctctctacatttgcagaagtgaatctggggtatcattcattcattccctccacatttgtggagaatccctggatgtcattcattcattccccccacatttgcagggaatatctgggtatcattcattcattctctctacatttgcagaagtgaatctggggtatcattcattcattccccccacatttgtggggaatatctgggtatcattcattcattctctctacatttgcagaagtgaatctggggtatcattcattcattcattccccccacatttgcagggaatatctgggtatcattcattcattctctctacatttgcagaagtgaatctggggtatcattcattcattccccccacatttgcagggaatatctgggtatcattcattcattctctctacgtttgcagaagtgaatctggggtatcattcattcattccccccacatttgtggggaatatctgggtatcattcattcattctctctacatttgcagaagtgaatctggggtatcattcattcattccctccacatttgtggagaatccctggatgtcattcattcattccccccacatttgcagggaatatctgggtatcattcattcattctctctacatttgcagaagtgaatccggggtatcattcattcattccctccacatttgtggagaatccctggatgtcattcattcattccccccacatttgcagggaatatctgggtatcattcattcattctctctacatttgcagaactgaatctggggtatcattcattcattccctccacatttgcagggaatatctgggtatcattcattcattctctctacatttgcagaagtgaatctggggtatcattcattcattccctccacatttgtggagaatccctggatgtcattcattcattccccccacatttgtggggaatatctgggtatcattcattcattctctctacatttgcagaagtgaatctggggtatcattcattcattccccccacatttgtggggaatatctgggtatcattcattcattctctctacatttgcagaagtgaatctggggtatcattcattcattccctccacatttgtggagaatccctggatgtcattcattcattccccccacatttgtggggaatatctgggtatcattcattcattctctctacatttgcagaagtgaatctggggtatcattcattcattccccccacatttgtggggaatatctgggtatcattcattctctctacatttgcagaagtgaatctggggtatcattcattcattccctccacatttgtggagaatccctggatgtcattcattcattccccccacatttgcagggaatatctgggtatcattcattcattctctctacatttgcagaagtgaatctggggtatcattcattcattccccccacatttgcggggaatatctgggtatcattcattcattctctctacatttgcagaagtgaatctggggtatcattcattcgttccctccacatttgcagggaagccctggatgtcattcattcgttccctccacatttgcagggaatatctgggtatcattcattcattctctctacatttgcagaagtgaatcctgggtgtcagtcattcattccctccacatttgtgaggaatccttaggtgtcattcattcattcattctctccactgttgcaggagtaaatctctgagtgatattcattctctctacatttacggaagtgaatcctgggtgtcagtcattcattccctccacatttgtgaggaatccttaggtgtcgttcattcattcattctctccactgttgcaggagtaaatctctgagtgatattcattccctctacatttgtagggaatccttaggtgtcagtcattcattccctccacatttgtggggaatctctgggtatcatttattcattctctctacatttgccgaagtgaatcctgggtgtcattcattcattccctccacttttgtggggaagccctgggcatcattcattacttttctctacatttgcagaagagaatcttgggtgtcattcattctttccctgcacatttgtgggaatgaatctctgggtgtcattcattctttccctccacatttgtgggagtgaatcctaggtatcatccattcattccctccacatttgcaggagtgtaccctggatgccattcattcattcattccctccacatttgtgggagtgaaccctgggtatcattcattcattccctccacatttgcataactgaatcctggatgtcattcattcattctctccacatttgtgtggacgctctgagtgttattcatacatgcacccattcattccctccacagtcattgggaatgtcctgtatcacacacacacacacacacacacacacacaccctgcatttaccaagaccatcctgggtgcacagctctaagctaaggacagcagacccaaaggagtttgcagcaggtacctggtggggaggagagggtcttcatggaggcaggagctggcacccatgggctggaatgaaatgcagacttccaagaggctctggcaggtccatggtgggctgatgccccaagaaggagggttgaaggtgtcactcaagactgtgctgggtgcagacaggcataaggagctgcatgggccagaggaatcacaggagctagggcaaggagatatctgtgagttggtcccaccgctgtggggacacagctttctgcagggccaggtagaccactgtaccaaggaaactggcataagcacatcatctgtgcctgacagcgagcaggggaaacaccaccccagcctttgagtagtagtcacttggtagctttgcattcaccccttcccaggagggtggtttagggcagaaccaggcagtgagattcctcagctcgttctgcctctccaggaataactcaggcaggctgaggggctcctgggggctcagctgttagtgatacactggggaccctgttgagacccacttctcttcttcttcttttttttttttagacagagttttgctcttgttggccaggctggagtgcagcggcacgatcttggctcaccgcaacctccacctcccaggttcaagcgattctcatgcctcagcctcccaagttgctgggattacagacgcccaccaccacgcctggctaattttttatagttttagtagagacggggtttcaccgtgttagccaggatggtctcgatctcctgacctcgtgatccacccgcctcggcctcccaaagtgctgggatgacaggcgtgagccaccgcgcctggcccggccttcttttttacccgtattctgacttgtccccaacccctgcaaagagcaggtgcaaatgcacctgcccagcaggccaggactatgctccagcctcagggagcaccaggatgatacacttcaggtctcttctccttggggagctctcagtatgcagtatggtccctgaaatccccttgggagggcagggaggatgagacaggcagccagagacaggtgcagagttcaggctcagaggcgcaggtgtgtttccactcagatgcgtgtatttggagattattgcaaggcagagtgcggcatcttctacatgcccagaaaacctacagtctgggtcccaagcaccacgccccttgtcactcatggcccaggttccttatgccctctgcccctcagtgtccccatatgtaaagcaaagatgataagcgcgtcttcctaggacgggtgcacaaaaaaacgtttgcaaacattcaatgtgacgtctgctctaagaacaggcgatgtcacctgaggactcaagcacacttgaccttctccttccctgtcatctccaggcagctaggaaggaagctctgtgtggccgggaaagacaaggaggaaattgaaacaatgctggacttgagaacttggacgcctttcactgtggctccctgagggacaccgtgaggtcactggttcacacagtggtggccactgcttcccctccactcaggcccagccaagctcaaatcagccatagtgaccacagacagggaaggcttgcgcagccggccccagacaccccggtagggacctgagggatgaggaggccaggctggctacggccccagtgacgactgcatcccccaaaagcggaagctcggccctggggctgccctgtcccggggagaaagggtcagcctggctgtgaccggggctctctgagggacaggaagacccaagcaacaagcgggggagcactgagactgcaggagcattcaggactcagcgcgggcagggagtcagccaggagggtgtaggggaagggccagctcagacgcaggaagtaaaccagaaacctgaggaatgtccttcctgcttcaagagacaattgtttcttgttgagattatgcttgacatgaactcaccgttttaaagcgaataactgggggacatttaggaccttcacagtgctgggcaacagccgcctctgtctatttccaccactttgtcattcctgcaaaaggaaacaccccctttagggggaaagtcactccccgtttccccatccccagtcccagccatggtcatctgctttctctctatatggatcagcatgttctgggcattttattgaaatggagtcctacaccatgtggccttctgtgtctggcttctctccctgagcatgatgtcttcaaggttcatccacagtgtagcctcggtcacagccttcttccttttcatggctgtatactattccactgtgtgcatgggggggccacgttgtgtttatctgtctgtctgttgacggacacttgggctgtttccaccttttggctgttgtgaagagtgctgcagggaacgttcatatgcaagtttttatgggtgcaaccattttttgttgttgttgagacagagtttcactcttttcacccagcctggagtgcaatggcatgatctccgctcactgcaacctccgcctcccgggttcaagcgattctcctgcctcagcctcccaagtggctgggatgacaggtgcctgccaccactcccagataattttgtatttttagtaaagacagggtttcaccatgttggccaggctggtcttgaactcctggcctcaggtgatccacctgtctcagcttcccaaagtgctgggattataggtgtgagccaccacacctagcccctttttatacattttctaatgctaccttcacttaccaaaatgacatgcagaaataatgtattatacatataattatatatacacataaggtgatctataaaatatgttgtatataattttatatatgctatgttcaatatgttacatataatacacaaattatatataacatataaatgatactatacaatatatcgtatataattattaaatatacatacaatataacatgtttaatttataataaaataagttgtaaataaattattatataacaataatatatataaataatatatgtaatattatataataataatttatacattatatcactttatatgattatgtatattatttacatattaaatttacatatccatatagccttaattacaatataaaagagaaacaaaagtaaataaaatgttaataaggtaatatttaatttaatgtgtacacatttacccataatttacagtaaggcatcattaaggggctgggcgcagtggctcacgcctgtaatcctagcattttgggtggccaaggcaagtggattgcctgacctcaggaatttgagaccagcctgggcaacatggtacaatgcccatctttgctaaaattcaaaaatgtagctgggcgtggtggtgcacacctgtagttccagctactcgggaggctgaggcacgagaactgcttgaagcccagaggtgaaggttgccgtgagccgccatgaagccactgcactccagcctggacgaccgagtgagaaaccaccttcaaaagaagaaaaaagacattactaagggctgggtgcagtggctcagacctgtaatctcaacacttttggaggctgaggcaggaggatttcttgagtctaggacttggagaccagcctgagcaacaaactgcaatcctgtctctaaaaaaaaaaaaaaaaaaaaaaaaagacattattacatcattaaggaatcagatgtttgcttaacaaattctccacctgtctttatttgtctccagcttttacctaggaggagaattggtgcatgacatggttaactatttgaggacacaccaggtgatttttggagtcaatttgcaaacacgcaggacttgaatgggacacagaggattctagtttttgctcaggaaggttccccagctgccgcttcttcttcttcttcttcttttttttttttttttttttttttacagggttttgctctgtcacgcaggctggagtgcagtggtgtgatctcagctcactgcaacctccgcctcccgggttccagcaattctcccgtctcagcctcccgagtagctggaatgacaggcacctgccatgacacccggctaattttttttgtatttttagtacagacgaggctttgccttgttgaccaggctggtctcgaacttccgacctcatgatccgcccgcctcagcctcccaaagtgctgggatgactggcgtgagccaccgcgcccggcctgtaatgttaatttcttgtgctgaggggtagcctaggatgggtactgctttgaaatcttttaaaatatccttttctgtgggcctgagaacctcccttaggtcacaaagagaacaaagaaatgagtctctgtctatgatcactgctaccttgggaccctttcacctttcagaggagagagattgaaactggctcacacgtggggaaatacgtatactggaggcttgtcacagctgagggttcccgtcattgggggtttgggtccagggagcaagagaaaaacacactcctttgtgttcaaagatgaaaatctttcctgagtttaggggagcccagctttgggtttaggggaacccagctttttaggtatataagggcccagctttgggtttaggggagtccagctttgggtctaagggagcccagctttgagttgaggggagcccagctttgggtttaggggaacccagctttgggtttaggggatcccagctttgagttttagggaaacccagctttgggtttaagggagctcaggtttgggtttaggagagcccagcttttggtctaaggcagcccagcttcaggtttaaaggaggtcagcattgggtttaggagagcccagctctgtggttaagggagctcagctttgggtttaggggagtccaactttgggttttggggagctcagctctgggtctaagggagcccctctttgggttttaaggaagcctgtttttgagtctaagggagggtagctttgggttttaatggagctcctgtttgggttgtttcttttttttctctctctttagacaaagttttgttcttgttgcccaggctggagtgcagtggcgcaatgttggctcaccgcgacctctgcctcccgggttcaagcaattctcctgcctcagcctcctgagtagctgggattacaggcatgcgcctccatgcctggctaattttgtatttttagtagagatggggtttctccatgttggtcaggctggtctcgaactcccagcctcaggtgatccacccacctcagcctcccaaagtgctgggattacaggcatgagccaccacgcctggctcctgtttgggttttaaggaaaccccgctttggatctaagggagcccagctttgacttcgggcaggaacaaggtagttgagaccgtctcggtttcttctccagggatctttctctttgactgctttgctgagcacatggctggaaacaggatgagcagaatccaccagatcacaattaaagtatcctaaggcaagtccgcgtcaactcacactgagcaacgatctttatttatttatttaaattaaaataattgattttatctttcatttaagttttagggtacatgtgcacaacgtgcaggtttgttacatatgtatacatgtgccatgttggtgtgctgcacccattaactcgtcatttagcattaggtatatctcctaatgctatccctcccccgtccccccaccccacaacagtccccggtgtgtgatgttctccttcctgtgtccatgtgttctcatggttcaattcccacctatgagtgagaacatgcagtgtttggttttttgtccttgcgatagtttgctgagaatgatggtttcgagcttcatccatgtccctacaaaggacatgaactcatcatttttgatggctgcatagtattccatggtgtatatgtgccacattttcataaatggtgctgggaaaactgactagccatatgttgaaagctgaaactggatcccttccttacaccttatactaaaattaattcaagatggattaaatacttaaatttagatctaaaaccataaaatccctagaagaaaacctaggcactaccattcaggacataggcatgggcaaggacttcatgtctagagcaacgatctttaaacagagagcagctgttaggaagtcaagcctgcgaaccttcctgtcacctctctctcatctgttaaatgaatctgtctgccataacctgctaaaaccatgggcactgtggctcagtaacggcagaagtgcttaaatttcagcatacgtgctatttccacactcttcttttgcagcagggcaggagccacacactcaaccactttgggttttttttttttttttcaccaaatggcatttcatgttaattagcttaattccacgtacagtggcttcctgccttccagagtgaggccgattttgctgctgttgagacatcctcacccatacacacacacacacacacacacacacacaccacacacacaaattaattttgtttcaaaaaggggcttcttatgtttctcagaatctgctctctggccagcgatgaagccccgtgctatatactctgagaatgagatacagaaatcagagaaacgcggccgctgcctttgcagaagacgcagatcaaaatctccacggggcgtctgcggaggacagcatgcaaatctcgctgggcaaacggtctgcttcgttgggtgatgcaatacaggaaaatcaacacacagcggcagagctcagagcatttcctacgcgtttttgtgcttagctaggaggattcttgccttgtgatctgaggccgacgccagcaggtcctctatcccctgacgcctgccagctgccagttcactggggctggtgggtcactttgaagtcagtagaacacagagttcgttcagaggcaggtgttatcacagaaacaggggtcactgggtctacaaagatggggaactttgagggtgcgagggttggaagctgagctccactaaacccaaagctggactctcctaatcccaaagctggactctcctaatcccaaagctggactctcctaatcccaaagctggactctcctaaacccaaagctgggctccttaaacccaaagctgggatcccttaagcccaaagctgggatcccttaaacccaaagcttgaagaaaatgtgactacctggccgggcacggtggctcacgcctgtaatcccagcactttgggaggtcgaggcaggtggatcacctgaggtcgggagttcaagaccagcccggctaacatagtgaaatcccatctctgctaaaaacacaaaacttagccaggcgtggtggcaggtgcctgtcagctactctggaggctgaggcaggagaatggcttgaacccgggaggcggaggttgcagggagccgacgttgtgccattgcactccagcctggaccacagagcaagactcagcctcaagaaaaaaaaaaaatgtattgcgtgctgcagagtgacctaaaggtcagagggtgcagggaccgtcttcttgtgaccagcattcaatgagagttccggtacttcatctgttggtatctctagatcttagtcaccctgagacctgtcggccggcatgtctcggcggtattaatttgcaattccctgatgagctacgacatggagtgatttttcgtaggtgaatttgccacctgcaaagcatctttcgtgaggtggcccatgtttaaatggttttttttttttccagtggttgaatcttaagagttttttttggcacattttgcatactggttctttgttttaaaaaaagttcttttattttctttttattttactttaagttctggggtacatgtgcagaacatgcaggtttgttacataggtgtacaggtgccagggtggtttgctgcacccatcaacccgtcatctacattaggtatttgtcctaatgctctccctcctctatcccctcaccccccgacaggccctggtgtgtgacgttcccctccctgtgtccatgtgttctcattgttcaactcccacttatgagtgacaacatgcagtgtttggttttctgttcctctgttagtttctcagaatgatggcttccagcttcatccatgtcccagcttacacaggaggctgagacagaaggatctcttgaggccaggagttcgaggctgcagtgagcggtcattgcactactgcccccagcttggttgacagagaaaggccctgtctcaaaaaaaaaaaaacccgggaagcgcaagctgcagtgagccaaggtcgtgccactgcagtccagctcaggagacagagggaaactctgactcagccaataaaaaaaaaaaagaaagaaaagaaagaaacatgtcaacctctgttgctgtgatgaaaatatgagttgaaacctctcacccttcaggctagttgctgtcacccttgttgatgagggtgtgagaatgagtgttgcccttgtctatcagctgtaagcacatattggtgaaatttattgggtggatatttggtgatattccctgtgtttctatcttctggaaggaatggtagagaatcaatataatttcttccttaaatgttggggaaaattcatcagtaaacccatctgggcctggagccttttgtttgggaaggttattaaattatcgattcaatttctttaagagatataggctcactcagattggctgtttcttcttgtgtgagttgtcagattttatccttttgttcttttcatctaggtgatcaattttatgggcacagaattgtttataatatttctttatgatctttttaatgtccatgggatctgtagtgatgtctcctctttcatttacagtattagtaacttgtgtcctcattctttgttgttgttagcctgactagaagcttattactctcattgattgttatttcaaagaacaagcctatggttttgatttttgtctattgacttgctgttttcaattgcactgatttctgtcctctatggatttcctattttcaaatccactgatttctcctctaatctaatatttatgatttatttctttcttcttccattagatttaatttgctcttctttttctagtttctcgaggtggaaacttaaattattgattttagatcttacttcctttctaatacatgcattccatttaaaatatgcaaacccttcaaatcagcagatcttctcctagaaatcgatcctagaaaatgttctcacaggtatgcataaaaatacttacagaggagtgtgtgtaagcacacaggctgaagcagagttgatccatccaaatcccctcactgtggggcatatggttagagacaccacaagacattcacaaaagtggtgacgggtgtatgtcctactatgcaaaataaaacttacctgtgtatgaaaggaggctccagagcaaacgaactcccagaggttacttctgaagggaagtgggacctggaggggaaagatccaaagacaaacacgaatacagagctctctatttctctttattcttttactcataacaagtgtgtgtgtgtgttctgtaattggaagatctaaaaattaaaccaaagttgaaaactcaatggtgtctggaagttcagaagaggttgcatctgcttctgtggctgaggggacttggaatgtgggaacctggaagtggtggtatcaaccccggttttattaggataagttgcagttcagtggggagggaccaccagaaaggcagacagcagggggcaggaggcttctggtatattccatgatagtctttgcaccatgagcccaccacctagcttctctgttttcccagcccctgctatctatgttcacataaaaagatacctgtaccgggagcagtggctcacacctgcaatcccagcactttgggaggccgaggtgggtggatcataaggtcaggagttcgagaccagcctggccaacatgctggaacccccatctctactaaaaatacaaaaattagccaagcatggtggcaggcgcctgtagtcccagatattcaggaggctgaggcaagagaatcgcttgaacccgggaggcggaggttgcagtgagccgagatcgtgccacttcactccagcctggacaacagagcgagactctgtctcaaaaaaataaataaataaataaaagatacctgtgccacttcagcttcccatattgaaaaccaccaactctcttcctacttcctccctcccaaaaggacctgtctgtcaccctacaacctctctgcaatctcttatctacagtctgccttctgcaatctctctagtttatatgatccctgtttgcaaaagatatgttggtaataatttctgcttccctgctgggcacacacacacacacacacacacatacgcctgccagcaccatttttcattttaaaagcattggtgtccatcatacagagaaatgcttaggattggaaacaggagataccaatggaaggttccacatgagtcaagaacttctctttgttattgcttctggccacagctctgacgtctgaccccaccccagctcaggggcccaagagatgctttagctcatgttccatctgtcttcctgaagaccaggtctcctcctctgtgatggggtgggaggtccgtgacggcaaggcaatgaggggcacgtgcaggcattttaaggaatcgctcttcatccacagctggtcactaaccatgatgagaccactgtccctttccacgacaccagcttcttgctaggaacatctgcctggggtcttttctctccccgaaagcctcttgcagacattctttggaaagtactcctgagctctgtgtgtttgttgaaggctgctcttgtcacacagttgcttgagggcaggtttctcagccttagcactgctgacatttcagcccagatgatcctctgtggtggggccatcctgtgtactgtagggtgttgagcagtgtccctgggatctacccaccagatgccagacgcatcttcccaattatgatacctgaatcattcacatttgcaaactattgaatggataaataattgatgcatagataaataattgatagattgatgaacacgtatatgtgattgttagataactgattcacagatgatagatgtaattaatagataactgattggtaggtaattgatatgaatagatgaaagatccatagaaagatgattgattcataattgatagatatgattgctagatagataagtaattgatagagagaaaattgataggtagatagatgatcgattgatagataattgatatagatagatgatagatcaagggttgcaagacgattgatatagatagatgatagatgatagatggatgacaggggttagatcaacaaatggattcatggatagacagatggtgaatttcttcttcttcttcttctttttttttttttgagatgcagtcttgctctgtcgcccaggctggggtgcaatggcacaatctcagctcactgcaacctccgcctcccaggtccaagtgcttctcctgcctcagcctcccaagtagctgggattagaggcacccgccaccacacctggctagtttttgtattttgagtagagacggggcttcaccgtgttggccaagctggtctcaaactcctgacctcaggtgatccacccacctcggcctcccaaagtgctgagattacaggtgtgagccactgctccaggctgacggtgaagttcttatgctcatgccaggttgtcaacctcagcactgtagatatttgaggctggatgcttctctgtggtggggaccctcctgtgcatggtagggtgttgagcaccatccctgggctccacccaccagatcccagtagcatccttccttaagttgtggcaaccagggatgtttcctacatttccaactattcttgagggtaggggaagccttctaggtgacccttgttcttctagacctggcatcagccacccttggctacctctcaaacatctatatgacccattatatttcttttttttttttctttttgaggcagagtctcactttgtcacccaggctggagtgcagtggtgccatctaggcttactgcaagctctgcctccggggttcatgccattctcctgcctcagcctcccgagtagctgggactacaggcacccgccaccacgcccggctaattttttttttcttttttgtatttttagtagagaaggggtttcaccgtgttagccaggatggtctccatctcctgacctcatgatctgcccacctcagcctcccaaagtgctgggattacagacatgagccaccgtgcccagccgacccattatatttctaaatcgatatcaaggactcttgctcaaacaggtctgggtgcactaacagtgaccctgagaccacattgtaaaatcctgaacaacttggtcataggaggtgtcccaaagctggattcttcctgtgacccttgtaggtcagcaccaggtgtatacctgtacctcctccctcctggagctggaaggggtctgatgcctgggtcatggagagctctggacagcccctgtgccatagatccacatgtcaaaggtcaagaagatgtcttggcccctgcagggagatgcttgagcagggagctctgagccttgcttccttccctaccctagtggttcaatgcaaccatggcaggtgaggagagggtcctatgcagccattcctcctgggctttggcaaatcacatcataatctatatgctccactctgctagtgttggacatttctcaacagtaagtcaaccaaagaaagggggactgcatgaatacatgttgttgttgttattgctttgcagtgccgtctttatatcttcaagtcttgagatccttgtcttccattgagtttctgaggcccattggcttgttcctcatttctttctcttatcctataatcttgtgcttttcatgctttatctttcttttaaggttcttcctctcttttatttggtatgatgacgctttctctaatttctttgaagtctgttggttaaaacttttcctctcttttctcggtgtattggtttgcgacagctgccataactaattaccactgatgtggtggcttaaataacagcaatgcattctctccccatcctggagaccagaagtctgagatgaaggtattggcagggttggttcctcattagggctctgagggaaaatctgttccaagctttgctgcagcttctggtgattttctggaaacaatcggcatttcatggtggatagaagcatccatccatgcatcatctattcatccatccacccatctacccacccacccatctacccactcatccatccatccacccatccatccacctacccatccacccactcatccatccatccacccatccatacatctgcccatccatctacccatcaacccatccattcatccacccataaatccagccacctaaacactgatccatccatccacccacccacccacccacttatccatccctccacacaggcatacacctattcatctatccatccacccgtctatccatctacccatccatctacccatcctcatccattcctcatacatccattcacccatcctcccactcatccatctgtccacccatccatccacccacacgtccaaccacctaaacactgattcatccatccacccacccacttatccatccatccatccatccatccatccacacacccatacacctattcatctatccagccacccatctacacacccatacacctattcatctatccagccacccatctatccatccacccatccatctacccatcctcatccattcatcatacatccattcacccatccatctacccatcctcatccattcatcatacatccattcacccatcctcccactcatccatctgtccacccatccatccacccacacgtccaaccacctaaacactgatccatccatccacccacccacttatccatccatccatccatccatccatccatccatccatccatccatccatccacacacccatacacctattcatctatccagccacccatctatccatctacccatccatctacccatcctcatccattcatcatacatccattcacccatcctcccactcatccatctatccacccatccatccactcacacgtccatccacctaaacactgatccatccatccacccacccacttatccatccatccatccatccatccatccacacacccatacacctattcatctatccagccacccatctatccatccacccatccatctacccatcctcatccattcatcctccatccactcacccatcctcccactcatccatctattcaccctcccatccacccacccatccacctactcatctattcatccacccatccatacacccacccatccatctacccatcaacccatccattcatccacccacacatccacctatctaaacactgatccatacatccacccattcacccacctacccacccattcacaaacccgcctaccattcatccacccatccaccctcccatccacccacccatccatccactcatccatgcatccgtccatccacccactcatccatctatccacccatccatccacccacccatccacctactcatctatacatccaccaatccatctacccatcaaccatcaatgcatccacccacatatccacctatctaaacactgatccatccatccacccatccacccacccacccactcacccattcacaaacccacccaccattcatccacccacccatccatctacccatccccatccattcatcatccatccacccacccatccacccagtcatccatctatccacccatacatccacctactcatctatacatccacccatccatctacccatcaatccatccattcatccacccacacatccacctatctaaacactgatccatcaatccacccattcacccacctacccacccattcacaaacccacctaccattcatccacccacccacccatccatccacccatccatgcatccatccattcacccagtcatccacctactcatccatacatccacccatccatctacccatcaactcatccattcatccacccacacatccatctatctaaacactgatccatccacccacccatccacccacccacccactcacccattcagaaacccatccaccattcatccacccatgcatccatctacccatccccatccattcatcatccatccaaccccccatccacccactcatccatctattcacccatccgtccacgcacccatctacctactcatctatccatctacctactcatctatccatccacccacccatccatccacccatccatctacctactcatctatccatccacccacccatccatccacccatccatctacccatcaacccatcaattcatccacccacacttccagttatctaaacactaatccatccatccacccatccacccacccactcacccattcacaaacccacctaccattcatccacccatccaccctcccacccacccccatccatccacccacccatccgcccacccatgcactcatccactcacccgcccatccatctacccatccacatccattcatcatccatccaccaacccatccacccactcatccatctagccactcatccatccacccacccatccacctactcatctatacatccacccatccatctacccatcaacccatcaattcatccacccacacatctatccacctaaacactgatctatccatccacacatccacccacccacccaccattcatccacacatccaccctcccacccatccacccatccatgcattcatccatacatcctcccatccatctacccatcaacccatccattcatccacccacacatcctatctaaacactgatccagccatccacccactcacccacctacccacccattcacaaacccacctaccattcatccgcacacccaccctcccacccacccacccatccacccatccatccacccacccatctgcccacccatgcactcatccactcacccacccatccatccatccacccacccatgtacccattcatccacccatctatgcatctacccatccatccacccacccatccatccatttattcatccatctacccatccatccactctcgtctctgtcttcatctttccatgccttctctctgtgtctgtgcctaaatttctctttctcctaaggacgccagtgaattttattagggcctctccctactctattatgaccacattttgacttcactaatgacatagacgcagaccctatttctaagtaagaaatggccataataccgagagtatcagccagggtgtggcccacgacaacttccttctacgtaatcaaagtaggtaattgaagccagcgtctgttttgtcttccaaatccacagctccaacagagtgccatttgctgtctttggggttgagggcctcctgaggcagccctatcaaaagaaccacaaactgggtggtgcaaacacccccagaaaacagaaaggagagcagacgacaagcacggggctggcttgtggttccttagggctggggcctctcactcccctgtgtgttcaacagctgggacagcccccagcactcaggaaagaggggtggttatagccagaagacaatagctggcaaaaaagggtctgtcaccggcatgcaatccctgctgcccacgaggagatgccttttgtctatttctcatcccaaccctgtaaggtccacccggaacaagactgtagtgatcactgcactcagcatctgaaccctttagaaaggggttcccagggctgggaatgagggaagagcagctttatgcacaatagccaagaatcaggaacacgccaggcgcggtggctcacacctgtcatcccagcactttgggaggccgaggcgggcagatcatgggaggtcaggagtttgagaccagcctggccaacatgatgaaagcttgtcgctactaaaattattaaaaaaaaaaaatgggctgggtgtgatggctcgtgcctgtaatcccagcactttgggaggccgaggagggtggatcatacatcagaggtcaggagtttgagaccagcctggccaacatgatgaaaccccgtcgttactaaaattacaaaaaaaaaaaaaaaaaaaaaatgggctgggcgcggtggctcacgtctgtagtcccagcactttgggagactgaggagggtggatcacctgaggtcagcagttcacaaccagcctggccaacatggtgaaaccctgtctctactaaaaatacaaaaattagctgggtgcggtgatgcatgcctgtagtcccagctactccagaggctgaggcaggaaaattgcttgaaccggggaagcggaggttgccgagagccgagatcacaccattgcactccagcctgggcaaaaagagcgaaactccctctcaaaaaaaaaattacaaaaaaattagccaggcgtggtggcaggttcctgtagccccagctacttgggaggctgaggcaggagaattgcttgaacccaggaggcggaggttgcactgagccaagatcgcaccactacactccagcctgggcaacagagcaagactccatctcaaaaaaaaaaaaaaaaatcagaaagaacaaaaatgtccatccacaggagaatgaataaacagaatgtggtctatccacacagtagactattatgcacccactgaaaggactcaagctctgacccaggctgcagcgtggatgaactttgaagacccctggctcagtgacagaagctagacacaaaagaccacatattgtagaattttattcttataaaatatctagaataggcagatccacagagacaggaagcagatttgaggttcacaggggctggggacaggaacgaacaggattagcagttgtggggttctgaagggtttttgttttgttttgagatggagttttgcttttgttgcccaggctggagtgcaatggtgtgatctcggctcactgcaacctctgccccctacccaggttcaagcgattctcctgccttagcctctggagtagctgggattacaggcatgtgccacaacacccggttaattttttttgtatttttagtagagacagggtttcaccatgttgggaaggctggtcttgaactcctgacctcaggtgatccacctgcctcggcctcccaaagtgatgggattacagacgtgagtcaccgcgcctggcccatttgtttttgtttgtttgtttgtttaattttagtaacaacaggatttcaccatgttggccaggctggtctcgaactcctgacctcaggtgatccacctgcctcggcctcccaaagtgctggaattacaggtgtgagccatgatgcccggccaggtcctgagttttgtttagggataaaaatggttctggaattgcattatggtgttgtttgcacatctgtgaatatattaaaaaccattgaactgtatgaatgagtgaaagcttatggtacgtaactcacgtcttggtaaagctgtttttttgtttgttggttttgttttgttttgagacagagtctcgctctgttgcccaggctggatggagtacagtggtgcgatctcggctcactgcaagctccgcctcccgggttcaggccattctcctgcctcagcctcccgagtagctgggactcgccaccatgccaccacgcccggctaatttttttgtttttttgtttttttagtagagatggggtttcaccgtgttagccaggatggtcttgatctcctgacctcgtgatctgcccacctcggccttccaaagtgctgggattacaggtgtgagccaccgtgcccggctggcaaagctgttttaagaagaaataagtgagagggctggaggagatacacacagaccctcaagaggagagaaacattgctggatgcattgctgccagacaggtgtgcatttacctgcaaagcataagaaaaagggtccaacctggccaggtgcagtggctcacgactgtcatcccagcactttaggaggccggggctggtggctcacctgaggtcaggaattcaagaccagcctggttaacatggtgaaactctttttggggctacaaaaagtaaaaaatcagccaggcgtggtggtgcatgcatgtaatcccagctactcaggaggctgaggcaggagaatcgcttgaagcagggagacagaggttgcagtgagccgagatcacgccattgcattccagcctggatgacagactgcgaaaagaaaagaggggagaggggagaggaaaggagaggagagagggaaggagaggagagagggaaggagaggagagagggaaggagaggagagagggaaggagaggagagagggaaggggagagggaaggagaggggagagggaaggagaaggaaggggaggggagaggggagagggaaggggaggggagaggggagagggaaggagaggggagaggggagaggggagaggggagaggggagaggggagaggagagagggaaggggaggggagaggggagagggaaggagagggaaggggaggggagaggggagagggaaggggaggggagaggggagagggaaggggaggggtgaggggagagggaaggggaggggtgaggggagagggaaggggaggggagaggggagagggagaggggagaggggagaggggagaggggagagaggagagaggagagaggagaggagggtcccacctacagcccctgagcgcccacctgtggtctgtccgttgcttcagacaattcagtgcccagaaatttctggacagccacctctgcaggccagacaccgccaagaacaaccgttgtgctgattttctaaaatttccatcctgcccgctgagccccggcggggcccaaaccgcaagcctgtgcctcctgtgtcagggcagctggcatcagttagaggtaatttcttgattagtcatgcgcgttcctcagcagtcctggctgtctgtcttccccgggggctgtccggtggccacagggcacagactcgaaatggcaacagatctggctgccaagaggctgcttgctggatccccagaccacacaggtacagacacgagggtggccgggtgaggccgccaccgtaggactttcaacagcacgtggtgtttaaatgtgtgcgaggcactgctgcctacgtggagagttaaagcaacaaattccagcccaggtgtgttgctcacacctgtaatcccaatgctttgggaggccgaggcaggaggattgcttgaggccaggagtttgagaccagcctgggcaacatagccaaaccccatgtctacagaaaataaaaatattagctgggcagggtggcatgcacctgcagtcccaggtactcaggaggattgcttgaggccaggagtttgagaccagcctgggaaatgtagcaaaactgtgtatctataaaaaataaaaatgttagctgggcacggaggtactgtcacctgtagtcccagctactcaggaggctgaggcaggaggattgcttgaggccaggagtttgagaccagcctgggaaacatagcaaaactctgtatctacaaaaaataaaaatattagctgggcgtggttgtactctcacctgtagtcccaactactcaggaggctgaggcaggaggattgcttgaggccaggcgttggaggctgcagtgagttacgtttgcactactgccctccagcctgggcaacaaggcaagaccccatatctataaaacaaacaaacaaaagaacaattccagggcacccctgtttccagctctgtccactttacattctcaaaataaaagtagtgtccctttgacagacactttttcatcaccagctcatggataaagcgtctctccttccagacgtcccccacggccacaccaagcggaacccaaagaaggaagggtctgcttttcctcctgaagccataggtggctggaggtgcccagctggccgtggggagcggtgctgactcgtgcataactgtaggtttcacacctgggcacggaccggcgggtcagaaaacttctccctgaaactgaaacgaaaactccgggccattttaaagccagcttgaggaagctgtttgtagagcagttggtaagaagtcgcaggtctcctctggaggaagaaagagcagggaggagccgtgggttgacgcgggtgttaaaagctggaaagactttggaggctgcgggttggtctcctggcactcggagtgtgtgttttctgctgatagacactttgtgggtggatgcccctgagatgagaggactcatacccagactaatactgccagggtgtcaagaattcccattaagaccaccctgggggctgacggtggctttgtggtttccgtccacgggggacactgagtcttgaggtttgtatgacaatgcattcaacctgcccaggggagccacagccccactgtggatcatctaagagtctcagcctctgacgtgggccgaggtctccaatgacctccctgatccaaggaaggacgggagggagggagggcgggaaggaaggaaggaaggaaggaaggagggaagaagagaaggaaggagagaggaggaaggaagaagaaaggggagaagacaggaaagaagaaaagaatgacacagggtgaagaaaggaggcagagagggagggaaggaaggaggagagggaaggaggaactaagggagggagggagggaggagacagcaggccctgctaaagcatctcccccgccttggtccccggggagcggcgctcaggagccctcccggcagccgcctctttacctgcgcccctgacccgtacacccttccctccttcccttgcagagcccgggcgaggacccctccaggatgcaggtcccgaacagcaccggcccggacaacgcgacgctgcagatgctgcggaacccggcgatcgcggtggccctgcccgtggtgtactcgctggtggcggcggtcagcatcccgggcaacctcttctctctgtgggtgctgtgccggcgcatggggcccagatccccgtcggtcatcttcatgatcaacctgagcgtcacggacctgatgctggccagcgtgttgcctttccaaatctactaccattgcaaccgccaccactgggtattcggggtgctgctttgcaacgtggtgaccgtggccttttacgcaaacatgtattccagcatcctcaccatgacctgtatcagcgtggagcgcttcctgggggtcctgtacccgctcagctccaagcgctggcgccgccgtcgttacgcggtggccgcgtgtgcagggacctggctgctgctcctgaccgccctgtccccgctggcgcgcaccgatctcacctacccggtgcacgccctgggcatcatcacctgcttcgacgtcctcaagtggacgatgctccccagcgtggccatgtgggccgtgttcctcttcaccatcttcatcctgctgttcctcatcccgttcgtgatcaccgtggcttgttacacggccaccatcctcaagctgttgcgcacggaggaggcgcacggccgggagcagcggaggcgcgcggtgggcctggccgcggtggtcttgctggcctttgtcacctgcttcgcccccaacaacttcgtgctcctggcgcacatcgtgagccgcctgttctacggcaagagctactaccacgtgtacaagctcacgctgtgtctcagctgcctcaacaactgtctggacccgtttgtttattactttgcgtcccgggaattccagctgcgcctgcgggaatatttgggctgccgccgggtgcccagagacaccctggacacgcgccgcgagagcctcttctccgccaggaccacgtccgtgcgctccgaggccggtgcgcaccctgaagggatggagggagccaccaggcccggcctccagaggcaggagagtgtgttctgagtcccgggggcgcagcttggagagccgggggcgcagcttggagatccaggggcgcatggagaggccacggtgccagaggttcagggagaacagctgcgttgctcccaggcactgcagaggcccggtggggaagggtctccaggctttattcctcccaggcactgcagaggcaccggtgaggaagggtctccaggcttcactcagggtagagaaacaagcaaagcccagcagcgcacagggtgcttgttatcctgcagagggtgcctctgcctctctgtgtcaggggacagcttgtgtcaccacgcccggctaatttttgtattttttttagtagagctgggctgtcacccccgagctccttagacactcctcacacctgtccatacccgagggtggatattcaaccagccccaccgcctacccgactcggtttctggatatcctccgtgggcgaactgcgagccccattcccagctcttctccctgctgacatcgtcccttagttgtggttctggccttctccattctcctccaggggttctggtctccgtagcccggtgcacgccgaaatttctgtttatttcactcaggggcactgtggttgctgtggttggaattcttctttcagaggagcgcctggggctcctgcaagtcagctactctccgtgcccacttccccccacacacacaccccaccctgttgctgaccaaggtgatttttggcacatttgttctggcctggcttggtgggaccccacccctattctgcttctgtgagtccctgatagagaaggaggtcccatcaggcccctggaacacactcaggcttccctgactcaggacaaggaccacgggaggcccaggtgcggaaaggaggctccgtgagatggggtccagcccatcccaacacaagggtgcagcttgattcgggagttccccacctcctgcccattctccgcgtccttttaccccatggagagcctcagccatggcaagtccatctggagtccaggaagcaggcaactggcctgacccatgagaccgtttggagaccaagcagcagatgcaggtgtggaccccaggaacctacaggggtgtcagccgctgagccccctccctgctgtgtgggtggtgagcaggctgggtctttgtctgtcttcttctacacggcatgtgcctgcaccagccccaacacctgagctggtttagcgcaaagaagagctctgactctccaggggtgctgggacatcacgtggaattggatcccaggctctcttgggcgagaaagaccattctggaggtgggagtgggagagctgcctgtctgcccacgggctctgcgtctccgcagtgggtggccttggatgcccggcccctccctttctgtgcactggggacgctgatggaggctgaagctgctgttcggaggccctctattggtgcctctctcctgccgtcatcactatggcaggaaaacagagatggtttagtaatgaattatcattcccaaacccgtgtccacctggaacatcaggatgggaccatgtttgaaaatcgggtctttccaaatgtaattaagtaaggcgaggccatactgcatttacaatgggcccaatccagtgtccctatgagagacggaagaggagacacagacacaaagcaggaggccacataaagacagaggcagagactgaagtgatgctgccccaagcccagggatgcctggagtccccaggagctgggagaggcaggaaggaccctcccctagagtctctggagggaactggatacaattgcagagtgcactaaacagttgccccagaaagacatgtcttgttttaaagcccagaacctgaaattattatagattttattcggtaataaggaactttgcatgtgtaattacttaaggatatgaagatgagattgtgctggattattaagcaccctaaatgccatgacaggtgtccttccaagagacagaagaggagacacagacacagagcaggaggacacgtggagacagaggcagactggagtgatgcggccacaagcccagggacacctggagcccccaggagctgggagaggcaggaaggatcctcccctagagcctccagggggaactggaggatgcgtaagagacccagaacttccacagaaggaggaaaattaacctcctgcttctctagactgttccaaagctgaaccctagaaagcaaagctgatacagaagcatccaggctgcaggagtacaggtcgcaagtgctgagcgtgggccttgggtgtgtctcatgggggaaaaaaaactgtgaaaaacctcagagtagcatcttcacagtaacgcacggacgatccctaaactgccttgtaaacaaaaatgagagcttgagtcagaggaagccgagacaatatccttcctcgacaacgtgcgagaaccctgacgtcccccagcaaaggaagacgttgcaagcaggcaaaatgcgtcgattttttttttttgtcagtatgatgatttttgcagccacttggctatggagagcagccgacaccccctcttacagccgtggatgtttcctggaagctgactcagtctgttcactggttgagctttgagtgaaaagataacacaggtctattgactcacacacatgttttaagatggaaaactttacttctgttcttggcaggacatggagagagggagggattccaaaaagtctcagcctccatcaaggcgtggcagctcatgccggtaatctcagcactttgggaggctcaggcgggaggactgattgagtccgggtgttcaagggccaacctaggcaacacagtgagaactcatctctgtaaaaaataaaaataaaacattaaaaaaaaacatgagctttgaagtgcacagggcaa

SEQ ID NO: 4162 - DNA, 27916 bp, human
gagcagcttgctgggtctccggaggctgctggtgtctgtctcaaggtgcggtgcaggcacagccagtgggatttttttcccagcagagcagagagctggccctccactcctgctcctgtgcggagctcactcccatagggcagccgcctctggcccaggaggagggtcccccaggaccccctgcctagcttgacggctgctcagacaagcaccaccagaccagcatcacccaggacgtctgccctccctgcagccaccgttgtaagtcacggggacctgggagtgttcgggtaggagaggctgctctgcagaaataccccagctagcagggcatatccaggccagagacgctgctgaatgccagagaaagccctcagctcagcctccctttggggtgtgtgatttttaacccgggctcaccagagtgctgcaaaaggacacacagcctccaggcaggagctgtgccatttgcacaagctctcgagggtcgcagagagggctgaggttggcctaaaacagacccccttcttgcacatcttcagacgttgccgcaagaaaagagcaaaatcgtcttgtccgttttaacggagattcccagtttgcaagccaattgttcctttgacgaggggtacaggccggcccacgccgagatgctgggttgggtggctctcggatgaagaaagtcccaccttctttaaaatgcgctctcccagaaatcttcttcacacctgtctttggcttttattttgcttttgttttgtggggaggagacgttgttcttggtttttcgctaataaaaatagttcacgtcgactgagtgaggaggaagcagcagccacttttacaagggctttatctctgcgatctttccttccttccctccctccctcctccctccttcctccttcctcctccttccctccctcctccttcctccttcctcctccttcctccttccctccctccctccttcctccttcctccctccccctcccctcccctcccctcccctcccctcccctcccctcccctcctctcctgtcctctcttctcctctcctttctttcctttcttgtctcgcactgttgcccaggctggagtgcagtggcgtgacctctgctcactgcaacctccgcctcccgggttcaagtgattctcctgcctcagcctcccacgtagctgggattacaggcgcccaccccaacgcccggctaattttttgtattttttagtagagatggggtctcactatgttgaccaggctgatctcgaactcccgacctcatgatccacccgcttcggcctcccaaagtgcgcctggcctgatctctgggattttcgaaacttcgtgagacaggtgctgttacaatcatccctgttttaccagtaacggaaactgaggcagacatggaggcgggggtgtgttcaagacctacaaccagaaagaggcagaggtgggcgctgagtgctgctcgttagccttgaaccactgcactggggaattagtgatgaatgatacgtgactgcctttgaaacaaccatgtctcagcccagggcaggtggcctgggctccgtgggccctctctctggaactaggacaattctgtccctcaactgggagcccaacctgcctacccctagtgcttgaggcataactgtcttctatggccagcaatagaaacttgagtcgagctagctgaagtcaaggtggaaattgtcaaattggataattaggatttctatgggggcttcaggcatggctggatccaggagcttacatggttgtcagtttctcctctttctctttctctcttcccacgtttcagccccacctttttctgcctccctcagctgcagggtgtggaatcactggaggaagaccactttctctatagggatggaaagagggtctctggtagcctggggtccccatcttttcagagcagaatcaaatgggaaaagagacaccctctctctcctggcacccacaagttacacctcctgaagggttccgaccagccatgtcagaaacaaatgaccactgcttgagataatttttatgaacagggtgagggtggccccctaactggccaggcttgggccacacccctctcttgggtgattgacaggctttggccacacacccccatcttcagtgattgacaggcttggaccacacccccctatcctcagtgattgaaaggcttggaccacacccctctcctcattgattggcagtcctggagaaccacacagcccagacagggagtgaccccaggggcgaggggtgctgggtgcacagtttccatggatgcagcagagaggtcagggccagtagcaagctggaccaaagtggaccggagggaggcggtggggctaacgtccacactgcccctgccgccttctgtccattccatcactcattcactctgcattctcagagtggcattcattcatgcattcattcatgcattcattcatttactcatttgctccacacattccatcactcattcgctctgcattctcagagtggcattcattcattcattcattcatttactcatttgctccacacattccgtcactcattggctgtgcattctcagagtggcattcattcattcactcatttactcatttgctccacacattccatcactcattcgctctgtattctcagagtggcattcattcattcattcattcatttactcatttgctccacacattccgtcactcattggctgtgcattctcagagtggcattcattcattcactcatttactcatttgctccacacttgtcaggaactagtgggcatcatgcattcactctttcatttattcactccacttttagggagaaaaccctacacgtcattgatttatgtattcacccattcgtttatcaagcaagtcctgtgtgctactcattccttcattccctccacatttgcaggaatgaatctctgtgtgtcattcattaattcccttcacatttgtggggaatccccggatgtcattcattaattccccccacatttgtggggaatatctgggtatcattcattcattctctctacatttgcagaagtgaatctggggtatcattcattcattccccccacatttgcagtgaatatctgggtatcattcattcattctctctacatttgcagaagtgaatctggggtatcattcattcattccctccacatttgtggagaatccctggatgtcattcattcattccccccacatttgcagggaatatctgggtatcattcattcattctctctacatttgcagaagtgaatctggggtatcattcattcattccccccacatttgtggggaatatctgggtatcattcattcattctctctacatttgcagaagtgaatctggggtatcattcattcattcattccccccacatttgcagggaatatctgggtatcattcattcattctctctacatttgcagaagtgaatctggggtatcattcattcattccccccacatttgcagggaatatctgggtatcattcattcattctctctacgtttgcagaagtgaatctggggtatcattcattcattccccccacatttgtggggaatatctgggtatcattcattcattctctctacatttgcagaagtgaatctggggtatcattcattcattccctccacatttgtggagaatccctggatgtcattcattcattccccccacatttgcagggaatatctgggtatcattcattcattctctctacatttgcagaagtgaatccggggtatcattcattcattccctccacatttgtggagaatccctggatgtcattcattcattccccccacatttgcagggaatatctgggtatcattcattcattctctctacatttgcagaactgaatctggggtatcattcattcattccctccacatttgcagggaatatctgggtatcattcattcattctctctacatttgcagaagtgaatctggggtatcattcattcattccctccacatttgtggagaatccctggatgtcattcattcattccccccacatttgtggggaatatctgggtatcattcattcattctctctacatttgcagaagtgaatctggggtatcattcattcattccccccacatttgtggggaatatctgggtatcattcattcattctctctacatttgcagaagtgaatctggggtatcattcattcattccctccacatttgtggagaatccctggatgtcattcattcattccccccacatttgtggggaatatctgggtatcattcattcattctctctacatttgcagaagtgaatctggggtatcattcattcattccccccacatttgtggggaatatctgggtatcattcattctctctacatttgcagaagtgaatctggggtatcattcattcattccctccacatttgtggagaatccctggatgtcattcattcattccccccacatttgcagggaatatctgggtatcattcattcattctctctacatttgcagaagtgaatctggggtatcattcattcattccccccacatttgcggggaatatctgggtatcattcattcattctctctacatttgcagaagtgaatctggggtatcattcattcgttccctccacatttgcagggaagccctggatgtcattcattcgttccctccacatttgcagggaatatctgggtatcattcattcattctctctacatttgcagaagtgaatcctgggtgtcagtcattcattccctccacatttgtgaggaatccttaggtgtcattcattcattcattctctccactgttgcaggagtaaatctctgagtgatattcattctctctacatttacggaagtgaatcctgggtgtcagtcattcattccctccacatttgtgaggaatccttaggtgtcgttcattcattcattctctccactgttgcaggagtaaatctctgagtgatattcattccctctacatttgtagggaatccttaggtgtcagtcattcattccctccacatttgtggggaatctctgggtatcatttattcattctctctacatttgccgaagtgaatcctgggtgtcattcattcattccctccacttttgtggggaagccctgggcatcattcattacttttctctacatttgcagaagagaatcttgggtgtcattcattctttccctgcacatttgtgggaatgaatctctgggtgtcattcattctttccctccacatttgtgggagtgaatcctaggtatcatccattcattccctccacatttgcaggagtgtaccctggatgccattcattcattcattccctccacatttgtgggagtgaaccctgggtatcattcattcattccctccacatttgcataactgaatcctggatgtcattcattcattctctccacatttgtgtggacgctctgagtgttattcatacatgcacccattcattccctccacagtcattgggaatgtcctgtatcacacacacacacacacacacacacacacaccctgcatttaccaagaccatcctgggtgcacagctctaagctaaggacagcagacccaaaggagtttgcagcaggtacctggtggggaggagagggtcttcatggaggcaggagctggcacccatgggctggaatgaaatgcagacttccaagaggctctggcaggtccatggtgggctgatgccccaagaaggagggttgaaggtgtcactcaagactgtgctgggtgcagacaggcataaggagctgcatgggccagaggaatcacaggagctagggcaaggagatatctgtgagttggtcccaccgctgtggggacacagctttctgcagggccaggtagaccactgtaccaaggaaactggcataagcacatcatctgtgcctgacagcgagcaggggaaacaccaccccagcctttgagtagtagtcacttggtagctttgcattcaccccttcccaggagggtggtttagggcagaaccaggcagtgagattcctcagctcgttctgcctctccaggaataactcaggcaggctgaggggctcctgggggctcagctgttagtgatacactggggaccctgttgagacccacttctcttcttcttcttttttttttttagacagagttttgctcttgttggccaggctggagtgcagcggcacgatcttggctcaccgcaacctccacctcccaggttcaagcgattctcatgcctcagcctcccaagttgctgggattacagacgcccaccaccacgcctggctaattttttatagttttagtagagacggggtttcaccgtgttagccaggatggtctcgatctcctgacctcgtgatccacccgcctcggcctcccaaagtgctgggatgacaggcgtgagccaccgcgcctggcccggccttcttttttacccgtattctgacttgtccccaacccctgcaaagagcaggtgcaaatgcacctgcccagcaggccaggactatgctccagcctcagggagcaccaggatgatacacttcaggtctcttctccttggggagctctcagtatgcagtatggtccctgaaatccccttgggagggcagggaggatgagacaggcagccagagacaggtgcagagttcaggctcagaggcgcaggtgtgtttccactcagatgcgtgtatttggagattattgcaaggcagagtgcggcatcttctacatgcccagaaaacctacagtctgggtcccaagcaccacgccccttgtcactcatggcccaggttccttatgccctctgcccctcagtgtccccatatgtaaagcaaagatgataagcgcgtcttcctaggacgggtgcacaaaaaaacgtttgcaaacattcaatgtgacgtctgctctaagaacaggcgatgtcacctgaggactcaagcacacttgaccttctccttccctgtcatctccaggcagctaggaaggaagctctgtgtggccgggaaagacaaggaggaaattgaaacaatgctggacttgagaacttggacgcctttcactgtggctccctgagggacaccgtgaggtcactggttcacacagtggtggccactgcttcccctccactcaggcccagccaagctcaaatcagccatagtgaccacagacagggaaggcttgcgcagccggccccagacaccccggtagggacctgagggatgaggaggccaggctggctacggccccagtgacgactgcatcccccaaaagcggaagctcggccctggggctgccctgtcccggggagaaagggtcagcctggctgtgaccggggctctctgagggacaggaagacccaagcaacaagcgggggagcactgagactgcaggagcattcaggactcagcgcgggcagggagtcagccaggagggtgtaggggaagggccagctcagacgcaggaagtaaaccagaaacctgaggaatgtccttcctgcttcaagagacaattgtttcttgttgagattatgcttgacatgaactcaccgttttaaagcgaataactgggggacatttaggaccttcacagtgctgggcaacagccgcctctgtctatttccaccactttgtcattcctgcaaaaggaaacaccccctttagggggaaagtcactccccgtttccccatccccagtcccagccatggtcatctgctttctctctatatggatcagcatgttctgggcattttattgaaatggagtcctacaccatgtggccttctgtgtctggcttctctccctgagcatgatgtcttcaaggttcatccacagtgtagcctcggtcacagccttcttccttttcatggctgtatactattccactgtgtgcatgggggggccacgttgtgtttatctgtctgtctgttgacggacacttgggctgtttccaccttttggctgttgtgaagagtgctgcagggaacgttcatatgcaagtttttatgggtgcaaccattttttgttgttgttgagacagagtttcactcttttcacccagcctggagtgcaatggcatgatctccgctcactgcaacctccgcctcccgggttcaagcgattctcctgcctcagcctcccaagtggctgggatgacaggtgcctgccaccactcccagataattttgtatttttagtaaagacagggtttcaccatgttggccaggctggtcttgaactcctggcctcaggtgatccacctgtctcagcttcccaaagtgctgggattataggtgtgagccaccacacctagcccctttttatacattttctaatgctaccttcacttaccaaaatgacatgcagaaataatgtattatacatataattatatatacacataaggtgatctataaaatatgttgtatataattttatatatgctatgttcaatatgttacatataatacacaaattatatataacatataaatgatactatacaatatatcgtatataattattaaatatacatacaatataacatgtttaatttataataaaataagttgtaaataaattattatataacaataatatatataaataatatatgtaatattatataataataatttatacattatatcactttatatgattatgtatattatttacatattaaatttacatatccatatagccttaattacaatataaaagagaaacaaaagtaaataaaatgttaataaggtaatatttaatttaatgtgtacacatttacccataatttacagtaaggcatcattaaggggctgggcgcagtggctcacgcctgtaatcctagcattttgggtggccaaggcaagtggattgcctgacctcaggaatttgagaccagcctgggcaacatggtacaatgcccatctttgctaaaattcaaaaatgtagctgggcgtggtggtgcacacctgtagttccagctactcgggaggctgaggcacgagaactgcttgaagcccagaggtgaaggttgccgtgagccgccatgaagccactgcactccagcctggacgaccgagtgagaaaccaccttcaaaagaagaaaaaagacattactaagggctgggtgcagtggctcagacctgtaatctcaacacttttggaggctgaggcaggaggatttcttgagtctaggacttggagaccagcctgagcaacaaactgcaatcctgtctctaaaaaaaaaaaaaaaaaaaaaaaaagacattattacatcattaaggaatcagatgtttgcttaacaaattctccacctgtctttatttgtctccagcttttacctaggaggagaattggtgcatgacatggttaactatttgaggacacaccaggtgatttttggagtcaatttgcaaacacgcaggacttgaatgggacacagaggattctagtttttgctcaggaaggttccccagctgccgcttcttcttcttcttcttcttttttttttttttttttttttttacagggttttgctctgtcacgcaggctggagtgcagtggtgtgatctcagctcactgcaacctccgcctcccgggttccagcaattctcccgtctcagcctcccgagtagctggaatgacaggcacctgccatgacacccggctaattttttttgtatttttagtacagacgaggctttgccttgttgaccaggctggtctcgaacttccgacctcatgatccgcccgcctcagcctcccaaagtgctgggatgactggcgtgagccaccgcgcccggcctgtaatgttaatttcttgtgctgaggggtagcctaggatgggtactgctttgaaatcttttaaaatatccttttctgtgggcctgagaacctcccttaggtcacaaagagaacaaagaaatgagtctctgtctatgatcactgctaccttgggaccctttcacctttcagaggagagagattgaaactggctcacacgtggggaaatacgtatactggaggcttgtcacagctgagggttcccgtcattgggggtttgggtccagggagcaagagaaaaacacactcctttgtgttcaaagatgaaaatctttcctgagtttaggggagcccagctttgggtttaggggaacccagctttttaggtatataagggcccagctttgggtttaggggagtccagctttgggtctaagggagcccagctttgagttgaggggagcccagctttgggtttaggggaacccagctttgggtttaggggatcccagctttgagttttagggaaacccagctttgggtttaagggagctcaggtttgggtttaggagagcccagcttttggtctaaggcagcccagcttcaggtttaaaggaggtcagcattgggtttaggagagcccagctctgtggttaagggagctcagctttgggtttaggggagtccaactttgggttttggggagctcagctctgggtctaagggagcccctctttgggttttaaggaagcctgtttttgagtctaagggagggtagctttgggttttaatggagctcctgtttgggttgtttcttttttttctctctctttagacaaagttttgttcttgttgcccaggctggagtgcagtggcgcaatgttggctcaccgcgacctctgcctcccgggttcaagcaattctcctgcctcagcctcctgagtagctgggattacaggcatgcgcctccatgcctggctaattttgtatttttagtagagatggggtttctccatgttggtcaggctggtctcgaactcccagcctcaggtgatccacccacctcagcctcccaaagtgctgggattacaggcatgagccaccacgcctggctcctgtttgggttttaaggaaaccccgctttggatctaagggagcccagctttgacttcgggcaggaacaaggtagttgagaccgtctcggtttcttctccagggatctttctctttgactgctttgctgagcacatggctggaaacaggatgagcagaatccaccagatcacaattaaagtatcctaaggcaagtccgcgtcaactcacactgagcaacgatctttatttatttatttaaattaaaataattgattttatctttcatttaagttttagggtacatgtgcacaacgtgcaggtttgttacatatgtatacatgtgccatgttggtgtgctgcacccattaactcgtcatttagcattaggtatatctcctaatgctatccctcccccgtccccccaccccacaacagtccccggtgtgtgatgttctccttcctgtgtccatgtgttctcatggttcaattcccacctatgagtgagaacatgcagtgtttggttttttgtccttgcgatagtttgctgagaatgatggtttcgagcttcatccatgtccctacaaaggacatgaactcatcatttttgatggctgcatagtattccatggtgtatatgtgccacattttcataaatggtgctgggaaaactgactagccatatgttgaaagctgaaactggatcccttccttacaccttatactaaaattaattcaagatggattaaatacttaaatttagatctaaaaccataaaatccctagaagaaaacctaggcactaccattcaggacataggcatgggcaaggacttcatgtctagagcaacgatctttaaacagagagcagctgttaggaagtcaagcctgcgaaccttcctgtcacctctctctcatctgttaaatgaatctgtctgccataacctgctaaaaccatgggcactgtggctcagtaacggcagaagtgcttaaatttcagcatacgtgctatttccacactcttcttttgcagcagggcaggagccacacactcaaccactttgggttttttttttttttttcaccaaatggcatttcatgttaattagcttaattccacgtacagtggcttcctgccttccagagtgaggccgattttgctgctgttgagacatcctcacccatacacacacacacacacacacacacacacaccacacacacaaattaattttgtttcaaaaaggggcttcttatgtttctcagaatctgctctctggccagcgatgaagccccgtgctatatactctgagaatgagatacagaaatcagagaaacgcggccgctgcctttgcagaagacgcagatcaaaatctccacggggcgtctgcggaggacagcatgcaaatctcgctgggcaaacggtctgcttcgttgggtgatgcaatacaggaaaatcaacacacagcggcagagctcagagcatttcctacgcgtttttgtgcttagctaggaggattcttgccttgtgatctgaggccgacgccagcaggtcctctatcccctgacgcctgccagctgccagttcactggggctggtgggtcactttgaagtcagtagaacacagagttcgttcagaggcaggtgttatcacagaaacaggggtcactgggtctacaaagatggggaactttgagggtgcgagggttggaagctgagctccactaaacccaaagctggactctcctaatcccaaagctggactctcctaatcccaaagctggactctcctaatcccaaagctggactctcctaaacccaaagctgggctccttaaacccaaagctgggatcccttaagcccaaagctgggatcccttaaacccaaagcttgaagaaaatgtgactacctggccgggcacggtggctcacgcctgtaatcccagcactttgggaggtcgaggcaggtggatcacctgaggtcgggagttcaagaccagcccggctaacatagtgaaatcccatctctgctaaaaacacaaaacttagccaggcgtggtggcaggtgcctgtcagctactctggaggctgaggcaggagaatggcttgaacccgggaggcggaggttgcagggagccgacgttgtgccattgcactccagcctggaccacagagcaagactcagcctcaagaaaaaaaaaaaatgtattgcgtgctgcagagtgacctaaaggtcagagggtgcagggaccgtcttcttgtgaccagcattcaatgagagttccggtacttcatctgttggtatctctagatcttagtcaccctgagacctgtcggccggcatgtctcggcggtattaatttgcaattccctgatgagctacgacatggagtgatttttcgtaggtgaatttgccacctgcaaagcatctttcgtgaggtggcccatgtttaaatggttttttttttttccagtggttgaatcttaagagttttttttggcacattttgcatactggttctttgttttaaaaaaagttcttttattttctttttattttactttaagttctggggtacatgtgcagaacatgcaggtttgttacataggtgtacaggtgccagggtggtttgctgcacccatcaacccgtcatctacattaggtatttgtcctaatgctctccctcctctatcccctcaccccccgacaggccctggtgtgtgacgttcccctccctgtgtccatgtgttctcattgttcaactcccacttatgagtgacaacatgcagtgtttggttttctgttcctctgttagtttctcagaatgatggcttccagcttcatccatgtcccagcttacacaggaggctgagacagaaggatctcttgaggccaggagttcgaggctgcagtgagcggtcattgcactactgcccccagcttggttgacagagaaaggccctgtctcaaaaaaaaaaaaacccgggaagcgcaagctgcagtgagccaaggtcgtgccactgcagtccagctcaggagacagagggaaactctgactcagccaataaaaaaaaaaaagaaagaaaagaaagaaacatgtcaacctctgttgctgtgatgaaaatatgagttgaaacctctcacccttcaggctagttgctgtcacccttgttgatgagggtgtgagaatgagtgttgcccttgtctatcagctgtaagcacatattggtgaaatttattgggtggatatttggtgatattccctgtgtttctatcttctggaaggaatggtagagaatcaatataatttcttccttaaatgttggggaaaattcatcagtaaacccatctgggcctggagccttttgtttgggaaggttattaaattatcgattcaatttctttaagagatataggctcactcagattggctgtttcttcttgtgtgagttgtcagattttatccttttgttcttttcatctaggtgatcaattttatgggcacagaattgtttataatatttctttatgatctttttaatgtccatgggatctgtagtgatgtctcctctttcatttacagtattagtaacttgtgtcctcattctttgttgttgttagcctgactagaagcttattactctcattgattgttatttcaaagaacaagcctatggttttgatttttgtctattgacttgctgttttcaattgcactgatttctgtcctctatggatttcctattttcaaatccactgatttctcctctaatctaatatttatgatttatttctttcttcttccattagatttaatttgctcttctttttctagtttctcgaggtggaaacttaaattattgattttagatcttacttcctttctaatacatgcattccatttaaaatatgcaaacccttcaaatcagcagatcttctcctagaaatcgatcctagaaaatgttctcacaggtatgcataaaaatacttacagaggagtgtgtgtaagcacacaggctgaagcagagttgatccatccaaatcccctcactgtggggcatatggttagagacaccacaagacattcacaaaagtggtgacgggtgtatgtcctactatgcaaaataaaacttacctgtgtatgaaaggaggctccagagcaaacgaactcccagaggttacttctgaagggaagtgggacctggaggggaaagatccaaagacaaacacgaatacagagctctctatttctctttattcttttactcataacaagtgtgtgtgtgtgttctgtaattggaagatctaaaaattaaaccaaagttgaaaactcaatggtgtctggaagttcagaagaggttgcatctgcttctgtggctgaggggacttggaatgtgggaacctggaagtggtggtatcaaccccggttttattaggataagttgcagttcagtggggagggaccaccagaaaggcagacagcagggggcaggaggcttctggtatattccatgatagtctttgcaccatgagcccaccacctagcttctctgttttcccagcccctgctatctatgttcacataaaaagatacctgtaccgggagcagtggctcacacctgcaatcccagcactttgggaggccgaggtgggtggatcataaggtcaggagttcgagaccagcctggccaacatgctggaacccccatctctactaaaaatacaaaaattagccaagcatggtggcaggcgcctgtagtcccagatattcaggaggctgaggcaagagaatcgcttgaacccgggaggcggaggttgcagtgagccgagatcgtgccacttcactccagcctggacaacagagcgagactctgtctcaaaaaaataaataaataaataaaagatacctgtgccacttcagcttcccatattgaaaaccaccaactctcttcctacttcctccctcccaaaaggacctgtctgtcaccctacaacctctctgcaatctcttatctacagtctgccttctgcaatctctctagtttatatgatccctgtttgcaaaagatatgttggtaataatttctgcttccctgctgggcacacacacacacacacacacacatacgcctgccagcaccatttttcattttaaaagcattggtgtccatcatacagagaaatgcttaggattggaaacaggagataccaatggaaggttccacatgagtcaagaacttctctttgttattgcttctggccacagctctgacgtctgaccccaccccagctcaggggcccaagagatgctttagctcatgttccatctgtcttcctgaagaccaggtctcctcctctgtgatggggtgggaggtccgtgacggcaaggcaatgaggggcacgtgcaggcattttaaggaatcgctcttcatccacagctggtcactaaccatgatgagaccactgtccctttccacgacaccagcttcttgctaggaacatctgcctggggtcttttctctccccgaaagcctcttgcagacattctttggaaagtactcctgagctctgtgtgtttgttgaaggctgctcttgtcacacagttgcttgagggcaggtttctcagccttagcactgctgacatttcagcccagatgatcctctgtggtggggccatcctgtgtactgtagggtgttgagcagtgtccctgggatctacccaccagatgccagacgcatcttcccaattatgatacctgaatcattcacatttgcaaactattgaatggataaataattgatgcatagataaataattgatagattgatgaacacgtatatgtgattgttagataactgattcacagatgatagatgtaattaatagataactgattggtaggtaattgatatgaatagatgaaagatccatagaaagatgattgattcataattgatagatatgattgctagatagataagtaattgatagagagaaaattgataggtagatagatgatcgattgatagataattgatatagatagatgatagatcaagggttgcaagacgattgatatagatagatgatagatgatagatggatgacaggggttagatcaacaaatggattcatggatagacagatggtgaatttcttcttcttcttcttctttttttttttttgagatgcagtcttgctctgtcgcccaggctggggtgcaatggcacaatctcagctcactgcaacctccgcctcccaggtccaagtgcttctcctgcctcagcctcccaagtagctgggattagaggcacccgccaccacacctggctagtttttgtattttgagtagagacggggcttcaccgtgttggccaagctggtctcaaactcctgacctcaggtgatccacccacctcggcctcccaaagtgctgagattacaggtgtgagccactgctccaggctgacggtgaagttcttatgctcatgccaggttgtcaacctcagcactgtagatatttgaggctggatgcttctctgtggtggggaccctcctgtgcatggtagggtgttgagcaccatccctgggctccacccaccagatcccagtagcatccttccttaagttgtggcaaccagggatgtttcctacatttccaactattcttgagggtaggggaagccttctaggtgacccttgttcttctagacctggcatcagccacccttggctacctctcaaacatctatatgacccattatatttcttttttttttttctttttgaggcagagtctcactttgtcacccaggctggagtgcagtggtgccatctaggcttactgcaagctctgcctccggggttcatgccattctcctgcctcagcctcccgagtagctgggactacaggcacccgccaccacgcccggctaattttttttttcttttttgtatttttagtagagaaggggtttcaccgtgttagccaggatggtctccatctcctgacctcatgatctgcccacctcagcctcccaaagtgctgggattacagacatgagccaccgtgcccagccgacccattatatttctaaatcgatatcaaggactcttgctcaaacaggtctgggtgcactaacagtgaccctgagaccacattgtaaaatcctgaacaacttggtcataggaggtgtcccaaagctggattcttcctgtgacccttgtaggtcagcaccaggtgtatacctgtacctcctccctcctggagctggaaggggtctgatgcctgggtcatggagagctctggacagcccctgtgccatagatccacatgtcaaaggtcaagaagatgtcttggcccctgcagggagatgcttgagcagggagctctgagccttgcttccttccctaccctagtggttcaatgcaaccatggcaggtgaggagagggtcctatgcagccattcctcctgggctttggcaaatcacatcataatctatatgctccactctgctagtgttggacatttctcaacagtaagtcaaccaaagaaagggggactgcatgaatacatgttgttgttgttattgctttgcagtgccgtctttatatcttcaagtcttgagatccttgtcttccattgagtttctgaggcccattggcttgttcctcatttctttctcttatcctataatcttgtgcttttcatgctttatctttcttttaaggttcttcctctcttttatttggtatgatgacgctttctctaatttctttgaagtctgttggttaaaacttttcctctcttttctcggtgtattggtttgcgacagctgccataactaattaccactgatgtggtggcttaaataacagcaatgcattctctccccatcctggagaccagaagtctgagatgaaggtattggcagggttggttcctcattagggctctgagggaaaatctgttccaagctttgctgcagcttctggtgattttctggaaacaatcggcatttcatggtggatagaagcatccatccatgcatcatctattcatccatccacccatctacccacccacccatctacccactcatccatccatccacccatccatccacctacccatccacccactcatccatccatccacccatccatacatctgcccatccatctacccatcaacccatccattcatccacccataaatccagccacctaaacactgatccatccatccacccacccacccacccacttatccatccctccacacaggcatacacctattcatctatccatccacccgtctatccatctacccatccatctacccatcctcatccattcctcatacatccattcacccatcctcccactcatccatctgtccacccatccatccacccacacgtccaaccacctaaacactgattcatccatccacccacccacttatccatccatccatccatccatccatccacacacccatacacctattcatctatccagccacccatctacacacccatacacctattcatctatccagccacccatctatccatccacccatccatctacccatcctcatccattcatcatacatccattcacccatccatctacccatcctcatccattcatcatacatccattcacccatcctcccactcatccatctgtccacccatccatccacccacacgtccaaccacctaaacactgatccatccatccacccacccacttatccatccatccatccatccatccatccatccatccatccatccatccatccacacacccatacacctattcatctatccagccacccatctatccatctacccatccatctacccatcctcatccattcatcatacatccattcacccatcctcccactcatccatctatccacccatccatccactcacacgtccatccacctaaacactgatccatccatccacccacccacttatccatccatccatccatccatccatccacacacccatacacctattcatctatccagccacccatctatccatccacccatccatctacccatcctcatccattcatcctccatccactcacccatcctcccactcatccatctattcaccctcccatccacccacccatccacctactcatctattcatccacccatccatacacccacccatccatctacccatcaacccatccattcatccacccacacatccacctatctaaacactgatccatacatccacccattcacccacctacccacccattcacaaacccgcctaccattcatccacccatccaccctcccatccacccacccatccatccactcatccatgcatccgtccatccacccactcatccatctatccacccatccatccacccacccatccacctactcatctatacatccaccaatccatctacccatcaaccatcaatgcatccacccacatatccacctatctaaacactgatccatccatccacccatccacccacccacccactcacccattcacaaacccacccaccattcatccacccacccatccatctacccatccccatccattcatcatccatccacccacccatccacccagtcatccatctatccacccatacatccacctactcatctatacatccacccatccatctacccatcaatccatccattcatccacccacacatccacctatctaaacactgatccatcaatccacccattcacccacctacccacccattcacaaacccacctaccattcatccacccacccacccatccatccacccatccatgcatccatccattcacccagtcatccacctactcatccatacatccacccatccatctacccatcaactcatccattcatccacccacacatccatctatctaaacactgatccatccacccacccatccacccacccacccactcacccattcagaaacccatccaccattcatccacccatgcatccatctacccatccccatccattcatcatccatccaaccccccatccacccactcatccatctattcacccatccgtccacgcacccatctacctactcatctatccatctacctactcatctatccatccacccacccatccatccacccatccatctacctactcatctatccatccacccacccatccatccacccatccatctacccatcaacccatcaattcatccacccacacttccagttatctaaacactaatccatccatccacccatccacccacccactcacccattcacaaacccacctaccattcatccacccatccaccctcccacccacccccatccatccacccacccatccgcccacccatgcactcatccactcacccgcccatccatctacccatccacatccattcatcatccatccaccaacccatccacccactcatccatctagccactcatccatccacccacccatccacctactcatctatacatccacccatccatctacccatcaacccatcaattcatccacccacacatctatccacctaaacactgatctatccatccacacatccacccacccacccaccattcatccacacatccaccctcccacccatccacccatccatgcattcatccatacatcctcccatccatctacccatcaacccatccattcatccacccacacatcctatctaaacactgatccagccatccacccactcacccacctacccacccattcacaaacccacctaccattcatccgcacacccaccctcccacccacccacccatccacccatccatccacccacccatctgcccacccatgcactcatccactcacccacccatccatccatccacccacccatgtacccattcatccacccatctatgcatctacccatccatccacccacccatccatccatttattcatccatctacccatccatccactctcgtctctgtcttcatctttccatgccttctctctgtgtctgtgcctaaatttctctttctcctaaggacgccagtgaattttattagggcctctccctactctattatgaccacattttgacttcactaatgacatagacgcagaccctatttctaagtaagaaatggccataataccgagagtatcagccagggtgtggcccacgacaacttccttctacgtaatcaaagtaggtaattgaagccagcgtctgttttgtcttccaaatccacagctccaacagagtgccatttgctgtctttggggttgagggcctcctgaggcagccctatcaaaagaaccacaaactgggtggtgcaaacacccccagaaaacagaaaggagagcagacgacaagcacggggctggcttgtggttccttagggctggggcctctcactcccctgtgtgttcaacagctgggacagcccccagcactcaggaaagaggggtggttatagccagaagacaatagctggcaaaaaagggtctgtcaccggcatgcaatccctgctgcccacgaggagatgccttttgtctatttctcatcccaaccctgtaaggtccacccggaacaagactgtagtgatcactgcactcagcatctgaaccctttagaaaggggttcccagggctgggaatgagggaagagcagctttatgcacaatagccaagaatcaggaacacgccaggcgcggtggctcacacctgtcatcccagcactttgggaggccgaggcgggcagatcatgggaggtcaggagtttgagaccagcctggccaacatgatgaaagcttgtcgctactaaaattattaaaaaaaaaaaatgggctgggtgtgatggctcgtgcctgtaatcccagcactttgggaggccgaggagggtggatcatacatcagaggtcaggagtttgagaccagcctggccaacatgatgaaaccccgtcgttactaaaattacaaaaaaaaaaaaaaaaaaaaaatgggctgggcgcggtggctcacgtctgtagtcccagcactttgggagactgaggagggtggatcacctgaggtcagcagttcacaaccagcctggccaacatggtgaaaccctgtctctactaaaaatacaaaaattagctgggtgcggtgatgcatgcctgtagtcccagctactccagaggctgaggcaggaaaattgcttgaaccggggaagcggaggttgccgagagccgagatcacaccattgcactccagcctgggcaaaaagagcgaaactccctctcaaaaaaaaaattacaaaaaaattagccaggcgtggtggcaggttcctgtagccccagctacttgggaggctgaggcaggagaattgcttgaacccaggaggcggaggttgcactgagccaagatcgcaccactacactccagcctgggcaacagagcaagactccatctcaaaaaaaaaaaaaaaaatcagaaagaacaaaaatgtccatccacaggagaatgaataaacagaatgtggtctatccacacagtagactattatgcacccactgaaaggactcaagctctgacccaggctgcagcgtggatgaactttgaagacccctggctcagtgacagaagctagacacaaaagaccacatattgtagaattttattcttataaaatatctagaataggcagatccacagagacaggaagcagatttgaggttcacaggggctggggacaggaacgaacaggattagcagttgtggggttctgaagggtttttgttttgttttgagatggagttttgcttttgttgcccaggctggagtgcaatggtgtgatctcggctcactgcaacctctgccccctacccaggttcaagcgattctcctgccttagcctctggagtagctgggattacaggcatgtgccacaacacccggttaattttttttgtatttttagtagagacagggtttcaccatgttgggaaggctggtcttgaactcctgacctcaggtgatccacctgcctcggcctcccaaagtgatgggattacagacgtgagtcaccgcgcctggcccatttgtttttgtttgtttgtttgtttaattttagtaacaacaggatttcaccatgttggccaggctggtctcgaactcctgacctcaggtgatccacctgcctcggcctcccaaagtgctggaattacaggtgtgagccatgatgcccggccaggtcctgagttttgtttagggataaaaatggttctggaattgcattatggtgttgtttgcacatctgtgaatatattaaaaaccattgaactgtatgaatgagtgaaagcttatggtacgtaactcacgtcttggtaaagctgtttttttgtttgttggttttgttttgttttgagacagagtctcgctctgttgcccaggctggatggagtacagtggtgcgatctcggctcactgcaagctccgcctcccgggttcaggccattctcctgcctcagcctcccgagtagctgggactcgccaccatgccaccacgcccggctaatttttttgtttttttgtttttttagtagagatggggtttcaccgtgttagccaggatggtcttgatctcctgacctcgtgatctgcccacctcggccttccaaagtgctgggattacaggtgtgagccaccgtgcccggctggcaaagctgttttaagaagaaataagtgagagggctggaggagatacacacagaccctcaagaggagagaaacattgctggatgcattgctgccagacaggtgtgcatttacctgcaaagcataagaaaaagggtccaacctggccaggtgcagtggctcacgactgtcatcccagcactttaggaggccggggctggtggctcacctgaggtcaggaattcaagaccagcctggttaacatggtgaaactctttttggggctacaaaaagtaaaaaatcagccaggcgtggtggtgcatgcatgtaatcccagctactcaggaggctgaggcaggagaatcgcttgaagcagggagacagaggttgcagtgagccgagatcacgccattgcattccagcctggatgacagactgcgaaaagaaaagaggggagaggggagaggaaaggagaggagagagggaaggagaggagagagggaaggagaggagagagggaaggagaggagagagggaaggagaggagagagggaaggggagagggaaggagaggggagagggaaggagaaggaaggggaggggagaggggagagggaaggggaggggagaggggagagggaaggagaggggagaggggagaggggagaggggagaggggagaggggagaggagagagggaaggggaggggagaggggagagggaaggagagggaaggggaggggagaggggagagggaaggggaggggagaggggagagggaaggggaggggtgaggggagagggaaggggaggggtgaggggagagggaaggggaggggagaggggagagggagaggggagaggggagaggggagaggggagagaggagagaggagagaggagaggagggtcccacctacagcccctgagcgcccacctgtggtctgtccgttgcttcagacaattcagtgcccagaaatttctggacagccacctctgcaggccagacaccgccaagaacaaccgttgtgctgattttctaaaatttccatcctgcccgctgagccccggcggggcccaaaccgcaagcctgtgcctcctgtgtcagggcagctggcatcagttagaggtaatttcttgattagtcatgcgcgttcctcagcagtcctggctgtctgtcttccccgggggctgtccggtggccacagggcacagactcgaaatggcaacagatctggctgccaagaggctgcttgctggatccccagaccacacaggtacagacacgagggtggccgggtgaggccgccaccgtaggactttcaacagcacgtggtgtttaaatgtgtgcgaggcactgctgcctacgtggagagttaaagcaacaaattccagcccaggtgtgttgctcacacctgtaatcccaatgctttgggaggccgaggcaggaggattgcttgaggccaggagtttgagaccagcctgggcaacatagccaaaccccatgtctacagaaaataaaaatattagctgggcagggtggcatgcacctgcagtcccaggtactcaggaggattgcttgaggccaggagtttgagaccagcctgggaaatgtagcaaaactgtgtatctataaaaaataaaaatgttagctgggcacggaggtactgtcacctgtagtcccagctactcaggaggctgaggcaggaggattgcttgaggccaggagtttgagaccagcctgggaaacatagcaaaactctgtatctacaaaaaataaaaatattagctgggcgtggttgtactctcacctgtagtcccaactactcaggaggctgaggcaggaggattgcttgaggccaggcgttggaggctgcagtgagttacgtttgcactactgccctccagcctgggcaacaaggcaagaccccatatctataaaacaaacaaacaaaagaacaattccagggcacccctgtttccagctctgtccactttacattctcaaaataaaagtagtgtccctttgacagacactttttcatcaccagctcatggataaagcgtctctccttccagacgtcccccacggccacaccaagcggaacccaaagaaggaagggtctgcttttcctcctgaagccataggtggctggaggtgcccagctggccgtggggagcggtgctgactcgtgcataactgtaggtttcacacctgggcacggaccggcgggtcagaaaacttctccctgaaactgaaacgaaaactccgggccattttaaagccagcttgaggaagctgtttgtagagcagttggtaagaagtcgcaggtctcctctggaggaagaaagagcagggaggagccgtgggttgacgcgggtgttaaaagctggaaagactttggaggctgcgggttggtctcctggcactcggagtgtgtgttttctgctgatagacactttgtgggtggatgcccctgagatgagaggactcatacccagactaatactgccagggtgtcaagaattcccattaagaccaccctgggggctgacggtggctttgtggtttccgtccacgggggacactgagtcttgaggtttgtatgacaatgcattcaacctgcccaggggagccacagccccactgtggatcatctaagagtctcagcctctgacgtgggccgaggtctccaatgacctccctgatccaaggaaggacgggagggagggagggcgggaaggaaggaaggaaggaaggaaggagggaagaagagaaggaaggagagaggaggaaggaagaagaaaggggagaagacaggaaagaagaaaagaatgacacagggtgaagaaaggaggcagagagggagggaaggaaggaggagagggaaggaggaactaagggagggagggagggaggagacagcaggccctgctaaagcatctcccccgccttggtccccggggagcggcgctcaggagccctcccggcagccgcctctttacctgcgcccctgacccgtacacccttccctccttcccttgcagagcccgggcgaggacccctccaggatgcaggtcccgaacagcaccggcccggacaacgcgacgctgcagatgctgcggaacccggcgatcgcggtggccctgcccgtggtgtactcgctggtggcggcggtcagcatcccgggca

SEQ ID NO: 4163 - DNA, 27863 bp, human; identical to SEQ ID NO: 2882

SEQ ID NO: 4164 - DNA, 27906 bp, human; identical to SEQ ID NO: 2883

SEQ ID NO: 4165 - DNA, 28080 bp, human; identical to SEQ ID NO: 2884

SEQ ID NO: 4166 - DNA, 27863 bp, human; identical to SEQ ID NO: 2882

SEQ ID NO: 4167 - DNA, 27906 bp, human; identical to SEQ ID NO: 2883

SEQ ID NO: 4168 - DNA, 28080 bp, human; identical to SEQ ID NO: 2884

SEQ ID NO: 4169 - DNA, 8717 bp, human; identical to SEQ ID NO: 2888

SEQ ID NO: 4170 - DNA, 281462 bp, human; identical to SEQ ID NO: 2891

SEQ ID NO: 4171 - DNA, 889 bp, human
tggcccgcggggctgcgctggcgctgctgctcttcggcctgctgggtgttctggtcgccgccccgggtgagcgagcggagggatccgggttgggggacgcggagggcgcgggccgggactggggatccgcttgagatgcggcgttgggggcgccccgcggggacacccggagcctcctccctgcccggcaggacgcgctgtgcccacgggggcccaggcccggaggaggcgcccactttctccccaacgcttttcctggagccgttccagagagaaaagtcagcgtttgttgtcggagttgcaaactcttacatgtggggcggccttgggagaggtgcgtccgatttttcccaatctaggggaccttcttacagatctctctccctttgcatgagcccctcaccccaccccgttatctacccccagggtttggggacctgcgtcttcaggccgcgcgcggaggccgccctggagttgcctgtcacagccacgccctgcgtcccgggcctaaatttggaatcgctaggagcctgagacccgggtggtggggggaagggaaggaaaagttagaaaaaaactttgagccctgaaaatgttcaaaaatactctgtggatgcgggctccgggaatttcagcgcgtgctgtgcgccaagcaacacggggcgcagaaagaaacgtgtgcttaccaaattgtccatctgcggcggtggagaattcggaaaacagaaaaagtgggcagggaagaaagagccacggtcaccctcccacgccctaaaccgggcctatttctaattattactttaatcatgtttttctgtttccctccctttgaaacggaaacggagaccctgccggatgtggtatgttataaattcttttttcatgttat

SEQ ID NO: 4172 - DNA, 49825 bp, human
cccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccgggtgagcgagcggagggatccgggttgggggacgcggagggcgcgggccgggactggggatccgcttgagatgcggcgttgggggcgccccgcggggacacccggagcctcctccctgcccggcaggacgcgctgtgcccacgggggcccaggcccggaggaggcgcccactttctccccaacgcttttcctggagccgttccagagagaaaagtcagcgtttgttgtcggagttgcaaactcttacatgtggggcggccttgggagaggtgcgtccgatttttcccaatctaggggaccttcttacagatctctctccctttgcatgagcccctcaccccaccccgttatctacccccagggtttggggacctgcgtcttcaggccgcgcgcggaggccgccctggagttgcctgtcacagccacgccctgcgtcccgggcctaaatttggaatcgctaggagcctgagacccgggtggtggggggaagggaaggaaaagttagaaaaaaactttgagccctgaaaatgttcaaaaatactctgtggatgcgggctccgggaatttcagcgcgtgctgtgcgccaagcaacacggggcgcagaaagaaacgtgtgcttaccaaattgtccatctgcggcggtggagaattcggaaaacagaaaaagtgggcagggaagaaagagccacggtcaccctcccacgccctaaaccgggcctatttctaattattactttaatcatgtttttctgtttccctccctttgaaacggaaacggagaccctgccggatgtggtatgttataaattcttttttcatgttataaattcttttttcaatggtcagtgcattttttgctcttcgtatgggcaggcttttaagtagaccggcttgcgggcagtgtggacttcaggacgggccttatcagggctggacgtatttaggaaggagacgcgggaacgcccggccctggggaggacggaggaggcccgatttgtgttgataggatctagctcagcctagagctgcggtgactaggccgggtctctatttttagggaggagttgctaatggatttacaccctctttaaaggggtcccgggtatcctagaaattgtgctttcacttggtagagattagagataatgaagcctgctccgtagaggaaaacttggaggactttccagcctgcaggggaggttccaagcagagcttcctgtttctcccttttcttcctaaatgtccttcttgcgggcaacctgtcaccacggacgggatggctctgtagggttttatcagctgcatttgttccccaggcacctgcagatgaacgggtttttcacttgtctctctgcgaatgcattccttcatccttcatgcctgccttccttcttttgcacctactgtgggcttggggtcagggaaatatatccaagggagtgctggtggcctaagaattcagtttcctggagaacagaggcatctgaacaggcagacgggagacagggccacagggacctttatagttccatcacgaaataactcaggggttcccagtggtaaatcttggtgaggggcttggctggattttgaagccctagggacagatttgccggctggtctggcgttccaggtcattggagcagagtgagtggaaagccttatattctctaagccccaaacaagtcgttgcacagtttttttgtttttgttggtggtggtggttttttttttttggacggagtttcactctgtcaccagtctggagtgtagtggcacgatgtcggctcattggcgttgcacagtttttaaacccacagcagtgttcatctggaactcctgattttggaagcagactgggcttaggaactccagctgctgatgctttgagtaaagggaagagtacctgtctatggggtgggtgggtagggaagagcagtgggataggggcataacaggggccaacctatccttccaattgcagaggagggcctggccgtcagcactgatggatctccttgagggacgcttctcaccccttctttgcagtctgaccctgctagagatggagacagaaacagcctgtcccaataatattaatacacgtttcatcgggaaagttgacttttgagttggtgatgctcagaacacactttcttatagcaacgtgcatcaggctgcaaaaccccgttgagcctgaagtaggttctcagactggtgctgatagctctggcctgatctcagagtgttggggaccctgtgttccttggttccttcataaattctcaggggtacaggtgggatgtggtgagggatggatggacagagggaggtgtatagaggaaaagaggaggcttcagctttgtagagagcaggatgtccccacagggcgacgttggccccgaggagacactttgtgatggttgcagacatttttggttgccaccctggggtgggacatcccaccatcctgcaatgggtggggcagcttagggaagctgctcagaatctttcaagggccaggacggcctccagcacaaagaattcatctggtcccaaatgccagtggtgttgagggtggaaaaccctgaggagggcttgggagttgcatgtatgcgctgattcagggctgcccctgcagttaggagcctgccgtcccgacagtagagtcgcacacatccgatgcatccctgctctctggcaaaggctgatttgccccaccccccggggcaacggcacagcggcctgtgcggtttgaaaaactccaaacatctacggaaccgacatctcttgaacaataccaggcctcttcaggattccctcgccccagtagagcaagtgtgggcttcgttgtttttttttttttttaactctctccagagctcttgtctcctgcccctgtgggtgtgtgtggaagttattaggagaatgtttctgggcagaggaagtgggttttatcatccagcgagtttgccttgattttccatcagcgcgtttggctctggtaaaagttgattgctttgcatttaactccctactttaggccgagcacggtgactcaggcctgtaaatcccagcactttgagaggccgagggccggtgggtcacatgaggccaagagttcgagaccagcctggccaacatggcaaaaccccgactctactaaaaatacaaaaattagccgggcgtggtggtgagcgcctataatcccagctactcaggaggctgaggcaggaaaatcacttcagcccgggaagcagaggttgcagtgagctgagatcgtgtcaccgcattatggcctgggtaacagagagagactcagtctcaaagaaaaaaaaaaacttcctgctttagctctttctcctttctctgtgtatgagacagagttttcatgtaaagacaaatacatgtctttacactttggagatactcaagtaaatgattgtttgtctggaaatcatttttcttcctgaaggtcctatggtgggtacatgctgtcatttagaaagaaatgcagctcatacaatacttttcccaattcagcatttaggaatcatggcgggatttcatggatactgtctggaatgttttcggactcagatatcttcccccggggaaatagacttctcagtagccacgtggaccttgtgctggttttcagtcctgctgaaaatgttctgagcactcttgttactttaggggaaaagaattacgtgtcctttgtgatttatagacacagtaagaaataagacctgtgtgtctctcggggtgcgaaggaggaaaagtcttttttttttgagatggaattttcctctgttgtccaggctggagtgaagtggcacgatctcagctcatggcaatctctccatctcaggttcaagcagttctcctgcctcagcctcccaattagctgggactacaggcatgcactgcatatctggctaatttttgtatgtttagtagagaaggggtttcactatgttgaccaggctgaaaaatatttttttgaggtggggtctctgttgcccagactggagtgcaggggtgcaatcagggctcactacagcctccacctcctgggctcaagcaatccttccacctcagcctctgtagtagctgggactacaagcacacaccactgtgcctggccacttttaaatttttttgtagagacagggtcttgctatgttgcccagactgaaaaaaaagtcttttttttttttttgagacagtgtctcactgtgtcacccaggctggagtgcaatggcaggatcttggctcactgcgacctgtgtctcccgggctcaggcaattctcctgcctcagacacctgaatagctgggaatacaggcacatgtcaccacacctggctattttttgtatttttagtagagacggtgtttcaccctgttggacaggctggcctcaaactcctggcctcaagtgatctgcccaccttggcctcccaaagtgctgggattacaggtgtgagccacctgaaaaatcattgtaaaaatcaactgtcctacattcttatttggaagtgactcctctaaccaaagacagggaaaaacaaaccaaactttattaacatgcgtttttcattgatacatgagagatacctagaaatgggtagttttcaaggaagtggcttggattctagctgctctagtaccctcaacaaagaacagtccatttttagagaattggcagagaaagacaaaggactttgagtcttcaggggcagcaacaaaatggcagagaaaggctggttattgaagcttgttcattctgagtcctgtgttccatgtcccaggcccatgtggattttctgctgtcttccgtgcttcacctctgttctcccagttggggaggtggggttcggattgcttgtgaatgtgggctcatcgttgctggtgtagctgcaggctgcaggctgtccagggcttgaggatttgctgatattctttcttttcttttctttttattttgagatgaagtctcgctctttttccccaggctggagtgcgatggtgcgatctcggctcactgcaacctctgcctcccaggttcaagcaattctcctgtctcagcctcctgagtacctgggattacaggtgcccgccaccacacctggctaatttttgtatttttttagtagaggtggagtttcaccatcttggccaggctggtttcgaactcctgacctcaggtgatccgcccgcctcggcctcctaaagtgtattcttttttgatttattcccagtctcttggctgaaacatggtagctcaccagcatttctactcccatttgtccaactgacggtatcttttcacatctctagagaccagaaggacttcctcttcttgaatttcctgttcagtattctttcttggcttggttccttggtgagttttgaggagatggtgcatgggtgtgtttttcggctttgttttagtatgactcagggttgccaccatgccttgtacggtctcctagtcatagtattaaagtttccgcttagcaggaaaccagaaacttcctttcttctcccccagagtcagattcaaaccagtgtttctcaagtgggctgtgaaagtagcttgcagccacccaccttgcaaagaagaaaattcaacagaggagaggagaaaatgcccacagggtacatggaaagccttgctaaagaagccgcatgggcaaagcttttgttccgctccctctgtcccggtgggctgggctgagatataatatatgtttgtcattgtggacggcagctggatgagtctgaaagcggttgcaaacccctttaattcactttgctttctcaactttgaatggtgtcgtgggctggggtgggtcccctgtttttgagaatcacctgaaagagtctgattttctgcatcttttcggggagtaaagctgttgctccaaagcgctgtttaaaagctgataatagtgtatctggttgagctaacagcccttcttgaggaggcagcagactggccagagggttctgcaggcattactcatcagcgacacctgagtttgcccaggtagcctgactcttgtttgtttctgctttgcctgaccctgcaaaattattgtccaaatgcaccctggcaagcattgatccacgaggggatgctgaccagaaggagctttcgtttctgcacgatggactggaacacgatggactggaatgatgacaagaataaacacactgcattgtcttttagggccaatggacttggaggcatagagattttataactactgccagaacccaaatattgccagtcggcctcttctgctgctgttgctagctgtcttcttctgggggaaatgggttgggttctaaatatgaattaacacagggctgtcttcgatgaattcagcacaaaatgttctcagcaattgaacactcggagagaagtgttaggcatttagtgcagactcatagaatagcaggacagggagggatttggatctgggcaagcaggagatggatatgaacatctgtcttttgagaccgtgccgaggtggcaatgaaggtagaggccccctgtgttgaggtctttactcaagaggctgtggtcctttgggactaacatagcatccgatagacagacaagatggacagctacagccacctatgggaagcggtttctactcttaaaccacaagcccctagacactcatcatatcataaacatatcaccgggcagtggcttgcaatctttttttttctttgtttctttttttttttttttttagacttgcccaggccggagtgcagtggcacgattgtagctcactgcagtcttgacctcctgggtgcaggtgaatctctcacctcagccttccaaggagctgggaccacaggcatgtgccaccctcagctaatttttaaaatctttttgtagaatcggagtctgactacattgcccaggctggtcttgaactcctgggctcaagcaaacctctcgcctcagcttcccaaagtgctggggttacaggcgtgagccaccatgctcagcctgcaatcattttttttgagacaggatctcactctgtcgcccaggctgaagtgcagtggtgtgatctcagctcactgcagcctcgaacccccaggctcaggtgacctgcccaccttagccttctgtgtagttgggactatgggcacatgccaccacactcaattaatttttaccttttttgtagatacagagttttgttctgtcgcccaggctggtggacatattttaatcctacagagtccaggctaaaaacacaccagtaactgtgatgcccatccctcctgcattcctgatttctgagtgatggtttcagacacaaacctgcttgaccaccctccagtagctcttgctgacctagatccgaggttctcagctttggccccattgcgggaagcttggaaacgtcactcttgcccagggttacctgggtagtctggtttatagacgtgttaggtgttttaatttttttttttttttgagacaagattttgctctgtcacccaggctggagtgcagtggtacagtcatagctcactgcagcctcaacctcctgggttcaagcagcccacctacctcagcctcgaaagaagctgggaccacaggtgcacctcaccatacccagctaatcttttctttctttttgtttttttcttttctttcctcttcttttcttttcttttgttttctcttctctcttttctttcttcttcttcttttttttagacagagtcttgctgtgttgcccaggctggagtgccttggtgcaatcttggctcactgcaacttccgcctccctggttcaagtgcctctcttgcctcagcctcctgagtagctggaactacaggcacgcaccaccacgcctggctaatttttgtatttttagtagagacgggatttcactatgttggccaggatggtctcgaactcctgacgtcgtgatctgcccacctcggcttcccaaagtgctgggattacaggtgtgagccaccgcgcccagccttttttttttttttttttttaaattacagagtctcactctgtcaccaggctggagtgcagcgatgcaatcttggctcgctgcaacctctgccacccaggttcaagtgattcttctgcctcagcctccctcaggcgtgagctggcacgcccagccaaatttttcattttttgtagagacagggtctccctatgttgcccagtttagtcctgaactcctgagttcaagccatccacctgccttggcctggcaaagtcttgggtttataggcgggagccactgcatcccgctattaggaatttttaaaaagcccctcggagggtcttcatgtgtggctgagttgtcaagaatcattgttattttactagatattctgtttcttccctcctacatgagatttcccatgaccgcctctcggatgtgaatgtctatgccatggattacatttttcaaagagcattcagtttgttatttcatcttcagcgagcccttaagatatttctcatgggccttttgtagataaagacactggggtcagagagttcaggagcttgctggtgatcacatggtcagcatggggaaaaatgcatgtggacatgagttctgttggtggtgagacgtgggcacaggggttgctgggcttgggagttggtggctgcgtgtgtgggctgaacagagctccccaggcacggccttgtggaccttgagggatgcctgccttcaccactagtgtgacttgaaggggaggagaatgtcctgaatcagtgatgggcattttgatatggaagagaactcccttgaatcctggtggtgaacttagaccagtcactgaggcctctccagctcctcagggtctccgtgttctaggtatccatgtgtccttccatccatttatccatccatttatgcatccatgcatccatccagccatgcatcctccttttatccatccatccatcaacccatcctcccattcatttacccatccatccgttcgtccatccatccatccatcaacccatcctcccattcatttacccatccatccattcatccatgcatccatccatccatgcgtgcatccatccatccatttatccatccatccatccatccatccgtcgtcccattcctttatccatccgttaatgcacctgtccatccatccatccattctccattcatctttccatccatgcatcatccatgcatccatccttttagttcatccagccactcatcaattgatacatccatctgtccaccatccactcatctatccatccattcacccatcctttcatcaatttacccatctaccatccatccatttatccgttcacccattcatctatccatctgtccatccatccacctatctgttcatccatccatccattcatctatccatccatccacctactcacccacccacccatccatccacccacccaaccatccatccacccaaccatccatccatacctccatccgtctacccacccactcatccacttaactacccatccatccacttatccatgcattcatccatccatccacctacctactcacccacctaaactcatctatccactcaaccatccatccacctatccacccttacctccatccatccccttactgcccatctttccactcatcccatccaactacccatccatccacccagctgtccacccaaccatccacccactcactaatttatccactcacccacgcatgcatccatccatccatccatccacccacccatttacccacccacccatccatccacttacctgcctgtccatccaccctcccagtccatggctctttcatgtattccttcagccagcataggttgaagttaaatgtactattggtgctatttgctgtggtccctgttttttgttctctgctttggaggtaacaaccagggcatcaatttgggcataaaagcaccattgtggatggaaggcctggatgtctggaggcacagagcagggactacacttgttcagggggtcagagagagttctcccaggaggggccctccctggacactgagcttccaagaatgagcagaggaaaccaggtgtaaggaagaggaagggcctcttctcagcctggtagacaagcagtaagagtgatgatggggcagctgcagttcatctcagactagaggagctgcaggggccagatggtgggcaacctctgttgccactgctgaggagtgcagatttaagctcccctgaagggtttgacgcagacagctgtgcggggacgcttaacctgcctaaggcccgtctttgggtaacagcatgcagaacaggtgggaggggctggggctatttttggcagagcgtggataagtcagtggagatagaagagaaggcacaagctattttaggagatattgaggaagttaaaatctgtaacaggtccctgcctgcagagttgaccacacgtttgcatcacatgggtaggctttaaaatatagatgcctgcatctcaccttggaaagtttctgatttaattagcctgggcatcaggacttaggaaaaccccacagatgtgtgtaatttgctgctggagttgagaactggggtgcggagctgtgctccttaaactgtaatgtgcttacagatcacctctggtaatacttgtgagaaagcgcttcaggtgggctagggagaggatcacggagggcttcctggagaaggtgacattctcccagggccttgaggggtgaatagacattttccaggttcagaaagaaggaatgggctttcatggccaggtagaggatccaatgaggcagacgaggggcccaaattctgtgaccccctacccctaccccacccccaggatgcccctgtatcagtcccatggtgtaacaaccaaattcacaagatgctgcagaggggaagagattttaaattttctgagaaagacaatgatatattttggacaccatgagaaatactgttattaacttgttttaacctaggtacacgcaatcttcatcattcagtgattctgtatttgtgacttgcctgcttactaaaatgtatttgtcatccccacatcaatattcctggcatttaatttttttattttaaactttcattttaggttcggggatacatgtgaaagtttgtgacttaggtaaacatgtgtcatgaggttttgttgtacagattatttcatcactgtggtattaaacccaggacccaatagttaccctttatgttcttctccttaccctcggctattttgttcatgcacagaacggcaaaaaaattgaactttttttttttattttttttggatggagtctccctctttcgccaaggctggagtgcagtggcgtgatcttggctcactgtaacctccgcctcctgtgttcaagtgattctcctgcctcagcctcccgagtagctgggattacaggcatgggattacagccaccacgcctggctaatttttgtatttttagtagagacggggtttcaccgtgttggccaggctgctctcaaactcctggcctcaagtgattcacccgcctgggcttcccaaaatgctgggattacaggcgtgagccaccacacctggccagaattgagcttctcaatagcacatgttctcagctgaggttcaacaaagccagaccctgccttctcgggccagcgcgtactgtcaacagggttctttgcaaggtctatttggtgtcccgtgttttgtgttttcgtgctttttgtcagtgattttgcgctttcaaatatccccaagtcggtgctgacatgctacctagcgtccctaagtacaggaaagctggcatggtctcacggggaaaatacacatttgatgagcgtcatttaggcacgagttatagtgctgttggcttcgagatcaatgtgagtgactccacaatgtctattcactgcggtgtctttaaacagaaacccacataaaacgcgcttaggtagtgattggttcatgacctctgggaacgtagtcctgtatttacgtgggagcaatagttcactattcgctaattcagtgttcgctgagactttataaaacgtaactgctttgaataacaaagctgtaattaacaaaccgagctgttaagtgtgtgtgtgtgtgtgtgtgtgtgtgtgtgtgtgtgtgtgtgtgttggcctcacatcattttacagagacacacagggctctgtgaactgctaatagttgggaccggcggaggggttatttcaagctagtccaaaactgcagggcagagaccactttgaaaggagatcagcagtcggggagtggctgggatgaagttggaaaaagtgctgaggcccctaagtcagtttccggtgtttccacgttagccttggggggtgatcactcagtttcctgtagggatgggatctgggctggcatctgcctgtggaaggggtgacagggacggagagcagggaaccccgagcagccctgccttgctgttgtctgagcctcagaactcctgaaggcggggtccttcagcatcaccctggagtttgttaaaaatgcaggctcatgagcctcaccccagaccacagaacgaaaatgtctgggggtgagacccaggattccacgtctccccaggtccctcgcagggcgattctgagaactgccggtgtgaggcgtgctcagcccagcccaaacattcacaccattctttggcctcttgtaaaacttggcgtagctcaggggacgttcccagagttatggcacacgaacaaaagaaagtttcccacttcttaccaaacatattgtaaaattacaggaaagagcttgttctttcacgtctatacccttgtgccgtcgtcctagttaggatgaagccgagatgttaccttgtaccttaggccaccgcagacaaggaagtatatgcagtttaaccacctgcatataatctttttcttttttcttttctttctttttttttgagacaaagtctcattctatcacccaggctagtgtgcagtggcacagtctcggctcactgcaacctccatctgccaagttcaagagattcttgtgcctcagcctcccaagtagctggaactacaggtacacgccaccatgcccagctaatttagcagagatggggttttgccttgttggccaggctggtctcgaacccctgacctcagtgatctgcctgcctcaacctcccaaagtgttgggattacaggagtgagccaccatgccctgcctattttttggaggcagggtctctctctgttgcccaggctggagtgccgtggtgcagtgtcagctccctgcaatctcaacctccacaagcgcaggccatcctcccgcctcagcctcccaagtagctgggaccatgggagtgcgtcacaacacctgtctaatttttgcattttttgtagagacggggtttcatcatgttgcccaggctgctgttgaactcctgggctcaagcaatcctcccaccttggcctcccaaagtgttgggattataggcgtgagccactgtacccggccacctatgtataattttcaagctaagaagacagagagacgagtttaactattgctacagacatgaagcccttccctttccatagtttgctagcagagagtgtttccagggcccggcggccactatcacccactgcgttcatagctttccatggggtgaacagattgcgctggactcagcggttaaatctaaagtgtaggatgtttggtgaactcggagttccttgcacttgtctgtgatctggcacattgtgttttctgtactcagatatgcagtcactggcacacatcctgttactgacgggaagctggacccagcactggagtatttctgagactatgacactctggtgtattcctgaaactatttatgacactattaagctcttttctgtaattttacaatatgtttggtaagatctcagcgccagatttttttaaatgatgtgtttatttcttttaattgacaaatacacattgtatgtgtttatgcggttgcacatggtgtcttgatgtatgtatccatggtgagatggatttaaatatgcatgacctcacagactttgcagcacttttttgtgtgtggtgagaacacttattcagaatgggctcctttagtcgttttcaaatattcaagccattgttactaattgcagtcgccatggtgtctctgagctttcctgaagttatttgtcctgtctcatggacgctttgtgccctgtgaccgatcgtctgcccggtgttaaatgacacatcttgaaaaagaggacaatacttccagagcgattcggttttatagcaacagaaaagtaagggtgttttgaccatttgaataaaatagtaaaatgaaatgtatcagctgcctcctgctattcccacacaggaggacttccggtgcttgctccaatgtggaggcattttctcttgcagcattctgagctacaattatctctaggctggggacccttcccgaggccccccaaacctggaatgaaagtttttagggtcagaccatgtgactggttccactcgacctccaaaacgttaaaaagaaaaaaaaaaaaagagccgggcgcggtggctcacgcctgtcatcccagcactttgggaggccgaggcgggcggatcacgagttcaggagatcgagaccatcctggctaccacggtgaaacccagtctctactaaaaatacaaaaaaatcagccgggcgtggtggtgggcacctgtagtcccagctactcgggaggctgaggcagcagaatggtgtgaacccgggaggcatagcttgcagtgagccaaaatcgggccaccgcactccagcctgggtgacacagagacactctgtctcaaaaaaaggaaaaaacaaaaaacaaaaaacgctttgcctttgcttggcatcagaggactcagcagcaagtaaagagcacacacgtgccctctgcaccacctcctcctccttttctacaatgtcctgaaagtttcgtgtttagtgggctttggaaaagggtgtggaaaaccagcaggagcagatgagtactggagtggccagcagcaggtgtgaacaccctggggtgatgctggggctgagtgaattggacatttttcagcagggacacccaggccagtggcgggtcttcatcctcccacccttaatggagatgaacggcattattgagaaagctgcaggcacacacagagcactgcttaaatgatgtccctggctgctgctgttactatgtaatgattgtgttattcttatgaaaatctgaaagttacaggaatcttggaactgcctaattttttttaattaattaattaatttatttcgagacagagtctcactctgtcgcccaggctggagtgcagtggtgcgatctcggctcactgcaacctccacctcccgggttcaagcgattctcctgcctcagcctcccaagtaactgggactacgggcgtgcaccaccacgcctggctcatttttaattttatgtgaaacacctgaatgatgtgatgatggggtttaagataacccaagtgttcgggcgcggcggctcacatctgtaatccctgcactttgggaggccaaggcaggcagatcacttgatgcccggagtttgagaccagcctggccaacatggcgaaactccatctctactaaaaacacaagaattagctggatgtggtggcacatgcccatagtcccagctactggggaagctgaggaaggagaatcacttgaacccaggaggtggaggttgcagtgagttgagatcatgctactgtactctagcctgggcaacagagcaaaactctgcctcaaaagaaaagaaaagaaaagaaaaaaacagcaaaaagagaacccaggtactggctctcctcctgcgtttgccccggttgagtgcattcctgcattagtgcaagccttagtcacgttgcagaggaactcacacaccccatgtggcctcggggacttcactctgggttcgtcctgttttttgagttgcctggctgatgagaaaaagtaaacatggtttgaatcagtagaaagtgtcttgtcagactgactcatgccatctgtcgtccgttccgccttgccctgatgagccattaccctgtcccggaaacatctggagctttgagagggccgggtggaaacagcagtggcagttgggggttctgctgagggtctggtctctttgcaaatttgcagagaggctgaatgccgtaaacgtgcaacacaggcacctgagttctccaccaggctccttctctgagggcatggttgcagctcttgctgggtgggttttgttggtgttttcttcacatttgtagccccggaggtcgttttcaggagcaaaaaggcaagtgggggtgtctgctgtgagcccgcaatttcctgcctaccacctgaaagctcagggaatgtgatgaattgggagatgaatcctaggcaataaagagagcagtggactgagttaggagacgatagcttcatttacagagattcctttactgactgatgatcattgattgggtttgcttccccatgaggcttcaagccaatagcacgtgcatttgcatccatttatatacacctgggggactgccttcctcacacacacctgggggactgcctccctcacacacacctggggaactgcatcccttcacatacatagggaactgtgtccctcacacacctggaagattagcctcagaggtgtctgcagtaccagattccaccagggagtgaacgtctgattatgggtgattcagggtgcccacgtctatatgaaatcgagagcgggtcacctccctttcctccctactctctgtggggtggtgtttggggagctgtcttaagtgttagtcacccgaggagaaaatggtgagggtgggactctgtatctgggagaaaggagaccttggaggcaggggacagactgacagagccttgagcgatggaagctgaggtcgagggcccaaggtcgatgatagaatgcttggggttgtctctcctctggtgtccttgtccttcaggcatcctggagtgacattgaaattgtttcaattaaaaactgtagaaacagcacagagataagaatggaagacaagctccaagtgcggggctgaggcgagttctccaaggactagggctaagggcagagggtgggagaaggggagaagggcgtgaggggcatactgtgtcctttgccacccactctcagacttgttgtcttggacctccgtcggctgagcttggggtccggggagcagtgggtttggacactcagtggtgacgtcagccgtagtcctgaagcagaggggaagttggcaatccaggcttgcctgggggtgacactggtggcgggagggcctgtgccctcccctgtaactgggtttgtgtggggtccatgggggcattggggtcagtggaaggaacatgaagtgagccagagcatcgtcactgtggcctctgagggcaggtggagcaagaaaaggaggaagcttctaagtgacacctggtcccagctcagtggctatgaccagggaagtcatgtggaggaaaaggctggtggactctgagggtgatggaggaggatgggaggggcaagctaggctggggaggtggcaggccatggacacacaccagacagacacacatgtgcatgcacacatacacaggcacatacatgcatgcacactcatgccatgcatatatgcatgcatgcacacgtgtgcacccacacagcaagtcacatgtgcacgtgagcacacatgaaaacacacaagcacatgcacatactcctgcagtgcacatgcacacccatatatgcatgcacacaggtgtgtgctcagatagcaccctcacacatatgcacacaagcacacaggcaaacacgcagacacatgaacaaatgcacatatatattcatgcagtgcacttgtgcacatatacacatgcaaacaggtgtgcattcagcacactcacaatgcacatgaaaacacgtgtgcacacacatgcagtgcaatacatatatgcatgcacatgtgtgcccacaccatacacccacacatacgtgcaggagcacacacgtgcacacacagaaaccacatgaatgcatgagcacgcgtatatgaaatacacatgtacacatgagcacatccacacgcgcacatgcatgaacatagacacacacatgcatgtacatagacacgcacatgcatgtacatagacatgcacacgtatacccaggccctgcattggaaaaaatccaaaatgtggcttggttgcaaagagcacatgaagagctgttgaatgcagaggtgcccagcaagaagcatggacctaaacccgaaggtggttgggggaagcttggggacacctgggtgggcaaatggcccccctgaggcccagggacagatgcaaaaacccagcaagccaggagggtctttgaaaaaaaaaatgtgtaccacatgtgacatttcccatgtgagggaagcatcgagatcatactgtgttttccctgtgccctgcgattttgcagctgacatgccctttctgtggaaatatatagcagtcctcatgctaggattgcgtgttctgtgtcaggcagctgggcatgggagtgcagggtgtggggtggaacctgggaggagagttctagttttaccactgtgttccggccgtggggtgtcctggggaatggaggccacctcctgacactggagtttcctgggttctgctgtgagcgaggagtgggagaagacaagactctggtcttagaaaccttccgagtctcgtacgcccttgactgccgtttctgagtatttcctgaagcttgggaaggatgagtcactttaaggggattgtcctatgttgctttgttttgtttctttagtgacggtgtctatgatcatcttctgtttatgagggtgaaattacagaaataagaagggttacacttaaaataatatctgtactttactttcacgtgtggggtttttttttgtcattgctgctgcttttttttctttaacattctgacagttctgtctgcttattattaagtcttcctacctttctaaagagaatgtctttcttgctaaagaatacattatggactcttggaatctctttgttggggtggagggggtggggacttgccctgacttgctgggaatgcccatagggtttagaagtcacgtctaccgctgaggcactaacaaaggtaagccttcaaggaagcactgtcatttccggggaagagagttttgaggaaattgaaacagttacgaattgatctagcagtccctctactaatgtatctacatatgaagatatgtagagatgactttttttttttttttttttttgagatggagtctccctctgtcacccaggctggagtgcagtggcatgatctctgctcactgcaacctctacttcccggattcaagcgattttcctgcctcagcctcctgagtagctgggattacatgcgcatatcaccacgcctggccaatttttttgtatttatagtagagacggggtttcaccatgttggttgggctggtctcgaactcctgacctcgtgatcctctcaccttggcctcccaaagtgctgagattacaggtgtgagccaccgcacccggccccagagatgacttctaaaccttcagggtattcccagcaagtcagggcaagtctatatatatataatatatatatgtgtatatatatatttgtataaatatataattcgtatatatagtatgtatatatagtatatatagtatgtatgtatatggtgtgtatatatgtagtgtgtgtatacatagtatgtgtatatacagtatgtatgtatatagtatgtgtatatatagtatgtgtgtgtattatatatatatatagtatgtgtatgtgtgtatatatatatatgtttatttgggataaggaaaggaaatcagtatgtcaaagagacactcccctcccatgtttattgcagcaccattcggagtagccaagacatgcagtcaatggaagagcccatcaagggatgaatgcagaaagaaaatgtgctatatcaactctgtacattcactaaaagccattcatttgcacagtgagaataagtgcctttcatgctatgtaaactatgcctcaataaagctattaaatgaacaaagaaaatagggtatattcacaatggaatggtattcagctttaaaaaagaaggaggttggctgggtgcggtggctcatgcctgtcatcctagcactttgggaggctgaggcaggtggatcacctgaggtcaggagttcaagaccagcctggccaacatggtgaaaccccgtctctagtaaaaatacaaaaaattagctgggcatgatgggcgggcgcctatagtcccagctactcaggaggctgaggcaggagaattgcttgaacccaggaggcggaggttgtagtgagccaagatcatcgcactccagcttgggcaacagagtgagactctgtctcaaaaagaaaaaagaaggaagtcctgccatttgcaacaacatggatggaactggaggacatgatgttaagtgcagtaagccgagcacagaaagacaaataccgtctgacccaaacacgcttacgtggaatctaaaaccactgaactcacagaagcagagtggaatggcggtgaccaaggggttgggagtgaggggtgggggaaatggggaaatgatgggtaaagggtacaacatttccatcagataggaagggataagttcaggggtctactgtactcagggtgactgtggttagtaagaatgcgttgcatacttgaaaatgcctaagacagtagctttgaactgtttgcaccacaaataaataggcgaggtaagatgtaaataaagaaaaaaaatacttcaaaaaatacaattacagatttctatggaaacatatgaacatgagtgcatatatatatttatatgtgcgtgtgtctgtacctgccttatggtttattctggatcagtaggatcctcccttgctaccgtctaaagatctgccgcatgctgcaggaggagctgtaattgcatttatgatgtctggcaagtgtcctgttgtggaaacagccatttcagggctctgaggttgtggaaacgactccactctggttgccggcatggggcccacagagctgttccgagcgttttgtctactttctacttattgttgacacacacagaaacacacacgcagccatgagtacacacacacacagacatacaagcagacgtggacacacctacctgtatgtacatactcaaaacacaccttcacactatactcacctacccatacacacacgtgcacacaactacatgtgtgcacacaaacacatgcatacatgcacctatgcatatgcacacgtggaaacacacctgcacactacacacacctacacatacacacacaaacccacaaatgcacacacccacacaggcacaaacacacaaatgcacacacccacacatgcacaaacacacctacacacataaacatattgacacatgcacacatgcacatgaaaaacacatatacacactacatccgcctacacatacacacacaaacccacatatacatgcacctacacacatgcacacataacacctacacacatgcatacagaacccacacatacatgcatccataggcacacagaaacacacctacacactgtgcacacctacatatgcacacacaaacccacatgaacatgcactgacacatatgcacacaaaaaacacactacacacacagaaacccacaaaatacacctccacacttacacaaaacacgcctacacatatgcacatacacaaacccacacatacatgcacctgcctatatgcacccacaacacatacacatatgcacacacagaactcacctacacaccccatacatgcacacaaaacccacaaatacatacatgtgcactgcaaatgcccaaatatacatgcacactcacacacacatacccctgtgacatatgcatgcacgcttcatttatacatgcaggagcatagcctggtcgtttgcacctgttgtggaactggacacacttccggtgttcacagggctcctgcgggttgttcttggacccctcgccacccaccgccaggtgcttcctgacggttgagagatgttgtatgcctttggtgctgaggagtggggacgctggatgttgacgattatcctaactcttcctccagttgaccaaacagtccaagtcgacttttccaaattttcctgaatttggcttttcttcagtgcgccagagatggccagccacgttgaagtagcattgaaattgttgtaattaaagactgtagaaacagggtagcctatcaataattcagcatgccagtttcctcattccgtgggattccatgagatttttttttaatgcataatgcacgtgtctttctgggttgtctagtgtttctactatattttggtttgtaattacaggaaagttgccaataaaaaagggagaattttgttccccatgttgttttcagtacatattcaaaattgttattcatctgtttgaaaggaacgacctgttaagaataatacacaaaatgatcgtgtttttacactattttaatttctactaagcttgaaggtcatcatttatttaaaacctaggctaacatattcttacttttaggcatggaagtgaatatttagaatgagaagagaaatcacgcaccttgtaaatttttttaagttgctgttttaaatatcacaaaaagaaaaatcgcatatcttttttatctctataatattcaaatttatttttatttttcttgtttctaagttgactctttttttctctcttagatggtggtttcgatttatccgatgcccttcctggtgagtatcaacatcattttttaaaatcccgtcaatattttatgttaacatagtatatacaggcatatcccagccatttccagctaggttctagaccaccgcaataacaggagtcatagcaatttttggcttcccagtacatataaatgttatgtttactctcaactgtagtctattaagtatgcaatagcattacctctaaaaacagtatactccaattgaaaataccttattgctaaaaaatgcagatacagagacaggaagtggggcacgtgctgttggaaaaaatgatgccgagagtctggcttgccacagggttgctgcaggccttccgtttgtaaaacacacagtatttgcaaagcaccttaagacaaagtgcagtgaaggaggtccgcctgtatgtgtccacctgccttattataaaaactagactcatagatgacgaggaaaagcaagatgcccttgttaagataaatgaaccaccctggtggaataattcacagtcctgtgatggtcagaggccgagcaaaaacttgccaggtccttggggaggggtctagaggaggtgagcaaatggaggtccccaggagagaggggcatccagtgctggcatcctccctctcgaaatcggcacccgctgtctccatggggccactccttccttcttctgcagctcttcctgtctcccgctcctcacccagagccctcggtgaagggcatgggaaaaggaattgaaggaattccgtcttatcactctatcagcttctgggtcttgtcatccctttgtatttgttttccggggctgccataaaaaggtgccaccaactgggggcttaaaccacagggatttatcatcttccagacctggacaacagaagtctgagatcaaggtgtagacagacccatgctccctctaggggctctaggggagggtccttcctgcctcttgcggcttccgggagctccaggtgtccctggacttgtggccgcatcactccagtctctgcctccttctccgtggggcctcctcctctgtgtctgtgtctccttttctttgtcttacaaggatacttgtcattgggtttagggccactctactccaggattatctaatctcaagatccttctcttaagcacatctgcaaagaccctatttccaaataaagtctcattaccaggttttaggctttaggatgtagatatatcttttgcggggaccactgctcaatccactgcagttatatccagttctttttggtggctctaggggaggatccttcctgcttctcccagcttttgagggcttcacgtgtccctgtgcttgtggctgcatcactgtaggctctgcctttgtgaacgctggtctcttccctgtgtctccatgtatctaaatttccttcctataagggcaccagtcattaggacctatcctaatctattataacctcatcttaactgattacaactgcaaagaccctgtttccaagtaagatcacctattgaggtttggggtgggtgtggatcttggaggaatgcttttcaacccaggacagccctcttcattttttttttttttttttccgagatggagtctctctctgtcacccaggctggagtgcagtggcacgatctcggctcactgcaacctctgcctcccgggttcaagtgattctcctgcctctgcctcccgagtaactgggattacaggcatgcaccaccatgcctagctagtttttgtattttcagtacagacggggtttcataatgttggtcaggctggtttcgaactcctgaccttgtgatctgcccgccttggcctcccaaagtgctgggatgacaggcatgagccactgagcccagccaccctcttcacttttttatgttttacttttttttttctgagacactgtctcgctgtgttgctcaggttggagtgcagtgttgggatcttggctcactgcagccttgaccgtctgggctcaagcagtcctcccacctcagcctgctgagtagctgggactacaggcatgtgccacctcacctggtacagtgagcaacacggggtctcactgtgttgctcagattggagtgccacggtgggatcttgtctcactacagccttgaccatgtgggttcgagcaatcctcccacctcagcctcccaaagtgctgaggcgtgagaggattgcagacacgagccactgcacctcgccagcttttaattttatgtcctgtggtgcagtgcagatggtttgagcggaaacagtgctgatggggatcatctctttcctgaccacctaccccttcttggcccttgggaacaaccattccctgcagtgggaggtgcccttagtcttacagcctccacctgatttgcctgattggcttccattctcagagggggcagcctaggcagaggcctgacggggccaaaagtgtgtttcatatgagaaatgtgaacagcctttcagccatcaatccggtgtctctccttctcatgcatagatctcgggctctgaaaagggcagtttttctcctaactttgccattctcctgccttcctggcttatgtctcagtcatagtcccattcaacgtcaagaagtggagaagggctgggcacggtggctcaagcctgtcatcccagcactttgggaggacgaggtgggtggatcacctgaggtcaggagttcgagaccaacctggccaacgtggtgaaaccccatctctgctaaaaatacaaaaaattagccgggagtgatggcatgcacctgtaagcccagctactcgggaggctgaggcaggagaatcgcttgaacccaggaggcagaggttgtggtgaacggagaccacaccattgcactccagcttgggtaacagagcaagacttggtctcaaaaaaaaaaaaaaaagaagtggagaaggggctcctggtctctgtggaaaccatggccggtagcagcctctgtgtctgtcttctgggctcaagagtcgttgtataaacctcagctcggtgtgggcaggtgagaaaaaacaatgctaaaaacattctccgactgtttccaagaaaatgaaacatccttaaccacaaaagagttgacacttgttttcccagctgcaacttttactaactgaaatatcttatctctttagacaatgaaaacaagaaacccactgcaatccccaagaaacccagtgctggtgagaagggcttcttcctagtatgcaaagaaaaagagcaaatcattttctcggacagcaggacgggacttaggcaactagaaagaagacagaagtgatttgagtgctccggctggagtctggttaatagttaatactggaattgtgttatgatgttacatttcatgtagtgattccagtaaaagaatggttgctgatgtgaaatgtttcggggccatttggacaacatctctgtgtgcttttattctaagggtctgagttactctgtctttagattttcttccctttttttttttttttttttttgagatggcgtttcattcttgtctcccaggctggagtgcagtggtgtgatcttggctcactgcaacctccacctcccgggttcagtgattctcctgcctcagatgcctcagtagctgggactgcaggcaccagccaccacacctggttaattgttgtatttttagtcgagacgaggtttcactatgtcggccaggctggtcttgaactcctgacttcaggcaatctgcctcccaaagtgctgggattacagcggtgagccaccatgcacggcctgtgtctttagatttcaacttcctaggagagagagcatttggtgctgagatctcccccatgatgaccaacaagtgaactcatctctcaacctgtgggcacacacctcatttgttctcagtgcttgctgttctttctttctttttttttttttttttgagacggagtctcgctctgtcgcccaggctggagtgcagtggcgcaatctcggctcactgcaagctccgcttcctgggttcacaccattcttctgcctcagcctcccaagtagctgggactacaggcagcggccaccacgcccagctaatttttttgtatttttagtagagacggggtttcaccatgttagccaggatggtctcgatctcctgaccttgtgatccacgcgccttggcctcccaaagtgctgggattacgggcatgagccaccacacccagccctcaatgctgttctttcaaacaaaagtcagaaacgaggtccacgtgatggaattgcccaagggtcaaccccactggcggataaacagagtaaaaatgatgctaaaacttatggcatcagtgtcttacagctaagacactgtcttgtcttagcacttctgagttttctaatataaaacattaatagctccacttcattattgggcttcctgtctagagtgtcagctcatgagcaaagggaccctgtgtccccagatccttgaactaagcaatcatgcagatagcaccaatgagtaggtgttgagcgtctgaatttatactatcatagtctccttgaggaagggactggaaattcccatatgtcactcaggatggctcagtacatgctgttgggtggatgccagcaaccattcctccatcttagttgggttttcaaaatcattcttcatactagaagacaagatctgaggccatggtgaactgtcacatcagttgcggagcacatatgggttgctagagccatgttttagacaccctctagcctaaatctgatcacagtcatctgtccccttctcttagggtctacctttccaaagttgttagggacctgggaggagaggatgatgggatggggagtcaacaggagaaaatcatgtgcaggcagaattggaatttcaacttggtccaggcaacacaattcatttataaattactttatttctctctctctctccccactgcctctcctctgagagcttctctcctagctttttatctgtctctgtctctctgttttttcctctttttatctgagagaatagtgatgtaaaaatggtcaggaattcactttttctaatgagatcctggtcaagctgatattcagaaaagtatttaggaatgtggggccgtggtgtgtttttgatctgttcacgaggtcattccttcctcgtttctctctggaatttggtattaactgctctttcccctcttttaggggatgactttgacttaggagatgctgttgttgatggagaaaatggtgagtattttcctttaatctcttctgctgctgatctgcttattatcacccaattatgatcatttcagagagaattctcccatttaaattataaagggaaccagttttcacagtggaaacctagggaataggtgtgtcggtttgttcttgctgttgtcgttgggtttttctttacaaccagtacgtgtgcttttattttaaaactcttacagtctttggaaggacatgagacaaatgtgcctaccctggccagggctggcttcaccagcatgtgacctgtgcagtggcacaggaccccatggcatgttggtttggcatgggaaccatactggtttactgctctgttgccgccatcttggaatacttaagaaaatttgaaaaatgggtcccacctttttattttggccctagaaattctgtagctggtgtggacacccgctttaatttttattaaacatagttgacattaagaactgtggctgaaagttgatgggaggaaactggcaggagactgtgtgtgtacaggtatccccaccaggacaaaggccaaggtccaatttctgttcagggaaccatctgtgtgtaaactgatgtttcattttctttactgcaaggcacttaaaattgcaactctcatctttcacaaacagacgacccacgaccaccgaacccacccaaaccgatgccaaatccaaaccccaaccaccctagttcctccggtaagagtctctgaccctgtgggatgtcttcatgttgttcagaattcagcgatatttatgtcagctgagaggaggtgatttcagatgagtgtgtgcttactgttgactgcctgtgcagtgtaatgcccatgttcatgtaatggaaaatgtacatttcaaaaatatatatttagcttggattttatttttagtttgcttttttttttttttttttttttgagacagagtcttgttctgtcacccaggctggagtgcagtggtgccatcttggctcactgcaacctccacctactgggttcaagtgattctcctgcatcagcctcctgagtagctggaattacaggcacacactgccatgcccggctaatttttgtatttttagtagagacagggttttgccatgttggccaggctggtcttgaactcctgacctcaagtgatccacccaccttggcctcccaaaagtgctgggatgacaggtgtgagccactgtgcctggactagtttgctacttttgtttccaagttccatcttatggaacttctaaaaaattgcatacaataatttaaatgtagacttgataaagagaaaagtattggcatacacattccttgtggagaagctagtgtgttttaaatctttctgcccttaaatatttaagtcagtttttctgacatatcacagcattttcagcgtaattcgaatagcaccagttttttttttttagctgaatggttgtcgaaagtttatatgtttaggtttttttgtttacatatttaatttttaacacagaagaatattaatgatgtccatatcttgttgacattttgatggctatttgtgctagtattttatatatcttttttttttcttttttgagacagggtctcactctgttgtccaggctagagtacagtgctgtgatcatattaaacataagagcataccacagcctccaactcctgggctagagagatccccctgcctcagcctttcaagtagctggggctacaggcacacagcatcgtgaccagttagttttttcattttttgtagaggtggggtctcagtatgttgcccaggctggtctgaaactcctggcctcaagcagtcctcttgcctcagcatcccaaatctctgagattacaggcacgagtcacctcacccagcctatatattaatctaaatgaaataaattttaaataaagttccaagtcttttgtttgtactgcattgtaacattactttttgcttactgatagtccatgaacattttttcatgtcatgtaatcatttctatcgtatgagttttactgataatcatgtactattacatactacatatataattatattcttcctgtaactaatccctaattctgaaaatgttatgtttcttctggcattttagaattatgaattaacaaagcaaatctgagtcaactccatgcgctatttttattcctttgaagacatttctagcattcaaatagtttagatcaacgtatatgagtactttcgtagcttttgacctggttgttaatttgctgcagatttttaccaatttattttgatgccaggggtgtgtgcaaatgtccctgtcttcacaccatctccaatattagttatcacctaggaaacctttgcaaatagtgtgaaattttctatcaactttctcctggtttcatgactttacttttaaaattaaaaaaaaaaaacaaacctgcatcaattggccgtggatacttcttattttgtgtattgtatgctttgccttttattcttacattctgatatgacattattgatttataagccttcttcatttatttacagacataaatattgccagcatgcaatattatgctcacgtttttccactttatttatggttttttgttttgttttgttttgagactgagtttagctcttcttgcccaggctggagtgcagtggtgccatcttggctcactgcaacctccacctccagggttcaagtgattctcctgcctcagcctcccgagtagctgggattacatgtgcctgtcaccacatccagctaatttttatattcttagtggagatggggtttcaccatgttgatgaacaggccggttttcatgagtttttcctttattctaagacatgaagacccttggaggagttccaggttgacaggtgatgctgtattttctttcctaggtagcttttcagatgctgaccttgcggatggcgtttcaggtggagaaggtacagttatcttgttttctgtctcttttctctctccatcccatgatgcccacctgctctgtagaatcactacagggtctaaactgtcagctctctgtgaactcacagtgaaatgttcagccatctctgtgggaactccgcctgtttgctgaggcttcaaggatgtgggaagtaaaggctgccccgtagaggttcggtcctcggagaagagttcagggcccaggcagctgccccacttttctgagggacagggcgtgatgaatgggcccttgtcaccacctcctcacccatccgttcacctgtgtgttcttgcaaataactagtgttgtttcagcttcattttattaggctgttttctgtaatttaaggaatgtgaatattaaagccctgagaatagtgataatgcctgggagtatgcgttctcagagtacccctagagtgtaacaggcagcacctcagctctgtagctgtgtaacatgcacccttagagtgtaataggcaggaccccagctctgtagctgggtaacatgtacccccgtagagtgtaagaagcaggaccccagcctcttcacggtcctggctgtgaatttttccttgaccccaaaccttcccattgcagacgttgtttttgtcttgcaggaaaaggaggcagtgatggtggaggcagccacaggaaagaaggggaagagggtaggtgcacctggcttctgtcttcttgtctctcccacgtggtgttgagaaggggaagcagaatgtctgagagctggcggactgcactggcattggcctcctaaagctactggcaggaggcacgggtgttctgtgccaagtgctcccaagtgatgtagctgcagaggtcccccagcaaaccagccctgctccgggtgcccacgtgacgcggattttatgtttggtcacctgcccacgatgccctggctggcgacccgacccctacatcacgcttcgccttgtccttgtgtttacaaaagctcctacactcaccctaacgatcagaggcttgtgacgcagtatcctcggttgcgcttggcccttgagaacgtcagtaaccaggtgggaggtgggaatgtggatcgcttccaccctggctgtaacaggcattgtgttctccatggaagtgccggtgatgtatctcctgtctcctttttcataaccttttcccttagatgggacaagaaaataatgacagacagaattccttttaaaactgtaaagaaaacaaaatgaggtaagaaagagaaacagagaagtagggaggaagaaaaaagggaaggagggaaggaaagaaggaaggagggatggagagaaggaaggaaggagggaagaagggaaggaaggaagggaggaaaagtgggtagtctacccttgttttaggtatttattatttttatgggtacagttcttgaattctaggctttctttgaagaggtagtaatctgtagccctcacctaggactacaaggtcattttttaaaaaatagctaagaaaacacatgtctggcatgtttatctcaggccatcgttcttggccttctagagagttaatgtctactatgtcacttcatcagggaggggtagttaagcttgaaaaatctttctatgacatgactgtgtcctgcacatattaaaaactggccgagtgaacacaccaccgacaggccatgtttggagccagtgtttttgctgaaagtcagacaattctccttccccgtcgtggagggcggagaagattctatctggagaagggtcctctgaagctcacatctggcatttggaatgaataatctcttcaatggccaggcacgctggctcatgcctgtcatcccagaactctgggaggctgaggcgggaggattgcttgaggccaagagttcgaaaccagcctggccaacatggtgaaaccccttttctacaaaaaatacaaaaattaggccaggtgtggtggctcacacctgtaatcctagcacttcgggaggccaaggtgggtggatcacttgaggtcaggagttcgagaccagcctggccaagatggtgaaaccccatctctacaaaaaatacaaaaattagctgggcgtgtgccatgcacctgtagtcctagctactcgggaggcacaagaattgcttgaacccgggaagcagaggctgcagtgagctgaaatcgtgccactgcactccagcctgggtgacaaagtaagactgcatttcaaaaaaaaaaaaaaactagccaggggtggtggcacacacctgtaatcccagctacttgggaggctgaggcaggagaatagcttgaacccgggacgcagaggttgcagtgagccgagatcgcaccactgcactccagcctgggcaacagagcaagactctgtctccccgccaaaaaaaaaagaattattgctggaataacataaaaaaaaaaaaaaaggctgagtgtggtggctcatgcgtgtaatcccagcattttgggaggcctaggcagcaggcaggttgctttaggctgggagttcgagatcagactgggcaacatagcaagaccccaattctataaaaccacagtaattaaccaggcatggtggtgcacacctgtagtcccagctactcggaaggctgaagtgggaggatctcatgagcccaggagtttgagattgcagtgagctgtgattacatcattgcactccagcctgtttgacagagcaagaacccatctcaaaataatacacaataataataattaattaaatagagatagatttaaaatgtctgcattgaaacccaaagctatcttcaaggggtgaaaaaggagcattctaacgatacaaaacgcattggcaaatgccccaagcattgcaggtctttgcttctttatcttctgcccctgcctgggctccttcctccaggtttgatgtccagctctctctttcttttttgttttgttttgttttgagatggtgaattgctctgtcgcccaggctggagtgcagcggcacaatctcggctcactgcaacctctgcctcccaggttcaagcgattctctggactcagcctcctgagtagctgggattaaaggcacccacccttactcccggctaatttttgtatttttcgtagagacgggttttaccatgttgaccaggctggtctcaaactcctgacctcaggcgattcacctgcctcggcctcccaaagtgctgggattacaggcgtgagccaccacgcccagccccagctctctttccatctgtctttgtctttttttgtctctgccttggttctgctgagcttctgcccgtacctcgctggcctctcttcatgtctcttttctcctgctccactccctccatggtctgaccaggtctgcccagcacgtgcgatgggagattgtgccttgctttgccttcctgtgtatcattctcggcatgcttcctttgcaaatcggtcagctcaggcgtctgagatgttctgaggatcttggtgctctcagactgactgtctctgccagccactgccccctgggatcttctctgcaccgtgcgtgtctcaatcacgatgctgtgtgcttcctcctgcagccgacgccccaggcgtgatccccgggattgtgggggctgtcgtggtcgccgtggctggagccatctctagcttcattgcttaccagaaaaagaagctatgcttcaaagaaaatggtaagtctcagtccgccggtgcctctccttcatgccttgctgattggaaaactgtgctttctttaaaaggcagaaaccaaactcgggctggcacgaaacaggtgcacgatggctgatggttcgtgaaactgctaaaattctggaatcgaaccttctggctttgatttcagggctgttctgccttgtgttttgttgtgtgaaagtttacaagttccccactgctgcagtgcttgggttgtttacgtctaccaagtgggaaatggttggtacatatgccgcggaattgttgctggggttagagacagtcctgcaggaaagccgctacaagttaccctgcagagagcaaaggtggaagacacttagctctgatcattcctgccctgttatttacaaccgatgtcatcatcaggaggagagccgtgaccagggggccgccacggtcctttctccactgagagttaagttaaaagccggcacaaggccggacatggtggctcacacctgtaatcccagcactttgggaggccgagacgggcggatcacgaggtcaggaggagatcgagaccatcctgggtaacatggtgaaaccccgtctctactaaaaatacaaaaaattagccgggcatggtggcgggcgtctgtagtcccagctactcggaaggctgaggcaggagaatggtgtgaacctgggaggcagagcttgcagtgagctgagatcatgtgactgcactccagcctgggcgacagagtgagactccgtctcaaaaaacaaaacaaaacaaaaaccagcacagcggattccctttctgttagtaccgaaaacccacaggcacccaggacctgggaagtttcttggatcgggactaaaatttacaggggaattaggaggaggacgtactcaccattgcaatcctcctaggtcagctggcaggctctttgggaccttgtattgggatccgccgtgaagctgggaagtaagccctgctatttggaacacagctaacgtgcatgcatcactgggcacttacatttagctcttgccttccctcttgcatgaccaagcattgtggtttgcaggaatcccatcgaccgggaacagctactcttattttttatttcttgagacagagtttcgctctgttgcccaggctggagtgcagtggcgcaatctcagctcactgcagtctccaccccacaggttcaagtgattctcctgcctcagcctcctgagtagctgggattataggcacccgccaccacgcccggctaatttctgtatttttagtagagatggggtctcaccatgttggccaggctggtctccaactcctcacctcaagtgatccacccgcctcggcctcccaaagtcttgggattacaggcgtgaggcaccacacctggccaacagctactgttttatggaggagcccctggggtccctcacgcctctgggtgtctgaacttctcaccctacttagatcttaagtccttattcattcttggtcactgatgtcattcactcaaagcactgcctcctgaagattttagagggattcctagaacatttgaatagatgctggtgtggacaaagttagactgtaggggtggagtttccccgtaatctcccatcattccagcatttgacatccacaaacattatttagagcgtgaaatggagagtcctaaacagctttcggatctcaagactttaaatgagctgctcgtgtttatttccccgttcttgctgtggggttttgggcagtgcgtggaagacagttgcctcctacctggtgggcagacgagtgggaaatggtgtttggttgtttcttttttttttttttttttttttgagatggagtctcactctgtcacccaggctggaatgcaatggctccatcttggctcactgcaacctccacctcccgggttctcctgcctcagcctcccgagtagctgggattacagatgtgcaccaccacgcacagctaatttttgtttttttagtagagatggagtttcgtcatgttggtcaggctggtctcgaactcctgaccttggatgatccgcctgccttgacctcccaaagtgttgggattgcaggcgtgagccaccgtgcccagctggtgtttggttgattgaatggcagttttgagcgggacccaaatggacagatgaccacattcaaggagatgcctgtaagagacgtacgattagaatcacgttggaaaaaagcaaacagcataacattcttctcccctcttgcttcttctagaagtagcggaggggttaaaacagtagggactcaatggaagggaatttttgtttgcttttcaatgacatttctttttcttttctgaaactgttcaactcacagcataatattcaaccaggaggtaaggaaggcttgtttgccaggacaggatgcgtaatattctagatgttgtatttcaaactctctggcttttttttttttttttttttgagacggagtctcgctctatcgcccagaatggagggcagtggtgcaatcttggctcactgcaacctcgcgggttcaagcaattctcctgcctcagcctccgaagtaactggaattacaggtgtgcatcaccacacccggctaatttttgtatttttagtagagatgggggttcaccatgttggacacactggtctcgaactcgtgacctcaggtggttcccccccgcaatcttggcctcccaaagtgttgggattataggcgtgagtcaaagcacccggcctcttttttagaatcccagacaattgttgaacacttttgcattaaactacaaagtctctgattgatgattctctgaaaatctttaggtcaacccaaattggattcatgagttgcaaaggatgtttattaccttgtgcgtgcagacgtaggaacttttgggatcttgtaagcctatttcatattcacatcctgtattagtccgttttcacactgctatgaagaactgcctaagactggataattcatgaaggaaagaggattcattgattcacagttcagcatggctggggaggcctcaggaaacttaacaatcatggcagaaggggacgcaaggcaccatcccattatcacgagaacagcatgggggaaccttcgctatggttcagtgaccccaacctggtctctccctggacacatggggattatgggaattacaatttaagatgagatttgggtggggacacagaggctcaccatatcacatctgaagacacacaaacttgggaaagcacccaggaggcttaatagacttgattttgtcaaaaattttgaaatagaattgggaaaaggaaaaacaacttttcctctaccttatccgccccgccacccctgggtcttggtcttgggtggaagcattatctttttttattgcaggaggtggggcaggcatgaacaatgaaagctctcactgggtagaaacaattttcctagattcttcaagaacaaaagcaaatatgtcctggcgaggtggccgacacctgtaatcccagtgctttgggagtccaaggaaagaggattgcttgagcccaggagttcaagatcagcctgggcaacatagtgaaacctcatctctacaaaaaatgtaaaaaattagctgggcgtgcttgcgcctgcctgtggtcccaactactctggaggccgaggtgtgaggattgcttgagcccaggaattggaggctgcagtaagccatgattgcaccactgcactccagcctggacgacagacagagaccctgtctctagatataaaaataaaaatacctttttttttttttttgagacggagtctcactctgtcacccaggctggagtgcaatggcgtgatctcggctcactgcagcctctgcctcccgggttcaagcgactctcctgcctcagcttcccgagcagctgggactacaggcgcgtgccaccacgtccagctaatttttcatatttttagtagagacggagttttgccgtgttagccaggatggtcttgatctcctgacctcatgatccacctgccttggcctcccaaagtgctagaattacaggcatgagccaccgtgcccggcccccaaaataattttttttaaaaaagcatcctttctgaagaattggctcaggggagtccaagattcactttatactaatgagatgctaggctaattttcttctaatattttctataagtctcttattctgatgccaaattaacagaaggtccaactttcaattcctggtttgctttctagttatcctgggattgattttcttggccttttgtaaatgcacaaagcaaagggccaaaaagaaaataaaataaagtataacaaagagaagcaagagatggtgaaaccccgtctctactaaaaatacaagaattagctgtgcgtgatggtgggcacctgtaatatcccagctacttgggaggctgaggcagggaattgcttgaacccgggaggcagaggttgcagtgagccaagattgtgccaccacactccagcctggacaacagagtgagactctgtctcaaaaaaaaaaaaaaaaaaagagaaagaaaacaaaaacaaggcactcttctataaataccaagaccctacctcaaaagaggacctttccaactgcatccactcacagcttggtttttatacctgaattataaaatgagtttaatatttatctcagtgacatgattttgttagtagacatggaattgtgatgttggatcgagttatccggaagacgaaagatgtcagagccctcagcctctggggcaggattttgctttatgggttcgatttccgggatggtgattttgagatctggcaaccccataggttcatggggagcttggagatttcataagaaggatgtgagtatagcatgccctggtccttcaagaaaccatgggccaggcgcggtggcttacgcctgtaatcccagcactttgggaggccaaggcgggtggatcacctgaggtcaggagtttgagaccagcctggccaacatggtgaaaccctggctctactaaaaatacaaaaattagccaggcatggtggtgcacacatgtatttccaggtactcgggaggctgaggcaggagaatcgcttgaacccaggaggcagagttgcagtgagccgagatcgagccactgcactccagcctggggacaagagcgagactttgtctcaaaaaagaaaaaagaaaagaaaaaccatgcccagttttggggatactgttattctaccagacaggctcattttccgggactgtgtcattgcattgaaatctgtggtgtttgttaaatttgtattaaaatgagtcccaggcgagtgagtagacataggtgagtcttcggcatctttccaacaaggagatgcctttatcaaatcctgtgacttgatatagatttactgagaagctttgcagtgttatattttggggttcacggattagaaactccttgtggaatcagatggctctgtctgttataggttggtgcaaaaataactgcggtttatgccattaaaagtaatagcaacatagcaagacctcgtgtctacaaaaaacgtaaaaaaaaaaaaattagctgagtgtggtggctcccagctaattttttacctttttttgtagagacagagtcttgctatgttgccattacttttaatggcaaaaaccacaattacttttgcaccagcctccgttcctcccttcctacagatttgagtttgtggtgcttgggcttctcctggtttttgtccatgtgatacgaaggggcctgttgaagctgcttctctcatgcactcggggtctgtgacttcgcatctgggtgtgttggcttcgcgggggacctggctcagaccactaaccacacggagcctgaccacttcccacagagcccagcttccgtggctggcaaggggtgttcaggatgctgtcctttggctgtggtggctggtcctactgctctgtttgccagggtcctgggctcacagtgggtttcttgaggctttggcaagatgggcgattggctctccctgtctccttctttctctttcttcttctctgcctttcttccttccctcctcctttctttccccctccctccttcttttctctcttccttccctgcttttctctttcttcctttgccctcagttctccctctctctctcttttcattctttcttgaactctccctctttcttcctccctccctcccttcttcttttcctccttttcctttttctctcttccttttctctatctcttcctttcttccttctcttttcttcttatgtacctctttcttttttctctcttctttccttccttcctttctttccatccctccctccttctttccttttcccctctccatcccttcctcctttccttccttcctttctttttttcctctctattctttgtctctcttcatccatctctcctgttcttacatgcctcttttcttccttccttctttcttctctccctccttcccttctttccttccttccttcccttcctccttccctctctccttcccttcctccctccctccctcatttccttcctccctgcttcacttcttcctccctcccttcctccatacctccctgcttccttttttccaacctccttccctcctcgttccttccctctttctgccttcctcccttccttcctcccatcccttcttcctgcttccctcctgctctccctgttccctgcctccctccctgccttcctctgtctctcccttcctccactccttaattttggtttccacttcccactctcacactttgagcctctatcccattacttccttgctcagagcagctctttctaacacctccctgctgctgggagccccagcgcacagcaaaagcagacccagcaccagtttactttttgtattattattttttatcgttttcaaccttccatttcagatggctgaagacctaggggtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaacagggcagtgacttccatgttttaatgagttttgtccctaagtccatccctgccaagggaacaaactggggcccagggtggccaccctcttccctgcagtgtcctaggttaagctcactcacgtcctaaggatttgaccttccaggtcatgcatggatttttaaatcttcaacgtttttggccgttgacttgcatttctcactgcacttcctatgaagcagttcttaactctttctgtgatcagtgttccaaacaggtacacaccttggttcctagaaaaacaaaattcatacgttgaggaatcacctaaacatctcctgatcttcacactgtaaggcgtgttgggaattggtgggtggtcaggtccctattcacacatttgagcacggagcctctgcggccgtcttccttggattctctcatatccctgaaaaacacaaattgtacctggattttccttctgtttccaaagtccaccaacttgttcttcaatgtaattgattttaacttgttttctttcttttacttttcttatttttttctttcttttcatttttttcttatttcttttccttctatttattttacttttcttatttgttatatgttatttctttttcttttcttacttttcttcttttttcatttttcttttttaaattggagtctcactctgttgcccaggctggagtgcagtggtgcaatcttggctcactgcagcctccacctcctgggttcaagcgattctcctgcctcagcctcccgagtagctgggactacaggcacacaccaccacacccagctaatttttgtatttttagtagagacggggtttctccatgttggccaggctgatctcgaacttctgacttcaggtgatctgcctgcctcaaccttccaaagtgctgggattacaggtgtgagccactgtgcctggccctttttcttttttctttttttttttctcttatttcttttttcttatttgttttcctttttgctttttctttttatcttatttcttttacttatttttcttttttttacttttatttcttctccgtttttcctcattcttttcctcttatttctttgacttttctgatttctttttttttcttattttcctttttttttcatattccttttaattttttcttacttcttttacttttcttatttgccctcttgtggaaatgaggcacagcctcccttatggttgagccgtagttctagctgagcacggatggtttgatcctcctgtgttggggcactgtatggtgtgagggcacaaaaccttgacccacatgggtctggtcaccttctcacagaggtcacctttacagccccccaactctttgaaggatgtgtcccaaggtgtctcaagtctgatgcaatgaaagctgccccccattgaccacaggactgagtccagaatgtcctgcgtgtttcccagagtgtctgtcctaacaccgcttaaagattagccactgctagacagtgatcctcaggtatatggtctcaggattggccccaagcacacggtgtgtgtgtgtgtataaatatatcttcacaaagcataggtacccattaaagccatattgctttgctgaatggttctaatagctacagatgatttctagcctgaaagaaaagcaccacgaattgtttgaagttgacttgtcagatgtggcatgcttggtctaagttttgacaggaagggtatgtgggtaggggtgtacggagcatctcatgagaccagttctcctcctgagaggtccgtgatgttggaactgttgccccagatggactttgcccttgtgagactttatacttttcaatgcagtttttccctctttaaaactcgccagcttttatgtagtgttttataaaattacaggaataaaaagaatatcttttatgctttttaaccaatgaggggagagggagaaattatttgtcctctgaaatgaatgcaggttttcaatttctagccaggacagtttgctgcaaaatgcacccgtgttgacaacttgtgactggcagaacaaatgacatttgtggtgaacattttcggatcatttcgaatgttcttctcttcagggggttttcctctctttttcttaaatcaaagaatttggccctttatgtgggagtcatttagtggttagggagaacagttgaaactgtggagttcacgtagcgtaaactggcgaggctgtctctgctgctgtcattaaaagttacgctgctggcttggcacggtggttcacacctgtaatcccagcattttgggaggccgaggtgggcagatcacgaagtcaggagatcgagaccatcctggctaacatggtgaaaccccgtctctactaaaaatacaaaaaattagctgggcatggtggcgggcgcctgtagtcccagctactcgggaggctgaggcaagagaatggcgtgaaccctggaggcggaggttgcagtgagccgagatcgcgccactgcgttccagcctgggcgacagagcaagactctgtctcaaaaaaaaaaaaaaaagaaaagaaaaagaaaagttacgctgctgcaccatacaaacgtgttcctttatgaaggcatttgaaccacagatggggccgttttacaaatagcacggtctttgtgagggggaaacgcatggccacagattcgatgagcttctgctgcttccctttgtgttgaaaacgtgggtgttccttcacaccaacactggaaataaataaatacctattgatctgtgcatctcttacgcgtttccaattctgttggcttatgctgtgggtcagaaaagaagcgacaccgacaacatttggggacttgaccctgtttgcattgcggcatgtttgaaacattttttaatggaaatttgggaatagagggccgggcgtggtggctcaggcctgtaatcccagtactttgagaggccgaggtgggcggatcacaaggtcaggagatcaagaccatcctggctaacacggtggaaccccatctctactaaaaatacaaaaaattagccaggcgtggtggtgcatgcctgaaatcccagctactcaggaggctgaggcaggagaattgcttgaacccgggaggcggaggttgcagtgagctgatatcgcgccactgcactccagcctgggcgacagagcgagactctgtctcaaagaaataataataataataaataaataaataaataaataaatttgggaatggaaacaagactgggaaaaaatgctggaggaggaagaaaaccgggtacacaagacgccttggctgtcttgtcctttgatggctggggaagctcttagtgctcggagtcctcactcacctctctgcattctgagggaggtagaaggggggacaggagagccaattcaacctgagaaggatgattggtggaggtgggtaaaggaagaaagtcccctttccctaggtactgaaaagatgctaatctgctgagattctctgtatttatttttatttattttaatttttattttgagacagtcttgctctgtcacccacgctggagtgcagtgccacgatctcagctcactgcaacctccacctcttgggttcaaatgattctcctgtctcagcctcccaagtagcggggactacaggtgcacgccaccacgcccagctaatttttgtatttttaatagagacggggtttcaccatgttggccaggatgggctcgatctcttgacctcgtgatccgcccgcctggcctcccaaagtggtgggattacaggtgtgagccaccatgcccagcctctgcatttatttttatttatttatttttatttttattttgagacagtcttgccctgtcacccaggctggagtgcaatagtgtgatctcggctcactgcaacctccacctcctgggttcaaacgatcctcctgcctcagcctcccgagtagctgggagtataggtgcacgccaccacgcccagttaacttttgtattttttagtagagacggggtttcaccatgttggccaggctggtctcgaactcctgacctcaagtgatccacctgcctcagcctcccaaagtgctgggattacaggcgtgagtcaccacgcccagccgtctgcatttgtttgatgagtttgggggcagttataaataagaatcttattttcacagatgcacgtactttttttttttttatagaaagagcttccatgtgcgtgttcctcagtgtttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagcagaacaaggggaggtggacatggagagccaccggaatgccaacgcagagccagctggtaagaaggacggggaacgatggcttgcacacgtggccagtgttcccattttatcttctccatcctctcccatcttgctgtcctgctcacattctcaaatttggttgcatggctttgaatgtcttcctttatgtctcgttgctttggagggatactttcaaaagacaatgaatgtgtaaacttcctagggcctgggccttcagagaagacctatatgtgcctaagtctctgtttaacaaaatattaaggaagttttcccaggagttcgagaccagcctggccaacatggtgaaaccctgtctgtactaaaaatacaaaattagctgagtgtggtggtgggcgcctgtaatcccagctacttgggaggctgaggcaagagaactgcttgaacctgggaggtagaggttgcagtgagccgagatcgtgccattgcactccagcctgggcgacacagtgagacatgtttcaaaaaaaaaaaaagttccaagtggcacacgattggtgcatagttgggaagtccacagctggctggtgtgcactgggaattaaaagcccatctcctgaaatataactcgttaagttttgctgtcaactttttttttgttgttagagatagggtctcactctgtcgcccaggctggagtgcagtggcacgatcataacttactgcagcctcgatctcctgggctcaagggatcctcccacctcagcctcctgataagctggaaccacaggcgtgcaccaccgtgtccggctgatttgttgttgttttttttttattttgtagagacaaggtctcactaggttgcccagacagggtctcactatgttgcccatcctgagctcaagcaaccctccgacctcagcttcccagagtgctggggttctaggcgtgaactaccgcacccagcctgctatcaccttctaaaaatcctctcaaccaggtggaaaatgtggttaagaagagactttaattcgtgagaaacttctcagggtaaaaggcaggcattttgccatcagaaccacttttgaaaatggcaagaaaaaaatgtgtgtgtgtatatgtgcgtgtatttttttattttgtttgtgcatacattggaaccttctcatttgcctgagagatgcagtgcttatttttaatagcagctgtcaaattgagagggatttttaatgaaatgatttaaaatattttaattttttttctttttgagatggagtgtctctctgtcacccaggctggagtgcagtggtgcgacctctgctcactgcaacccctgcctcccagtgtcaagtgattctccttcctcagccttctgagtagctgagaccacaggcacccgccatcatgccccactaattttctttctgtttttactagagacggggctttcgccatgttggccagagtggtctcgaactcctgacctcaagtgatctgcccaccttggcctcccaaagtgctaggattacaggcatgagccaccgtgcctggcattccattttaaagatagagacttctacaaagttagtgtctcgccagacgcggtggctaatgcctgtagtcccagcactttgggaggctgaggtgggcggatcacctgaggttgggagttcgagaccagcctgaccaacatggagaaaccacgtctctactaaaaattaaaaaaaaaaaaaaaaaaaaaattagccaggcatcgtggcgcatgcctgtaattccagctactcagaaggctgaggcaggagaatcgcttgaacccgggaggcggaggttgtggtgagccaagattgcgccattgcactccagcctgggcaacaagagcaaaactctgtctcaaaaataataataataataataaaagaaagttagtgtcttgttgactgctctttcgagtcagggaaagatgtttagaacaagctatatcttaaagagaaaaggaagattccttctgcccactgcaatgaagttgtctggcttcattagccagtacattggtatatgtgtgtggagccctcgtgacttgaagggcgtggcattccagtgttttctgccaccattgttcttaattccttcttccaaatcccagcttctccctccaaaatagttttaagactgacatgcagaataaagtttccaaaacttaaatgaatggaccagaaaatctcagcccagcatcattgcaaatcaataaaaactgcacactctcatttagaagatttattcttccatttggtaagttataggcatttgttagtgtctctgtgacgtcgttagtggaaattgccttctgctgttttccttctgctttttctgcagcatccattttttttaatgaatggcatcattcaatgaaattgattgaattgattgagatttagggttttgctttctcgtgatgagttttgggcccatttttcttatgcagaaataaaaccactggctcctgaaagttgtaggaactgtgtccacgtgagtgctcagggacctgggaatgactttcttttgtctctgtctcccacagttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatg

SEQ ID NO: 4173 - DNA, 42387 bp, human
gcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccgggtgagcgagcggagggatccgggttgggggacgcggagggcgcgggccgggactggggatccgcttgagatgcggcgttgggggcgccccgcggggacacccggagcctcctccctgcccggcaggacgcgctgtgcccacgggggcccaggcccggaggaggcgcccactttctccccaacgcttttcctggagccgttccagagagaaaagtcagcgtttgttgtcggagttgcaaactcttacatgtggggcggccttgggagaggtgcgtccgatttttcccaatctaggggaccttcttacagatctctctccctttgcatgagcccctcaccccaccccgttatctacccccagggtttggggacctgcgtcttcaggccgcgcgcggaggccgccctggagttgcctgtcacagccacgccctgcgtcccgggcctaaatttggaatcgctaggagcctgagacccgggtggtggggggaagggaaggaaaagttagaaaaaaactttgagccctgaaaatgttcaaaaatactctgtggatgcgggctccgggaatttcagcgcgtgctgtgcgccaagcaacacggggcgcagaaagaaacgtgtgcttaccaaattgtccatctgcggcggtggagaattcggaaaacagaaaaagtgggcagggaagaaagagccacggtcaccctcccacgccctaaaccgggcctatttctaattattactttaatcatgtttttctgtttccctccctttgaaacggaaacggagaccctgccggatgtggtatgttataaattcttttttcatgttataaattcttttttcaatggtcagtgcattttttgctcttcgtatgggcaggcttttaagtagaccggcttgcgggcagtgtggacttcaggacgggccttatcagggctggacgtatttaggaaggagacgcgggaacgcccggccctggggaggacggaggaggcccgatttgtgttgataggatctagctcagcctagagctgcggtgactaggccgggtctctatttttagggaggagttgctaatggatttacaccctctttaaaggggtcccgggtatcctagaaattgtgctttcacttggtagagattagagataatgaagcctgctccgtagaggaaaacttggaggactttccagcctgcaggggaggttccaagcagagcttcctgtttctcccttttcttcctaaatgtccttcttgcgggcaacctgtcaccacggacgggatggctctgtagggttttatcagctgcatttgttccccaggcacctgcagatgaacgggtttttcacttgtctctctgcgaatgcattccttcatccttcatgcctgccttccttcttttgcacctactgtgggcttggggtcagggaaatatatccaagggagtgctggtggcctaagaattcagtttcctggagaacagaggcatctgaacaggcagacgggagacagggccacagggacctttatagttccatcacgaaataactcaggggttcccagtggtaaatcttggtgaggggcttggctggattttgaagccctagggacagatttgccggctggtctggcgttccaggtcattggagcagagtgagtggaaagccttatattctctaagccccaaacaagtcgttgcacagtttttttgtttttgttggtggtggtggttttttttttttggacggagtttcactctgtcaccagtctggagtgtagtggcacgatgtcggctcattggcgttgcacagtttttaaacccacagcagtgttcatctggaactcctgattttggaagcagactgggcttaggaactccagctgctgatgctttgagtaaagggaagagtacctgtctatggggtgggtgggtagggaagagcagtgggataggggcataacaggggccaacctatccttccaattgcagaggagggcctggccgtcagcactgatggatctccttgagggacgcttctcaccccttctttgcagtctgaccctgctagagatggagacagaaacagcctgtcccaataatattaatacacgtttcatcgggaaagttgacttttgagttggtgatgctcagaacacactttcttatagcaacgtgcatcaggctgcaaaaccccgttgagcctgaagtaggttctcagactggtgctgatagctctggcctgatctcagagtgttggggaccctgtgttccttggttccttcataaattctcaggggtacaggtgggatgtggtgagggatggatggacagagggaggtgtatagaggaaaagaggaggcttcagctttgtagagagcaggatgtccccacagggcgacgttggccccgaggagacactttgtgatggttgcagacatttttggttgccaccctggggtgggacatcccaccatcctgcaatgggtggggcagcttagggaagctgctcagaatctttcaagggccaggacggcctccagcacaaagaattcatctggtcccaaatgccagtggtgttgagggtggaaaaccctgaggagggcttgggagttgcatgtatgcgctgattcagggctgcccctgcagttaggagcctgccgtcccgacagtagagtcgcacacatccgatgcatccctgctctctggcaaaggctgatttgccccaccccccggggcaacggcacagcggcctgtgcggtttgaaaaactccaaacatctacggaaccgacatctcttgaacaataccaggcctcttcaggattccctcgccccagtagagcaagtgtgggcttcgttgtttttttttttttttaactctctccagagctcttgtctcctgcccctgtgggtgtgtgtggaagttattaggagaatgtttctgggcagaggaagtgggttttatcatccagcgagtttgccttgattttccatcagcgcgtttggctctggtaaaagttgattgctttgcatttaactccctactttaggccgagcacggtgactcaggcctgtaaatcccagcactttgagaggccgagggccggtgggtcacatgaggccaagagttcgagaccagcctggccaacatggcaaaaccccgactctactaaaaatacaaaaattagccgggcgtggtggtgagcgcctataatcccagctactcaggaggctgaggcaggaaaatcacttcagcccgggaagcagaggttgcagtgagctgagatcgtgtcaccgcattatggcctgggtaacagagagagactcagtctcaaagaaaaaaaaaaacttcctgctttagctctttctcctttctctgtgtatgagacagagttttcatgtaaagacaaatacatgtctttacactttggagatactcaagtaaatgattgtttgtctggaaatcatttttcttcctgaaggtcctatggtgggtacatgctgtcatttagaaagaaatgcagctcatacaatacttttcccaattcagcatttaggaatcatggcgggatttcatggatactgtctggaatgttttcggactcagatatcttcccccggggaaatagacttctcagtagccacgtggaccttgtgctggttttcagtcctgctgaaaatgttctgagcactcttgttactttaggggaaaagaattacgtgtcctttgtgatttatagacacagtaagaaataagacctgtgtgtctctcggggtgcgaaggaggaaaagtcttttttttttgagatggaattttcctctgttgtccaggctggagtgaagtggcacgatctcagctcatggcaatctctccatctcaggttcaagcagttctcctgcctcagcctcccaattagctgggactacaggcatgcactgcatatctggctaatttttgtatgtttagtagagaaggggtttcactatgttgaccaggctgaaaaatatttttttgaggtggggtctctgttgcccagactggagtgcaggggtgcaatcagggctcactacagcctccacctcctgggctcaagcaatccttccacctcagcctctgtagtagctgggactacaagcacacaccactgtgcctggccacttttaaatttttttgtagagacagggtcttgctatgttgcccagactgaaaaaaaagtcttttttttttttttgagacagtgtctcactgtgtcacccaggctggagtgcaatggcaggatcttggctcactgcgacctgtgtctcccgggctcaggcaattctcctgcctcagacacctgaatagctgggaatacaggcacatgtcaccacacctggctattttttgtatttttagtagagacggtgtttcaccctgttggacaggctggcctcaaactcctggcctcaagtgatctgcccaccttggcctcccaaagtgctgggattacaggtgtgagccacctgaaaaatcattgtaaaaatcaactgtcctacattcttatttggaagtgactcctctaaccaaagacagggaaaaacaaaccaaactttattaacatgcgtttttcattgatacatgagagatacctagaaatgggtagttttcaaggaagtggcttggattctagctgctctagtaccctcaacaaagaacagtccatttttagagaattggcagagaaagacaaaggactttgagtcttcaggggcagcaacaaaatggcagagaaaggctggttattgaagcttgttcattctgagtcctgtgttccatgtcccaggcccatgtggattttctgctgtcttccgtgcttcacctctgttctcccagttggggaggtggggttcggattgcttgtgaatgtgggctcatcgttgctggtgtagctgcaggctgcaggctgtccagggcttgaggatttgctgatattctttcttttcttttctttttattttgagatgaagtctcgctctttttccccaggctggagtgcgatggtgcgatctcggctcactgcaacctctgcctcccaggttcaagcaattctcctgtctcagcctcctgagtacctgggattacaggtgcccgccaccacacctggctaatttttgtatttttttagtagaggtggagtttcaccatcttggccaggctggtttcgaactcctgacctcaggtgatccgcccgcctcggcctcctaaagtgtattcttttttgatttattcccagtctcttggctgaaacatggtagctcaccagcatttctactcccatttgtccaactgacggtatcttttcacatctctagagaccagaaggacttcctcttcttgaatttcctgttcagtattctttcttggcttggttccttggtgagttttgaggagatggtgcatgggtgtgtttttcggctttgttttagtatgactcagggttgccaccatgccttgtacggtctcctagtcatagtattaaagtttccgcttagcaggaaaccagaaacttcctttcttctcccccagagtcagattcaaaccagtgtttctcaagtgggctgtgaaagtagcttgcagccacccaccttgcaaagaagaaaattcaacagaggagaggagaaaatgcccacagggtacatggaaagccttgctaaagaagccgcatgggcaaagcttttgttccgctccctctgtcccggtgggctgggctgagatataatatatgtttgtcattgtggacggcagctggatgagtctgaaagcggttgcaaacccctttaattcactttgctttctcaactttgaatggtgtcgtgggctggggtgggtcccctgtttttgagaatcacctgaaagagtctgattttctgcatcttttcggggagtaaagctgttgctccaaagcgctgtttaaaagctgataatagtgtatctggttgagctaacagcccttcttgaggaggcagcagactggccagagggttctgcaggcattactcatcagcgacacctgagtttgcccaggtagcctgactcttgtttgtttctgctttgcctgaccctgcaaaattattgtccaaatgcaccctggcaagcattgatccacgaggggatgctgaccagaaggagctttcgtttctgcacgatggactggaacacgatggactggaatgatgacaagaataaacacactgcattgtcttttagggccaatggacttggaggcatagagattttataactactgccagaacccaaatattgccagtcggcctcttctgctgctgttgctagctgtcttcttctgggggaaatgggttgggttctaaatatgaattaacacagggctgtcttcgatgaattcagcacaaaatgttctcagcaattgaacactcggagagaagtgttaggcatttagtgcagactcatagaatagcaggacagggagggatttggatctgggcaagcaggagatggatatgaacatctgtcttttgagaccgtgccgaggtggcaatgaaggtagaggccccctgtgttgaggtctttactcaagaggctgtggtcctttgggactaacatagcatccgatagacagacaagatggacagctacagccacctatgggaagcggtttctactcttaaaccacaagcccctagacactcatcatatcataaacatatcaccgggcagtggcttgcaatctttttttttctttgtttctttttttttttttttttagacttgcccaggccggagtgcagtggcacgattgtagctcactgcagtcttgacctcctgggtgcaggtgaatctctcacctcagccttccaaggagctgggaccacaggcatgtgccaccctcagctaatttttaaaatctttttgtagaatcggagtctgactacattgcccaggctggtcttgaactcctgggctcaagcaaacctctcgcctcagcttcccaaagtgctggggttacaggcgtgagccaccatgctcagcctgcaatcattttttttgagacaggatctcactctgtcgcccaggctgaagtgcagtggtgtgatctcagctcactgcagcctcgaacccccaggctcaggtgacctgcccaccttagccttctgtgtagttgggactatgggcacatgccaccacactcaattaatttttaccttttttgtagatacagagttttgttctgtcgcccaggctggtggacatattttaatcctacagagtccaggctaaaaacacaccagtaactgtgatgcccatccctcctgcattcctgatttctgagtgatggtttcagacacaaacctgcttgaccaccctccagtagctcttgctgacctagatccgaggttctcagctttggccccattgcgggaagcttggaaacgtcactcttgcccagggttacctgggtagtctggtttatagacgtgttaggtgttttaatttttttttttttttgagacaagattttgctctgtcacccaggctggagtgcagtggtacagtcatagctcactgcagcctcaacctcctgggttcaagcagcccacctacctcagcctcgaaagaagctgggaccacaggtgcacctcaccatacccagctaatcttttctttctttttgtttttttcttttctttcctcttcttttcttttcttttgttttctcttctctcttttctttcttcttcttcttttttttagacagagtcttgctgtgttgcccaggctggagtgccttggtgcaatcttggctcactgcaacttccgcctccctggttcaagtgcctctcttgcctcagcctcctgagtagctggaactacaggcacgcaccaccacgcctggctaatttttgtatttttagtagagacgggatttcactatgttggccaggatggtctcgaactcctgacgtcgtgatctgcccacctcggcttcccaaagtgctgggattacaggtgtgagccaccgcgcccagccttttttttttttttttttttaaattacagagtctcactctgtcaccaggctggagtgcagcgatgcaatcttggctcgctgcaacctctgccacccaggttcaagtgattcttctgcctcagcctccctcaggcgtgagctggcacgcccagccaaatttttcattttttgtagagacagggtctccctatgttgcccagtttagtcctgaactcctgagttcaagccatccacctgccttggcctggcaaagtcttgggtttataggcgggagccactgcatcccgctattaggaatttttaaaaagcccctcggagggtcttcatgtgtggctgagttgtcaagaatcattgttattttactagatattctgtttcttccctcctacatgagatttcccatgaccgcctctcggatgtgaatgtctatgccatggattacatttttcaaagagcattcagtttgttatttcatcttcagcgagcccttaagatatttctcatgggccttttgtagataaagacactggggtcagagagttcaggagcttgctggtgatcacatggtcagcatggggaaaaatgcatgtggacatgagttctgttggtggtgagacgtgggcacaggggttgctgggcttgggagttggtggctgcgtgtgtgggctgaacagagctccccaggcacggccttgtggaccttgagggatgcctgccttcaccactagtgtgacttgaaggggaggagaatgtcctgaatcagtgatgggcattttgatatggaagagaactcccttgaatcctggtggtgaacttagaccagtcactgaggcctctccagctcctcagggtctccgtgttctaggtatccatgtgtccttccatccatttatccatccatttatgcatccatgcatccatccagccatgcatcctccttttatccatccatccatcaacccatcctcccattcatttacccatccatccgttcgtccatccatccatccatcaacccatcctcccattcatttacccatccatccattcatccatgcatccatccatccatgcgtgcatccatccatccatttatccatccatccatccatccatccgtcgtcccattcctttatccatccgttaatgcacctgtccatccatccatccattctccattcatctttccatccatgcatcatccatgcatccatccttttagttcatccagccactcatcaattgatacatccatctgtccaccatccactcatctatccatccattcacccatcctttcatcaatttacccatctaccatccatccatttatccgttcacccattcatctatccatctgtccatccatccacctatctgttcatccatccatccattcatctatccatccatccacctactcacccacccacccatccatccacccacccaaccatccatccacccaaccatccatccatacctccatccgtctacccacccactcatccacttaactacccatccatccacttatccatgcattcatccatccatccacctacctactcacccacctaaactcatctatccactcaaccatccatccacctatccacccttacctccatccatccccttactgcccatctttccactcatcccatccaactacccatccatccacccagctgtccacccaaccatccacccactcactaatttatccactcacccacgcatgcatccatccatccatccatccacccacccatttacccacccacccatccatccacttacctgcctgtccatccaccctcccagtccatggctctttcatgtattccttcagccagcataggttgaagttaaatgtactattggtgctatttgctgtggtccctgttttttgttctctgctttggaggtaacaaccagggcatcaatttgggcataaaagcaccattgtggatggaaggcctggatgtctggaggcacagagcagggactacacttgttcagggggtcagagagagttctcccaggaggggccctccctggacactgagcttccaagaatgagcagaggaaaccaggtgtaaggaagaggaagggcctcttctcagcctggtagacaagcagtaagagtgatgatggggcagctgcagttcatctcagactagaggagctgcaggggccagatggtgggcaacctctgttgccactgctgaggagtgcagatttaagctcccctgaagggtttgacgcagacagctgtgcggggacgcttaacctgcctaaggcccgtctttgggtaacagcatgcagaacaggtgggaggggctggggctatttttggcagagcgtggataagtcagtggagatagaagagaaggcacaagctattttaggagatattgaggaagttaaaatctgtaacaggtccctgcctgcagagttgaccacacgtttgcatcacatgggtaggctttaaaatatagatgcctgcatctcaccttggaaagtttctgatttaattagcctgggcatcaggacttaggaaaaccccacagatgtgtgtaatttgctgctggagttgagaactggggtgcggagctgtgctccttaaactgtaatgtgcttacagatcacctctggtaatacttgtgagaaagcgcttcaggtgggctagggagaggatcacggagggcttcctggagaaggtgacattctcccagggccttgaggggtgaatagacattttccaggttcagaaagaaggaatgggctttcatggccaggtagaggatccaatgaggcagacgaggggcccaaattctgtgaccccctacccctaccccacccccaggatgcccctgtatcagtcccatggtgtaacaaccaaattcacaagatgctgcagaggggaagagattttaaattttctgagaaagacaatgatatattttggacaccatgagaaatactgttattaacttgttttaacctaggtacacgcaatcttcatcattcagtgattctgtatttgtgacttgcctgcttactaaaatgtatttgtcatccccacatcaatattcctggcatttaatttttttattttaaactttcattttaggttcggggatacatgtgaaagtttgtgacttaggtaaacatgtgtcatgaggttttgttgtacagattatttcatcactgtggtattaaacccaggacccaatagttaccctttatgttcttctccttaccctcggctattttgttcatgcacagaacggcaaaaaaattgaactttttttttttattttttttggatggagtctccctctttcgccaaggctggagtgcagtggcgtgatcttggctcactgtaacctccgcctcctgtgttcaagtgattctcctgcctcagcctcccgagtagctgggattacaggcatgggattacagccaccacgcctggctaatttttgtatttttagtagagacggggtttcaccgtgttggccaggctgctctcaaactcctggcctcaagtgattcacccgcctgggcttcccaaaatgctgggattacaggcgtgagccaccacacctggccagaattgagcttctcaatagcacatgttctcagctgaggttcaacaaagccagaccctgccttctcgggccagcgcgtactgtcaacagggttctttgcaaggtctatttggtgtcccgtgttttgtgttttcgtgctttttgtcagtgattttgcgctttcaaatatccccaagtcggtgctgacatgctacctagcgtccctaagtacaggaaagctggcatggtctcacggggaaaatacacatttgatgagcgtcatttaggcacgagttatagtgctgttggcttcgagatcaatgtgagtgactccacaatgtctattcactgcggtgtctttaaacagaaacccacataaaacgcgcttaggtagtgattggttcatgacctctgggaacgtagtcctgtatttacgtgggagcaatagttcactattcgctaattcagtgttcgctgagactttataaaacgtaactgctttgaataacaaagctgtaattaacaaaccgagctgttaagtgtgtgtgtgtgtgtgtgtgtgtgtgtgtgtgtgtgtgtgtgtgttggcctcacatcattttacagagacacacagggctctgtgaactgctaatagttgggaccggcggaggggttatttcaagctagtccaaaactgcagggcagagaccactttgaaaggagatcagcagtcggggagtggctgggatgaagttggaaaaagtgctgaggcccctaagtcagtttccggtgtttccacgttagccttggggggtgatcactcagtttcctgtagggatgggatctgggctggcatctgcctgtggaaggggtgacagggacggagagcagggaaccccgagcagccctgccttgctgttgtctgagcctcagaactcctgaaggcggggtccttcagcatcaccctggagtttgttaaaaatgcaggctcatgagcctcaccccagaccacagaacgaaaatgtctgggggtgagacccaggattccacgtctccccaggtccctcgcagggcgattctgagaactgccggtgtgaggcgtgctcagcccagcccaaacattcacaccattctttggcctcttgtaaaacttggcgtagctcaggggacgttcccagagttatggcacacgaacaaaagaaagtttcccacttcttaccaaacatattgtaaaattacaggaaagagcttgttctttcacgtctatacccttgtgccgtcgtcctagttaggatgaagccgagatgttaccttgtaccttaggccaccgcagacaaggaagtatatgcagtttaaccacctgcatataatctttttcttttttcttttctttctttttttttgagacaaagtctcattctatcacccaggctagtgtgcagtggcacagtctcggctcactgcaacctccatctgccaagttcaagagattcttgtgcctcagcctcccaagtagctggaactacaggtacacgccaccatgcccagctaatttagcagagatggggttttgccttgttggccaggctggtctcgaacccctgacctcagtgatctgcctgcctcaacctcccaaagtgttgggattacaggagtgagccaccatgccctgcctattttttggaggcagggtctctctctgttgcccaggctggagtgccgtggtgcagtgtcagctccctgcaatctcaacctccacaagcgcaggccatcctcccgcctcagcctcccaagtagctgggaccatgggagtgcgtcacaacacctgtctaatttttgcattttttgtagagacggggtttcatcatgttgcccaggctgctgttgaactcctgggctcaagcaatcctcccaccttggcctcccaaagtgttgggattataggcgtgagccactgtacccggccacctatgtataattttcaagctaagaagacagagagacgagtttaactattgctacagacatgaagcccttccctttccatagtttgctagcagagagtgtttccagggcccggcggccactatcacccactgcgttcatagctttccatggggtgaacagattgcgctggactcagcggttaaatctaaagtgtaggatgtttggtgaactcggagttccttgcacttgtctgtgatctggcacattgtgttttctgtactcagatatgcagtcactggcacacatcctgttactgacgggaagctggacccagcactggagtatttctgagactatgacactctggtgtattcctgaaactatttatgacactattaagctcttttctgtaattttacaatatgtttggtaagatctcagcgccagatttttttaaatgatgtgtttatttcttttaattgacaaatacacattgtatgtgtttatgcggttgcacatggtgtcttgatgtatgtatccatggtgagatggatttaaatatgcatgacctcacagactttgcagcacttttttgtgtgtggtgagaacacttattcagaatgggctcctttagtcgttttcaaatattcaagccattgttactaattgcagtcgccatggtgtctctgagctttcctgaagttatttgtcctgtctcatggacgctttgtgccctgtgaccgatcgtctgcccggtgttaaatgacacatcttgaaaaagaggacaatacttccagagcgattcggttttatagcaacagaaaagtaagggtgttttgaccatttgaataaaatagtaaaatgaaatgtatcagctgcctcctgctattcccacacaggaggacttccggtgcttgctccaatgtggaggcattttctcttgcagcattctgagctacaattatctctaggctggggacccttcccgaggccccccaaacctggaatgaaagtttttagggtcagaccatgtgactggttccactcgacctccaaaacgttaaaaagaaaaaaaaaaaaagagccgggcgcggtggctcacgcctgtcatcccagcactttgggaggccgaggcgggcggatcacgagttcaggagatcgagaccatcctggctaccacggtgaaacccagtctctactaaaaatacaaaaaaatcagccgggcgtggtggtgggcacctgtagtcccagctactcgggaggctgaggcagcagaatggtgtgaacccgggaggcatagcttgcagtgagccaaaatcgggccaccgcactccagcctgggtgacacagagacactctgtctcaaaaaaaggaaaaaacaaaaaacaaaaaacgctttgcctttgcttggcatcagaggactcagcagcaagtaaagagcacacacgtgccctctgcaccacctcctcctccttttctacaatgtcctgaaagtttcgtgtttagtgggctttggaaaagggtgtggaaaaccagcaggagcagatgagtactggagtggccagcagcaggtgtgaacaccctggggtgatgctggggctgagtgaattggacatttttcagcagggacacccaggccagtggcgggtcttcatcctcccacccttaatggagatgaacggcattattgagaaagctgcaggcacacacagagcactgcttaaatgatgtccctggctgctgctgttactatgtaatgattgtgttattcttatgaaaatctgaaagttacaggaatcttggaactgcctaattttttttaattaattaattaatttatttcgagacagagtctcactctgtcgcccaggctggagtgcagtggtgcgatctcggctcactgcaacctccacctcccgggttcaagcgattctcctgcctcagcctcccaagtaactgggactacgggcgtgcaccaccacgcctggctcatttttaattttatgtgaaacacctgaatgatgtgatgatggggtttaagataacccaagtgttcgggcgcggcggctcacatctgtaatccctgcactttgggaggccaaggcaggcagatcacttgatgcccggagtttgagaccagcctggccaacatggcgaaactccatctctactaaaaacacaagaattagctggatgtggtggcacatgcccatagtcccagctactggggaagctgaggaaggagaatcacttgaacccaggaggtggaggttgcagtgagttgagatcatgctactgtactctagcctgggcaacagagcaaaactctgcctcaaaagaaaagaaaagaaaagaaaaaaacagcaaaaagagaacccaggtactggctctcctcctgcgtttgccccggttgagtgcattcctgcattagtgcaagccttagtcacgttgcagaggaactcacacaccccatgtggcctcggggacttcactctgggttcgtcctgttttttgagttgcctggctgatgagaaaaagtaaacatggtttgaatcagtagaaagtgtcttgtcagactgactcatgccatctgtcgtccgttccgccttgccctgatgagccattaccctgtcccggaaacatctggagctttgagagggccgggtggaaacagcagtggcagttgggggttctgctgagggtctggtctctttgcaaatttgcagagaggctgaatgccgtaaacgtgcaacacaggcacctgagttctccaccaggctccttctctgagggcatggttgcagctcttgctgggtgggttttgttggtgttttcttcacatttgtagccccggaggtcgttttcaggagcaaaaaggcaagtgggggtgtctgctgtgagcccgcaatttcctgcctaccacctgaaagctcagggaatgtgatgaattgggagatgaatcctaggcaataaagagagcagtggactgagttaggagacgatagcttcatttacagagattcctttactgactgatgatcattgattgggtttgcttccccatgaggcttcaagccaatagcacgtgcatttgcatccatttatatacacctgggggactgccttcctcacacacacctgggggactgcctccctcacacacacctggggaactgcatcccttcacatacatagggaactgtgtccctcacacacctggaagattagcctcagaggtgtctgcagtaccagattccaccagggagtgaacgtctgattatgggtgattcagggtgcccacgtctatatgaaatcgagagcgggtcacctccctttcctccctactctctgtggggtggtgtttggggagctgtcttaagtgttagtcacccgaggagaaaatggtgagggtgggactctgtatctgggagaaaggagaccttggaggcaggggacagactgacagagccttgagcgatggaagctgaggtcgagggcccaaggtcgatgatagaatgcttggggttgtctctcctctggtgtccttgtccttcaggcatcctggagtgacattgaaattgtttcaattaaaaactgtagaaacagcacagagataagaatggaagacaagctccaagtgcggggctgaggcgagttctccaaggactagggctaagggcagagggtgggagaaggggagaagggcgtgaggggcatactgtgtcctttgccacccactctcagacttgttgtcttggacctccgtcggctgagcttggggtccggggagcagtgggtttggacactcagtggtgacgtcagccgtagtcctgaagcagaggggaagttggcaatccaggcttgcctgggggtgacactggtggcgggagggcctgtgccctcccctgtaactgggtttgtgtggggtccatgggggcattggggtcagtggaaggaacatgaagtgagccagagcatcgtcactgtggcctctgagggcaggtggagcaagaaaaggaggaagcttctaagtgacacctggtcccagctcagtggctatgaccagggaagtcatgtggaggaaaaggctggtggactctgagggtgatggaggaggatgggaggggcaagctaggctggggaggtggcaggccatggacacacaccagacagacacacatgtgcatgcacacatacacaggcacatacatgcatgcacactcatgccatgcatatatgcatgcatgcacacgtgtgcacccacacagcaagtcacatgtgcacgtgagcacacatgaaaacacacaagcacatgcacatactcctgcagtgcacatgcacacccatatatgcatgcacacaggtgtgtgctcagatagcaccctcacacatatgcacacaagcacacaggcaaacacgcagacacatgaacaaatgcacatatatattcatgcagtgcacttgtgcacatatacacatgcaaacaggtgtgcattcagcacactcacaatgcacatgaaaacacgtgtgcacacacatgcagtgcaatacatatatgcatgcacatgtgtgcccacaccatacacccacacatacgtgcaggagcacacacgtgcacacacagaaaccacatgaatgcatgagcacgcgtatatgaaatacacatgtacacatgagcacatccacacgcgcacatgcatgaacatagacacacacatgcatgtacatagacacgcacatgcatgtacatagacatgcacacgtatacccaggccctgcattggaaaaaatccaaaatgtggcttggttgcaaagagcacatgaagagctgttgaatgcagaggtgcccagcaagaagcatggacctaaacccgaaggtggttgggggaagcttggggacacctgggtgggcaaatggcccccctgaggcccagggacagatgcaaaaacccagcaagccaggagggtctttgaaaaaaaaaatgtgtaccacatgtgacatttcccatgtgagggaagcatcgagatcatactgtgttttccctgtgccctgcgattttgcagctgacatgccctttctgtggaaatatatagcagtcctcatgctaggattgcgtgttctgtgtcaggcagctgggcatgggagtgcagggtgtggggtggaacctgggaggagagttctagttttaccactgtgttccggccgtggggtgtcctggggaatggaggccacctcctgacactggagtttcctgggttctgctgtgagcgaggagtgggagaagacaagactctggtcttagaaaccttccgagtctcgtacgcccttgactgccgtttctgagtatttcctgaagcttgggaaggatgagtcactttaaggggattgtcctatgttgctttgttttgtttctttagtgacggtgtctatgatcatcttctgtttatgagggtgaaattacagaaataagaagggttacacttaaaataatatctgtactttactttcacgtgtggggtttttttttgtcattgctgctgcttttttttctttaacattctgacagttctgtctgcttattattaagtcttcctacctttctaaagagaatgtctttcttgctaaagaatacattatggactcttggaatctctttgttggggtggagggggtggggacttgccctgacttgctgggaatgcccatagggtttagaagtcacgtctaccgctgaggcactaacaaaggtaagccttcaaggaagcactgtcatttccggggaagagagttttgaggaaattgaaacagttacgaattgatctagcagtccctctactaatgtatctacatatgaagatatgtagagatgactttttttttttttttttttttgagatggagtctccctctgtcacccaggctggagtgcagtggcatgatctctgctcactgcaacctctacttcccggattcaagcgattttcctgcctcagcctcctgagtagctgggattacatgcgcatatcaccacgcctggccaatttttttgtatttatagtagagacggggtttcaccatgttggttgggctggtctcgaactcctgacctcgtgatcctctcaccttggcctcccaaagtgctgagattacaggtgtgagccaccgcacccggccccagagatgacttctaaaccttcagggtattcccagcaagtcagggcaagtctatatatatataatatatatatgtgtatatatatatttgtataaatatataattcgtatatatagtatgtatatatagtatatatagtatgtatgtatatggtgtgtatatatgtagtgtgtgtatacatagtatgtgtatatacagtatgtatgtatatagtatgtgtatatatagtatgtgtgtgtattatatatatatatagtatgtgtatgtgtgtatatatatatatgtttatttgggataaggaaaggaaatcagtatgtcaaagagacactcccctcccatgtttattgcagcaccattcggagtagccaagacatgcagtcaatggaagagcccatcaagggatgaatgcagaaagaaaatgtgctatatcaactctgtacattcactaaaagccattcatttgcacagtgagaataagtgcctttcatgctatgtaaactatgcctcaataaagctattaaatgaacaaagaaaatagggtatattcacaatggaatggtattcagctttaaaaaagaaggaggttggctgggtgcggtggctcatgcctgtcatcctagcactttgggaggctgaggcaggtggatcacctgaggtcaggagttcaagaccagcctggccaacatggtgaaaccccgtctctagtaaaaatacaaaaaattagctgggcatgatgggcgggcgcctatagtcccagctactcaggaggctgaggcaggagaattgcttgaacccaggaggcggaggttgtagtgagccaagatcatcgcactccagcttgggcaacagagtgagactctgtctcaaaaagaaaaaagaaggaagtcctgccatttgcaacaacatggatggaactggaggacatgatgttaagtgcagtaagccgagcacagaaagacaaataccgtctgacccaaacacgcttacgtggaatctaaaaccactgaactcacagaagcagagtggaatggcggtgaccaaggggttgggagtgaggggtgggggaaatggggaaatgatgggtaaagggtacaacatttccatcagataggaagggataagttcaggggtctactgtactcagggtgactgtggttagtaagaatgcgttgcatacttgaaaatgcctaagacagtagctttgaactgtttgcaccacaaataaataggcgaggtaagatgtaaataaagaaaaaaaatacttcaaaaaatacaattacagatttctatggaaacatatgaacatgagtgcatatatatatttatatgtgcgtgtgtctgtacctgccttatggtttattctggatcagtaggatcctcccttgctaccgtctaaagatctgccgcatgctgcaggaggagctgtaattgcatttatgatgtctggcaagtgtcctgttgtggaaacagccatttcagggctctgaggttgtggaaacgactccactctggttgccggcatggggcccacagagctgttccgagcgttttgtctactttctacttattgttgacacacacagaaacacacacgcagccatgagtacacacacacacagacatacaagcagacgtggacacacctacctgtatgtacatactcaaaacacaccttcacactatactcacctacccatacacacacgtgcacacaactacatgtgtgcacacaaacacatgcatacatgcacctatgcatatgcacacgtggaaacacacctgcacactacacacacctacacatacacacacaaacccacaaatgcacacacccacacaggcacaaacacacaaatgcacacacccacacatgcacaaacacacctacacacataaacatattgacacatgcacacatgcacatgaaaaacacatatacacactacatccgcctacacatacacacacaaacccacatatacatgcacctacacacatgcacacataacacctacacacatgcatacagaacccacacatacatgcatccataggcacacagaaacacacctacacactgtgcacacctacatatgcacacacaaacccacatgaacatgcactgacacatatgcacacaaaaaacacactacacacacagaaacccacaaaatacacctccacacttacacaaaacacgcctacacatatgcacatacacaaacccacacatacatgcacctgcctatatgcacccacaacacatacacatatgcacacacagaactcacctacacaccccatacatgcacacaaaacccacaaatacatacatgtgcactgcaaatgcccaaatatacatgcacactcacacacacatacccctgtgacatatgcatgcacgcttcatttatacatgcaggagcatagcctggtcgtttgcacctgttgtggaactggacacacttccggtgttcacagggctcctgcgggttgttcttggacccctcgccacccaccgccaggtgcttcctgacggttgagagatgttgtatgcctttggtgctgaggagtggggacgctggatgttgacgattatcctaactcttcctccagttgaccaaacagtccaagtcgacttttccaaattttcctgaatttggcttttcttcagtgcgccagagatggccagccacgttgaagtagcattgaaattgttgtaattaaagactgtagaaacagggtagcctatcaataattcagcatgccagtttcctcattccgtgggattccatgagatttttttttaatgcataatgcacgtgtctttctgggttgtctagtgtttctactatattttggtttgtaattacaggaaagttgccaataaaaaagggagaattttgttccccatgttgttttcagtacatattcaaaattgttattcatctgtttgaaaggaacgacctgttaagaataatacacaaaatgatcgtgtttttacactattttaatttctactaagcttgaaggtcatcatttatttaaaacctaggctaacatattcttacttttaggcatggaagtgaatatttagaatgagaagagaaatcacgcaccttgtaaatttttttaagttgctgttttaaatatcacaaaaagaaaaatcgcatatcttttttatctctataatattcaaatttatttttatttttcttgtttctaagttgactctttttttctctcttagatggtggtttcgatttatccgatgcccttcctggtgagtatcaacatcattttttaaaatcccgtcaatattttatgttaacatagtatatacaggcatatcccagccatttccagctaggttctagaccaccgcaataacaggagtcatagcaatttttggcttcccagtacatataaatgttatgtttactctcaactgtagtctattaagtatgcaatagcattacctctaaaaacagtatactccaattgaaaataccttattgctaaaaaatgcagatacagagacaggaagtggggcacgtgctgttggaaaaaatgatgccgagagtctggcttgccacagggttgctgcaggccttccgtttgtaaaacacacagtatttgcaaagcaccttaagacaaagtgcagtgaaggaggtccgcctgtatgtgtccacctgccttattataaaaactagactcatagatgacgaggaaaagcaagatgcccttgttaagataaatgaaccaccctggtggaataattcacagtcctgtgatggtcagaggccgagcaaaaacttgccaggtccttggggaggggtctagaggaggtgagcaaatggaggtccccaggagagaggggcatccagtgctggcatcctccctctcgaaatcggcacccgctgtctccatggggccactccttccttcttctgcagctcttcctgtctcccgctcctcacccagagccctcggtgaagggcatgggaaaaggaattgaaggaattccgtcttatcactctatcagcttctgggtcttgtcatccctttgtatttgttttccggggctgccataaaaaggtgccaccaactgggggcttaaaccacagggatttatcatcttccagacctggacaacagaagtctgagatcaaggtgtagacagacccatgctccctctaggggctctaggggagggtccttcctgcctcttgcggcttccgggagctccaggtgtccctggacttgtggccgcatcactccagtctctgcctccttctccgtggggcctcctcctctgtgtctgtgtctccttttctttgtcttacaaggatacttgtcattgggtttagggccactctactccaggattatctaatctcaagatccttctcttaagcacatctgcaaagaccctatttccaaataaagtctcattaccaggttttaggctttaggatgtagatatatcttttgcggggaccactgctcaatccactgcagttatatccagttctttttggtggctctaggggaggatccttcctgcttctcccagcttttgagggcttcacgtgtccctgtgcttgtggctgcatcactgtaggctctgcctttgtgaacgctggtctcttccctgtgtctccatgtatctaaatttccttcctataagggcaccagtcattaggacctatcctaatctattataacctcatcttaactgattacaactgcaaagaccctgtttccaagtaagatcacctattgaggtttggggtgggtgtggatcttggaggaatgcttttcaacccaggacagccctcttcattttttttttttttttttccgagatggagtctctctctgtcacccaggctggagtgcagtggcacgatctcggctcactgcaacctctgcctcccgggttcaagtgattctcctgcctctgcctcccgagtaactgggattacaggcatgcaccaccatgcctagctagtttttgtattttcagtacagacggggtttcataatgttggtcaggctggtttcgaactcctgaccttgtgatctgcccgccttggcctcccaaagtgctgggatgacaggcatgagccactgagcccagccaccctcttcacttttttatgttttacttttttttttctgagacactgtctcgctgtgttgctcaggttggagtgcagtgttgggatcttggctcactgcagccttgaccgtctgggctcaagcagtcctcccacctcagcctgctgagtagctgggactacaggcatgtgccacctcacctggtacagtgagcaacacggggtctcactgtgttgctcagattggagtgccacggtgggatcttgtctcactacagccttgaccatgtgggttcgagcaatcctcccacctcagcctcccaaagtgctgaggcgtgagaggattgcagacacgagccactgcacctcgccagcttttaattttatgtcctgtggtgcagtgcagatggtttgagcggaaacagtgctgatggggatcatctctttcctgaccacctaccccttcttggcccttgggaacaaccattccctgcagtgggaggtgcccttagtcttacagcctccacctgatttgcctgattggcttccattctcagagggggcagcctaggcagaggcctgacggggccaaaagtgtgtttcatatgagaaatgtgaacagcctttcagccatcaatccggtgtctctccttctcatgcatagatctcgggctctgaaaagggcagtttttctcctaactttgccattctcctgccttcctggcttatgtctcagtcatagtcccattcaacgtcaagaagtggagaagggctgggcacggtggctcaagcctgtcatcccagcactttgggaggacgaggtgggtggatcacctgaggtcaggagttcgagaccaacctggccaacgtggtgaaaccccatctctgctaaaaatacaaaaaattagccgggagtgatggcatgcacctgtaagcccagctactcgggaggctgaggcaggagaatcgcttgaacccaggaggcagaggttgtggtgaacggagaccacaccattgcactccagcttgggtaacagagcaagacttggtctcaaaaaaaaaaaaaaaagaagtggagaaggggctcctggtctctgtggaaaccatggccggtagcagcctctgtgtctgtcttctgggctcaagagtcgttgtataaacctcagctcggtgtgggcaggtgagaaaaaacaatgctaaaaacattctccgactgtttccaagaaaatgaaacatccttaaccacaaaagagttgacacttgttttcccagctgcaacttttactaactgaaatatcttatctctttagacaatgaaaacaagaaacccactgcaatccccaagaaacccagtgctggtgagaagggcttcttcctagtatgcaaagaaaaagagcaaatcattttctcggacagcaggacgggacttaggcaactagaaagaagacagaagtgatttgagtgctccggctggagtctggttaatagttaatactggaattgtgttatgatgttacatttcatgtagtgattccagtaaaagaatggttgctgatgtgaaatgtttcggggccatttggacaacatctctgtgtgcttttattctaagggtctgagttactctgtctttagattttcttccctttttttttttttttttttttgagatggcgtttcattcttgtctcccaggctggagtgcagtggtgtgatcttggctcactgcaacctccacctcccgggttcagtgattctcctgcctcagatgcctcagtagctgggactgcaggcaccagccaccacacctggttaattgttgtatttttagtcgagacgaggtttcactatgtcggccaggctggtcttgaactcctgacttcaggcaatctgcctcccaaagtgctgggattacagcggtgagccaccatgcacggcctgtgtctttagatttcaacttcctaggagagagagcatttggtgctgagatctcccccatgatgaccaacaagtgaactcatctctcaacctgtgggcacacacctcatttgttctcagtgcttgctgttctttctttctttttttttttttttttgagacggagtctcgctctgtcgcccaggctggagtgcagtggcgcaatctcggctcactgcaagctccgcttcctgggttcacaccattcttctgcctcagcctcccaagtagctgggactacaggcagcggccaccacgcccagctaatttttttgtatttttagtagagacggggtttcaccatgttagccaggatggtctcgatctcctgaccttgtgatccacgcgccttggcctcccaaagtgctgggattacgggcatgagccaccacacccagccctcaatgctgttctttcaaacaaaagtcagaaacgaggtccacgtgatggaattgcccaagggtcaaccccactggcggataaacagagtaaaaatgatgctaaaacttatggcatcagtgtcttacagctaagacactgtcttgtcttagcacttctgagttttctaatataaaacattaatagctccacttcattattgggcttcctgtctagagtgtcagctcatgagcaaagggaccctgtgtccccagatccttgaactaagcaatcatgcagatagcaccaatgagtaggtgttgagcgtctgaatttatactatcatagtctccttgaggaagggactggaaattcccatatgtcactcaggatggctcagtacatgctgttgggtggatgccagcaaccattcctccatcttagttgggttttcaaaatcattcttcatactagaagacaagatctgaggccatggtgaactgtcacatcagttgcggagcacatatgggttgctagagccatgttttagacaccctctagcctaaatctgatcacagtcatctgtccccttctcttagggtctacctttccaaagttgttagggacctgggaggagaggatgatgggatggggagtcaacaggagaaaatcatgtgcaggcagaattggaatttcaacttggtccaggcaacacaattcatttataaattactttatttctctctctctctccccactgcctctcctctgagagcttctctcctagctttttatctgtctctgtctctctgttttttcctctttttatctgagagaatagtgatgtaaaaatggtcaggaattcactttttctaatgagatcctggtcaagctgatattcagaaaagtatttaggaatgtggggccgtggtgtgtttttgatctgttcacgaggtcattccttcctcgtttctctctggaatttggtattaactgctctttcccctcttttaggggatgactttgacttaggagatgctgttgttgatggagaaaatggtgagtattttcctttaatctcttctgctgctgatctgcttattatcacccaattatgatcatttcagagagaattctcccatttaaattataaagggaaccagttttcacagtggaaacctagggaataggtgtgtcggtttgttcttgctgttgtcgttgggtttttctttacaaccagtacgtgtgcttttattttaaaactcttacagtctttggaaggacatgagacaaatgtgcctaccctggccagggctggcttcaccagcatgtgacctgtgcagtggcacaggaccccatggcatgttggtttggcatgggaaccatactggtttactgctctgttgccgccatcttggaatacttaagaaaatttgaaaaatgggtcccacctttttattttggccctagaaattctgtagctggtgtggacacccgctttaatttttattaaacatagttgacattaagaactgtggctgaaagttgatgggaggaaactggcaggagactgtgtgtgtacaggtatccccaccaggacaaaggccaaggtccaatttctgttcagggaaccatctgtgtgtaaactgatgtttcattttctttactgcaaggcacttaaaattgcaactctcatctttcacaaacagacgacccacgaccaccgaacccacccaaaccgatgccaaatccaaaccccaaccaccctagttcctccggtaagagtctctgaccctgtgggatgtcttcatgttgttcagaattcagcgatatttatgtcagctgagaggaggtgatttcagatgagtgtgtgcttactgttgactgcctgtgcagtgtaatgcccatgttcatgtaatggaaaatgtacatttcaaaaatatatatttagcttggattttatttttagtttgcttttttttttttttttttttttgagacagagtcttgttctgtcacccaggctggagtgcagtggtgccatcttggctcactgcaacctccacctactgggttcaagtgattctcctgcatcagcctcctgagtagctggaattacaggcacacactgccatgcccggctaatttttgtatttttagtagagacagggttttgccatgttggccaggctggtcttgaactcctgacctcaagtgatccacccaccttggcctcccaaaagtgctgggatgacaggtgtgagccactgtgcctggactagtttgctacttttgtttccaagttccatcttatggaacttctaaaaaattgcatacaataatttaaatgtagacttgataaagagaaaagtattggcatacacattccttgtggagaagctagtgtgttttaaatctttctgcccttaaatatttaagtcagtttttctgacatatcacagcattttcagcgtaattcgaatagcaccagttttttttttttagctgaatggttgtcgaaagtttatatgtttaggtttttttgtttacatatttaatttttaacacagaagaatattaatgatgtccatatcttgttgacattttgatggctatttgtgctagtattttatatatcttttttttttcttttttgagacagggtctcactctgttgtccaggctagagtacagtgctgtgatcatattaaacataagagcataccacagcctccaactcctgggctagagagatccccctgcctcagcctttcaagtagctggggctacaggcacacagcatcgtgaccagttagttttttcattttttgtagaggtggggtctcagtatgttgcccaggctggtctgaaactcctggcctcaagcagtcctcttgcctcagcatcccaaatctctgagattacaggcacgagtcacctcacccagcctatatattaatctaaatgaaataaattttaaataaagttccaagtcttttgtttgtactgcattgtaacattactttttgcttactgatagtccatgaacattttttcatgtcatgtaatcatttctatcgtatgagttttactgataatcatgtactattacatactacatatataattatattcttcctgtaactaatccctaattctgaaaatgttatgtttcttctggcattttagaattatgaattaacaaagcaaatctgagtcaactccatgcgctatttttattcctttgaagacatttctagcattcaaatagtttagatcaacgtatatgagtactttcgtagcttttgacctggttgttaatttgctgcagatttttaccaatttattttgatgccaggggtgtgtgcaaatgtccctgtcttcacaccatctccaatattagttatcacctaggaaacctttgcaaatagtgtgaaattttctatcaactttctcctggtttcatgactttacttttaaaattaaaaaaaaaaaacaaacctgcatcaattggccgtggatacttcttattttgtgtattgtatgctttgccttttattcttacattctgatatgacattattgatttataagccttcttcatttatttacagacataaatattgccagcatgcaatattatgctcacgtttttccactttatttatggttttttgttttgttttgttttgagactgagtttagctcttcttgcccaggctggagtgcagtggtgccatcttggctcactgcaacctccacctccagggttcaagtgattctcctgcctcagcctcccgagtagctgggattacatgtgcctgtcaccacatccagctaatttttatattcttagtggagatggggtttcaccatgttgatgaacaggccggttttcatgagtttttcctttattctaagacatgaagacccttggaggagttccaggttgacaggtgatgctgtattttctttcctaggtagcttttcagatgctgaccttgcggatggcgtttcaggtggagaaggtacagttatcttgttttctgtctcttttctctctccatcccatgatgcccacctgctctgtagaatcactacagggtctaaactgtcagctctctgtgaactcacagtgaaatgttcagccatctctgtgggaactccgcctgtttgctgaggcttcaaggatgtgggaagtaaaggctgccccgtagaggttcggtcctcggagaagagttcagggcccaggcagctgccccacttttctgagggacagggcgtgatgaatgggcccttgtcaccacctcctcacccatccgttcacctgtgtgttcttgcaaataactagtgttgtttcagcttcattttattaggctgttttctgtaatttaaggaatgtgaatattaaagccctgagaatagtgataatgcctgggagtatgcgttctcagagtacccctagagtgtaacaggcagcacctcagctctgtagctgtgtaacatgcacccttagagtgtaataggcaggaccccagctctgtagctgggtaacatgtacccccgtagagtgtaagaagcaggaccccagcctcttcacggtcctggctgtgaatttttccttgaccccaaaccttcccattgcagacgttgtttttgtcttgcaggaaaaggaggcagtgatggtggaggcagccacaggaaagaaggggaagagggtaggtgcacctggcttctgtcttcttgtctctcccacgtggtgttgagaaggggaagcagaatgtctgagagctggcggactgcactggcattggcctcctaaagctactggcaggaggcacgggtgttctgtgccaagtgctcccaagtgatgtagctgcagaggtcccccagcaaaccagccctgctccgggtgcccacgtgacgcggattttatgtttggtcacctgcccacgatgccctggctggcgacccgacccctacatcacgcttcgccttgtccttgtgtttacaaaagctcctacactcaccctaacgatcagaggcttgtgacgcagtatcctcggttgcgcttggcccttgagaacgtcagtaaccaggtgggaggtgggaatgtggatcgcttccaccctggctgtaacaggcattgtgttctccatggaagtgccggtgatgtatctcctgtctcctttttcataaccttttcccttagatgggacaagaaaataatgacagacagaattccttttaaaactgtaaagaaaacaaaatgaggtaagaaagagaaacagagaagtagggaggaagaaaaaagggaaggagggaaggaaagaaggaaggagggatggagagaaggaaggaaggagggaagaagggaaggaaggaagggaggaaaagtgggtagtctacccttgttttaggtatttattatttttatgggtacagttcttgaattctaggctttctttgaagaggtagtaatctgtagccctcacctaggactacaaggtcattttttaaaaaatagctaagaaaacacatgtctggcatgtttatctcaggccatcgttcttggccttctagagagttaatgtctactatgtcacttcatcagggaggggtagttaagcttgaaaaatctttctatgacatgactgtgtcctgcacatattaaaaactggccgagtgaacacaccaccgacaggccatgtttggagccagtgtttttgctgaaagtcagacaattctccttccccgtcgtggagggcggagaagattctatctggagaagggtcctctgaagctcacatctggcatttggaatgaataatctcttcaatggccaggcacgctggctcatgcctgtcatcccagaactctgggaggctgaggcgggaggattgcttgaggccaagagttcgaaaccagcctggccaacatggtgaaaccccttttctacaaaaaatacaaaaattaggccaggtgtggtggctcacacctgtaatcctagcacttcgggaggccaaggtgggtggatcacttgaggtcaggagttcgagaccagcctggccaagatggtgaaaccccatctctacaaaaaatacaaaaattagctgggcgtgtgccatgcacctgtagtcctagctactcgggaggcacaagaattgcttgaacccgggaagcagaggctgcagtgagctgaaatcgtgccactgcactccagcctgggtgacaaagtaagactgcatttcaaaaaaaaaaaaaaactagccaggggtggtggcacacacctgtaatcccagctacttgggaggctgaggcaggagaatagcttgaacccgggacgcagaggttgcagtgagccgagatcgcaccactgcactccagcctgggcaacagagcaagactctgtctccccgccaaaaaaaaaagaattattgctggaataacataaaaaaaaaaaaaaaggctgagtgtggtggctcatgcgtgtaatcccagcattttgggaggcctaggcagcaggcaggttgctttaggctgggagttcgagatcagactgggcaacatagcaagaccccaattctataaaaccacagtaattaaccaggcatggtggtgcacacctgtagtcccagctactcggaaggctgaagtgggaggatctcatgagcccaggagtttgagattgcagtgagctgtgattacatcattgcactccagcctgtttgacagagcaagaacccatctcaaaataatacacaataataataattaattaaatagagatagatttaaaatgtctgcattgaaacccaaagctatcttcaaggggtgaaaaaggagcattctaacgatacaaaacgcattggcaaatgccccaagcattgcaggtctttgcttctttatcttctgcccctgcctgggctccttcctccaggtttgatgtccagctctctctttcttttttgttttgttttgttttgagatggtgaattgctctgtcgcccaggctggagtgcagcggcacaatctcggctcactgcaacctctgcctcccaggttcaagcgattctctggactcagcctcctgagtagctgggattaaaggcacccacccttactcccggctaatttttgtatttttcgtagagacgggttttaccatgttgaccaggctggtctcaaactcctgacctcaggcgattcacctgcctcggcctcccaaagtgctgggattacaggcgtgagccaccacgcccagccccagctctctttccatctgtctttgtctttttttgtctctgccttggttctgctgagcttctgcccgtacctcgctggcctctcttcatgtctcttttctcctgctccactccctccatggtctgaccaggtctgcccagcacgtgcgatgggagattgtgccttgctttgccttcctgtgtatcattctcggcatgcttcctttgcaaatcggtcagctcaggcgtctgagatgttctgaggatcttggtgctctcagactgactgtctctgccagccactgccccctgggatcttctctgcaccgtgcgtgtctcaatcacgatgctgtgtgcttcctcctgcagccgacgccccaggcgtgatccccgggattgtgggggctgtcgtggtcgccgtggctggagccatctctagcttcattgcttaccagaaaaagaagctatgcttcaaagaaaatggtaagtctcagtccgccggtgcctctccttcatgccttgctgattggaaaactgtgctttctttaaaaggcagaaaccaaactcgggctggcacgaaacaggtgcacgatggctgatggttcgtgaaactgctaaaattctggaatcgaaccttctggctttgatttcagggctgttctgccttgtgttttgttgtgtgaaagtttacaagttccccactgctgcagtgcttgggttgtttacgtctaccaagtgggaaatggttggtacatatgccgcggaattgttgctggggttagagacagtcctgcaggaaagccgctacaagttaccctgcagagagcaaaggtggaagacacttagctctgatcattcctgccctgttatttacaaccgatgtcatcatcaggaggagagccgtgaccagggggccgccacggtcctttctccactgagagttaagttaaaagccggcacaaggccggacatggtggctcacacctgtaatcccagcactttgggaggccgagacgggcggatcacgaggtcaggaggagatcgagaccatcctgggtaacatggtgaaaccccgtctctactaaaaatacaaaaaattagccgggcatggtggcgggcgtctgtagtcccagctactcggaaggctgaggcaggagaatggtgtgaacctgggaggcagagcttgcagtgagctgagatcatgtgactgcactccagcctgggcgacagagtgagactccgtctcaaaaaacaaaacaaaacaaaaaccagcacagcggattccctttctgttagtaccgaaaacccacaggcacccaggacctgggaagtttcttggatcgggactaaaatttacaggggaattaggaggaggacgtactcaccattgcaatcctcctaggtcagctggcaggctctttgggaccttgtattgggatccgccgtgaagctgggaagtaagccctgctatttggaacacagctaacgtgcatgcatcactgggcacttacatttagctcttgccttccctcttgcatgaccaagcattgtggtttgcaggaatcccatcgaccgggaacagctactcttattttttatttcttgagacagagtttcgctctgttgcccaggctggagtgcagtggcgcaatctcagctcactgcagtctccaccccacaggttcaagtgattctcctgcctcagcctcctgagtagctgggattataggcacccgccaccacgcccggctaatttctgtatttttagtagagatggggtctcaccatgttggccaggctggtctccaactcctcacctcaagtgatccacccgcctcggcctcccaaagtcttgggattacaggcgtgaggcaccacacctggccaacagctactgttttatggaggagcccctggggtccctcacgcctctgggtgtctgaacttctcaccctacttagatcttaagtccttattcattcttggtcactgatgtcattcactcaaagcactgcctcctgaagattttagagggattcctagaacatttgaatagatgctggtgtggacaaagttagactgtaggggtggagtttccccgtaatctcccatcattccagcatttgacatccacaaacattatttagagcgtgaaatggagagtcctaaacagctttcggatctcaagactttaaatgagctgctcgtgtttatttccccgttcttgctgtggggttttgggcagtgcgtggaagacagttgcctcctacctggtgggcagacgagtgggaaatggtgtttggttgtttcttttttttttttttttttttttgagatggagtctcactctgtcacccaggctggaatgcaatggctccatcttggctcactgcaacctccacctcccgggttctcctgcctcagcctcccgagtagctgggattacagatgtgcaccaccacgcacagctaatttttgtttttttagtagagatggagtttcgtcatgttggtcaggctggtctcgaactcctgaccttggatgatccgcctgccttgacctcccaaagtgttgggattgcaggcgtgagccaccgtgcccagctggtgtttggttgattgaatggcagttttgagcgggacccaaatggacagatgaccacattcaaggagatgcctgtaagagacgtacgattagaatcacgttggaaaaaagcaaacagcataacattcttctcccctcttgcttcttctagaagtagcggaggggttaaaacagtagggactcaatggaagggaatttttgtttgcttttcaatgacatttctttttcttttctgaaactgttcaactcacagcataatattcaaccaggaggtaaggaaggcttgtttgccaggacaggatgcgtaatattctagatgttgtatttcaaactctctggcttttttttttttttttttttgagacggagtctcgctctatcgcccagaatggagggcagtggtgcaatcttggctcactgcaacctcgcgggttcaagcaattctcctgcctcagcctccgaagtaactggaattacaggtgtgcatcaccacacccggctaatttttgtatttttagtagagatgggggttcaccatgttggacacactggtctcgaactcgtgacctcaggtggttcccccccgcaatcttggcctcccaaagtgttgggattataggcgtgagtcaaagcacccggcctcttttttagaatcccagacaattgttgaacacttttgcattaaactacaaagtctctgattgatgattctctgaaaatctttaggtcaacccaaattggattcatgagttgcaaaggatgtttattaccttgtgcgtgcagacgtaggaacttttgggatcttgtaagcctatttcatattcacatcctgtattagtccgttttcacactgctatgaagaactgcctaagactggataattcatgaaggaaagaggattcattgattcacagttcagcatggctggggaggcctcaggaaacttaacaatcatggcagaaggggacgcaaggcaccatcccattatcacgagaacagcatgggggaaccttcgctatggttcagtgaccccaacctggtctctccctggacacatggggattatgggaattacaatttaagatgagatttgggtggggacacagaggctcaccatatcacatctgaagacacacaaacttgggaaagcacccaggaggcttaatagacttgattttgtcaaaaattttgaaatagaattgggaaaaggaaaaacaacttttcctctaccttatccgccccgccacccctgggtcttggtcttgggtggaagcattatctttttttattgcaggaggtggggcaggcatgaacaatgaaagctctcactgggtagaaacaattttcctagattcttcaagaacaaaagcaaatatgtcctggcgaggtggccgacacctgtaatcccagtgctttgggagtccaaggaaagaggattgcttgagcccaggagttcaagatcagcctgggcaacatagtgaaacctcatctctacaaaaaatgtaaaaaattagctgggcgtgcttgcgcctgcctgtggtcccaactactctggaggccgaggtgtgaggattgcttgagcccaggaattggaggctgcagtaagccatgattgcaccactgcactccagcctggacgacagacagagaccctgtctctagatataaaaataaaaatacctttttttttttttttgagacggagtctcactctgtcacccaggctggagtgcaatggcgtgatctcggctcactgcagcctctgcctcccgggttcaagcgactctcctgcctcagcttcccgagcagctgggactacaggcgcgtgccaccacgtccagctaatttttcatatttttagtagagacggagttttgccgtgttagccaggatggtcttgatctcctgacctcatgatccacctgccttggcctcccaaagtgctagaattacaggcatgagccaccgtgcccggcccccaaaataattttttttaaaaaagcatcctttctgaagaattggctcaggggagtccaagattcactttatactaatgagatgctaggctaattttcttctaatattttctataagtctcttattctgatgccaaattaacagaaggtccaactttcaattcctggtttgctttctagttatcctgggattgattttcttggccttttgtaaatgcacaaagcaaagggccaaaaagaaaataaaataaagtataacaaagagaagcaagagatggtgaaaccccgtctctactaaaaatacaagaattagctgtgcgtgatggtgggcacctgtaatatcccagctacttgggaggctgaggcagggaattgcttgaacccgggaggcagaggttgcagtgagccaagattgtgccaccacactccagcctggacaacagagtgagactctgtctcaaaaaaaaaaaaaaaaaaagagaaagaaaacaaaaacaaggcactcttctataaataccaagaccctacctcaaaagaggacctttccaactgcatccactcacagcttggtttttatacctgaattataaaatgagtttaatatttatctcagtgacatgattttgttagtagacatggaattgtgatgttggatcgagttatccggaagacgaaagatgtcagagccctcagcctctggggcaggattttgctttatgggttcgatttccgggatggtgattttgagatctggcaaccccataggttcatggggagcttggagatttcataagaaggatgtgagtatagcatgccctggtccttcaagaaaccatgggccaggcgcggtggcttacgcctgtaatcccagcactttgggaggccaaggcgggtggatcacctgaggtcaggagtttgagaccagcctggccaacatggtgaaaccctggctctactaaaaatacaaaaattagccaggcatggtggtgcacacatgtatttccaggtactcgggaggctgaggcaggagaatcgcttgaacccaggaggcagagttgcagtgagccgagatcgagccactgcactccagcctggggacaagagcgagactttgtctcaaaaaagaaaaaagaaaagaaaaaccatgcccagttttggggatactgttattctaccagacaggctcattttccgggactgtgtcattgcattgaaatctgtggtgtttgttaaatttgtattaaaatgagtcccaggcgagtgagtagacataggtgagtcttcggcatctttccaacaaggagatgcctttatcaaatcctgtgacttgatatagatttactgagaagctttgcagtgttatattttggggttcacggattagaaactccttgtggaatcagatggctctgtctgttataggttggtgcaaaaataactgcggtttatgccattaaaagtaatagcaacatagcaagacctcgtgtctacaaaaaacgtaaaaaaaaaaaaattagctgagtgtggtggctcccagctaattttttacctttttttgtagagacagagtcttgctatgttgccattacttttaatggcaaaaaccacaattacttttgcaccagcctccgttcctcccttcctacagatttgagtttgtggtgcttgggcttctcctggtttttgtccatgtgatacgaaggggcctgttgaagctgcttctctcatgcactcggggtctgtgacttcgcatctgggtgtgttggcttcgcgggggacctggctcagaccactaaccacacggagcctgaccacttcccacagagcccagcttccgtggctggcaaggggtgttcaggatgctgtcctttggctgtggtggctggtcctactgctctgtttgccagggtcctgggctcacagtgggtttcttgaggctttggcaagatgggcgattggctctccctgtctccttctttctctttcttcttctctgcctttcttccttccctcctcctttctttccccctccctccttcttttctctcttccttccctgcttttctctttcttcctttgccctcagttctccctctctctctcttttcattctttcttgaactctccctctttcttcctccctccctcccttcttcttttcctccttttcctttttctctcttccttttctctatctcttcctttcttccttctcttttcttcttatgtacctctttcttttttctctcttctttccttccttcctttctttccatccctccctccttctttccttttcccctctccatcccttcctcctttccttccttcctttctttttttcctctctattctttgtctctcttcatccatctctcctgttcttacatgcctcttttcttccttccttctttcttctctccctccttcccttctttccttccttccttcccttcctccttccctctctccttcccttcctccctccctccctcatttccttcctccctgcttcacttcttcctccctcccttcctccatacctccctgcttccttttttccaacctccttccctcctcgttccttccctctttctgccttcctcccttccttcctcccatcccttcttcctgcttccctcctgctctccctgttccctgcctccctccctgccttcctctgtctctcccttcctccactccttaattttggtttccacttcccactctcacactttgagcctctatcccattacttccttgctcagagcagctctttctaacacctccctgctgctgggagccccagcgcacagcaaaagcagacccagcaccagtttactttttgtattattattttttatcgttttcaaccttccatttcagatggctgaagacctaggggtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaa

SEQ ID NO: 4174 - DNA, 50130 bp, human
cgcgcgtggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccgggtgagcgagcggagggatccgggttgggggacgcggagggcgcgggccgggactggggatccgcttgagatgcggcgttgggggcgccccgcggggacacccggagcctcctccctgcccggcaggacgcgctgtgcccacgggggcccaggcccggaggaggcgcccactttctccccaacgcttttcctggagccgttccagagagaaaagtcagcgtttgttgtcggagttgcaaactcttacatgtggggcggccttgggagaggtgcgtccgatttttcccaatctaggggaccttcttacagatctctctccctttgcatgagcccctcaccccaccccgttatctacccccagggtttggggacctgcgtcttcaggccgcgcgcggaggccgccctggagttgcctgtcacagccacgccctgcgtcccgggcctaaatttggaatcgctaggagcctgagacccgggtggtggggggaagggaaggaaaagttagaaaaaaactttgagccctgaaaatgttcaaaaatactctgtggatgcgggctccgggaatttcagcgcgtgctgtgcgccaagcaacacggggcgcagaaagaaacgtgtgcttaccaaattgtccatctgcggcggtggagaattcggaaaacagaaaaagtgggcagggaagaaagagccacggtcaccctcccacgccctaaaccgggcctatttctaattattactttaatcatgtttttctgtttccctccctttgaaacggaaacggagaccctgccggatgtggtatgttataaattcttttttcatgttataaattcttttttcaatggtcagtgcattttttgctcttcgtatgggcaggcttttaagtagaccggcttgcgggcagtgtggacttcaggacgggccttatcagggctggacgtatttaggaaggagacgcgggaacgcccggccctggggaggacggaggaggcccgatttgtgttgataggatctagctcagcctagagctgcggtgactaggccgggtctctatttttagggaggagttgctaatggatttacaccctctttaaaggggtcccgggtatcctagaaattgtgctttcacttggtagagattagagataatgaagcctgctccgtagaggaaaacttggaggactttccagcctgcaggggaggttccaagcagagcttcctgtttctcccttttcttcctaaatgtccttcttgcgggcaacctgtcaccacggacgggatggctctgtagggttttatcagctgcatttgttccccaggcacctgcagatgaacgggtttttcacttgtctctctgcgaatgcattccttcatccttcatgcctgccttccttcttttgcacctactgtgggcttggggtcagggaaatatatccaagggagtgctggtggcctaagaattcagtttcctggagaacagaggcatctgaacaggcagacgggagacagggccacagggacctttatagttccatcacgaaataactcaggggttcccagtggtaaatcttggtgaggggcttggctggattttgaagccctagggacagatttgccggctggtctggcgttccaggtcattggagcagagtgagtggaaagccttatattctctaagccccaaacaagtcgttgcacagtttttttgtttttgttggtggtggtggttttttttttttggacggagtttcactctgtcaccagtctggagtgtagtggcacgatgtcggctcattggcgttgcacagtttttaaacccacagcagtgttcatctggaactcctgattttggaagcagactgggcttaggaactccagctgctgatgctttgagtaaagggaagagtacctgtctatggggtgggtgggtagggaagagcagtgggataggggcataacaggggccaacctatccttccaattgcagaggagggcctggccgtcagcactgatggatctccttgagggacgcttctcaccccttctttgcagtctgaccctgctagagatggagacagaaacagcctgtcccaataatattaatacacgtttcatcgggaaagttgacttttgagttggtgatgctcagaacacactttcttatagcaacgtgcatcaggctgcaaaaccccgttgagcctgaagtaggttctcagactggtgctgatagctctggcctgatctcagagtgttggggaccctgtgttccttggttccttcataaattctcaggggtacaggtgggatgtggtgagggatggatggacagagggaggtgtatagaggaaaagaggaggcttcagctttgtagagagcaggatgtccccacagggcgacgttggccccgaggagacactttgtgatggttgcagacatttttggttgccaccctggggtgggacatcccaccatcctgcaatgggtggggcagcttagggaagctgctcagaatctttcaagggccaggacggcctccagcacaaagaattcatctggtcccaaatgccagtggtgttgagggtggaaaaccctgaggagggcttgggagttgcatgtatgcgctgattcagggctgcccctgcagttaggagcctgccgtcccgacagtagagtcgcacacatccgatgcatccctgctctctggcaaaggctgatttgccccaccccccggggcaacggcacagcggcctgtgcggtttgaaaaactccaaacatctacggaaccgacatctcttgaacaataccaggcctcttcaggattccctcgccccagtagagcaagtgtgggcttcgttgtttttttttttttttaactctctccagagctcttgtctcctgcccctgtgggtgtgtgtggaagttattaggagaatgtttctgggcagaggaagtgggttttatcatccagcgagtttgccttgattttccatcagcgcgtttggctctggtaaaagttgattgctttgcatttaactccctactttaggccgagcacggtgactcaggcctgtaaatcccagcactttgagaggccgagggccggtgggtcacatgaggccaagagttcgagaccagcctggccaacatggcaaaaccccgactctactaaaaatacaaaaattagccgggcgtggtggtgagcgcctataatcccagctactcaggaggctgaggcaggaaaatcacttcagcccgggaagcagaggttgcagtgagctgagatcgtgtcaccgcattatggcctgggtaacagagagagactcagtctcaaagaaaaaaaaaaacttcctgctttagctctttctcctttctctgtgtatgagacagagttttcatgtaaagacaaatacatgtctttacactttggagatactcaagtaaatgattgtttgtctggaaatcatttttcttcctgaaggtcctatggtgggtacatgctgtcatttagaaagaaatgcagctcatacaatacttttcccaattcagcatttaggaatcatggcgggatttcatggatactgtctggaatgttttcggactcagatatcttcccccggggaaatagacttctcagtagccacgtggaccttgtgctggttttcagtcctgctgaaaatgttctgagcactcttgttactttaggggaaaagaattacgtgtcctttgtgatttatagacacagtaagaaataagacctgtgtgtctctcggggtgcgaaggaggaaaagtcttttttttttgagatggaattttcctctgttgtccaggctggagtgaagtggcacgatctcagctcatggcaatctctccatctcaggttcaagcagttctcctgcctcagcctcccaattagctgggactacaggcatgcactgcatatctggctaatttttgtatgtttagtagagaaggggtttcactatgttgaccaggctgaaaaatatttttttgaggtggggtctctgttgcccagactggagtgcaggggtgcaatcagggctcactacagcctccacctcctgggctcaagcaatccttccacctcagcctctgtagtagctgggactacaagcacacaccactgtgcctggccacttttaaatttttttgtagagacagggtcttgctatgttgcccagactgaaaaaaaagtcttttttttttttttgagacagtgtctcactgtgtcacccaggctggagtgcaatggcaggatcttggctcactgcgacctgtgtctcccgggctcaggcaattctcctgcctcagacacctgaatagctgggaatacaggcacatgtcaccacacctggctattttttgtatttttagtagagacggtgtttcaccctgttggacaggctggcctcaaactcctggcctcaagtgatctgcccaccttggcctcccaaagtgctgggattacaggtgtgagccacctgaaaaatcattgtaaaaatcaactgtcctacattcttatttggaagtgactcctctaaccaaagacagggaaaaacaaaccaaactttattaacatgcgtttttcattgatacatgagagatacctagaaatgggtagttttcaaggaagtggcttggattctagctgctctagtaccctcaacaaagaacagtccatttttagagaattggcagagaaagacaaaggactttgagtcttcaggggcagcaacaaaatggcagagaaaggctggttattgaagcttgttcattctgagtcctgtgttccatgtcccaggcccatgtggattttctgctgtcttccgtgcttcacctctgttctcccagttggggaggtggggttcggattgcttgtgaatgtgggctcatcgttgctggtgtagctgcaggctgcaggctgtccagggcttgaggatttgctgatattctttcttttcttttctttttattttgagatgaagtctcgctctttttccccaggctggagtgcgatggtgcgatctcggctcactgcaacctctgcctcccaggttcaagcaattctcctgtctcagcctcctgagtacctgggattacaggtgcccgccaccacacctggctaatttttgtatttttttagtagaggtggagtttcaccatcttggccaggctggtttcgaactcctgacctcaggtgatccgcccgcctcggcctcctaaagtgtattcttttttgatttattcccagtctcttggctgaaacatggtagctcaccagcatttctactcccatttgtccaactgacggtatcttttcacatctctagagaccagaaggacttcctcttcttgaatttcctgttcagtattctttcttggcttggttccttggtgagttttgaggagatggtgcatgggtgtgtttttcggctttgttttagtatgactcagggttgccaccatgccttgtacggtctcctagtcatagtattaaagtttccgcttagcaggaaaccagaaacttcctttcttctcccccagagtcagattcaaaccagtgtttctcaagtgggctgtgaaagtagcttgcagccacccaccttgcaaagaagaaaattcaacagaggagaggagaaaatgcccacagggtacatggaaagccttgctaaagaagccgcatgggcaaagcttttgttccgctccctctgtcccggtgggctgggctgagatataatatatgtttgtcattgtggacggcagctggatgagtctgaaagcggttgcaaacccctttaattcactttgctttctcaactttgaatggtgtcgtgggctggggtgggtcccctgtttttgagaatcacctgaaagagtctgattttctgcatcttttcggggagtaaagctgttgctccaaagcgctgtttaaaagctgataatagtgtatctggttgagctaacagcccttcttgaggaggcagcagactggccagagggttctgcaggcattactcatcagcgacacctgagtttgcccaggtagcctgactcttgtttgtttctgctttgcctgaccctgcaaaattattgtccaaatgcaccctggcaagcattgatccacgaggggatgctgaccagaaggagctttcgtttctgcacgatggactggaacacgatggactggaatgatgacaagaataaacacactgcattgtcttttagggccaatggacttggaggcatagagattttataactactgccagaacccaaatattgccagtcggcctcttctgctgctgttgctagctgtcttcttctgggggaaatgggttgggttctaaatatgaattaacacagggctgtcttcgatgaattcagcacaaaatgttctcagcaattgaacactcggagagaagtgttaggcatttagtgcagactcatagaatagcaggacagggagggatttggatctgggcaagcaggagatggatatgaacatctgtcttttgagaccgtgccgaggtggcaatgaaggtagaggccccctgtgttgaggtctttactcaagaggctgtggtcctttgggactaacatagcatccgatagacagacaagatggacagctacagccacctatgggaagcggtttctactcttaaaccacaagcccctagacactcatcatatcataaacatatcaccgggcagtggcttgcaatctttttttttctttgtttctttttttttttttttttagacttgcccaggccggagtgcagtggcacgattgtagctcactgcagtcttgacctcctgggtgcaggtgaatctctcacctcagccttccaaggagctgggaccacaggcatgtgccaccctcagctaatttttaaaatctttttgtagaatcggagtctgactacattgcccaggctggtcttgaactcctgggctcaagcaaacctctcgcctcagcttcccaaagtgctggggttacaggcgtgagccaccatgctcagcctgcaatcattttttttgagacaggatctcactctgtcgcccaggctgaagtgcagtggtgtgatctcagctcactgcagcctcgaacccccaggctcaggtgacctgcccaccttagccttctgtgtagttgggactatgggcacatgccaccacactcaattaatttttaccttttttgtagatacagagttttgttctgtcgcccaggctggtggacatattttaatcctacagagtccaggctaaaaacacaccagtaactgtgatgcccatccctcctgcattcctgatttctgagtgatggtttcagacacaaacctgcttgaccaccctccagtagctcttgctgacctagatccgaggttctcagctttggccccattgcgggaagcttggaaacgtcactcttgcccagggttacctgggtagtctggtttatagacgtgttaggtgttttaatttttttttttttttgagacaagattttgctctgtcacccaggctggagtgcagtggtacagtcatagctcactgcagcctcaacctcctgggttcaagcagcccacctacctcagcctcgaaagaagctgggaccacaggtgcacctcaccatacccagctaatcttttctttctttttgtttttttcttttctttcctcttcttttcttttcttttgttttctcttctctcttttctttcttcttcttcttttttttagacagagtcttgctgtgttgcccaggctggagtgccttggtgcaatcttggctcactgcaacttccgcctccctggttcaagtgcctctcttgcctcagcctcctgagtagctggaactacaggcacgcaccaccacgcctggctaatttttgtatttttagtagagacgggatttcactatgttggccaggatggtctcgaactcctgacgtcgtgatctgcccacctcggcttcccaaagtgctgggattacaggtgtgagccaccgcgcccagccttttttttttttttttttttaaattacagagtctcactctgtcaccaggctggagtgcagcgatgcaatcttggctcgctgcaacctctgccacccaggttcaagtgattcttctgcctcagcctccctcaggcgtgagctggcacgcccagccaaatttttcattttttgtagagacagggtctccctatgttgcccagtttagtcctgaactcctgagttcaagccatccacctgccttggcctggcaaagtcttgggtttataggcgggagccactgcatcccgctattaggaatttttaaaaagcccctcggagggtcttcatgtgtggctgagttgtcaagaatcattgttattttactagatattctgtttcttccctcctacatgagatttcccatgaccgcctctcggatgtgaatgtctatgccatggattacatttttcaaagagcattcagtttgttatttcatcttcagcgagcccttaagatatttctcatgggccttttgtagataaagacactggggtcagagagttcaggagcttgctggtgatcacatggtcagcatggggaaaaatgcatgtggacatgagttctgttggtggtgagacgtgggcacaggggttgctgggcttgggagttggtggctgcgtgtgtgggctgaacagagctccccaggcacggccttgtggaccttgagggatgcctgccttcaccactagtgtgacttgaaggggaggagaatgtcctgaatcagtgatgggcattttgatatggaagagaactcccttgaatcctggtggtgaacttagaccagtcactgaggcctctccagctcctcagggtctccgtgttctaggtatccatgtgtccttccatccatttatccatccatttatgcatccatgcatccatccagccatgcatcctccttttatccatccatccatcaacccatcctcccattcatttacccatccatccgttcgtccatccatccatccatcaacccatcctcccattcatttacccatccatccattcatccatgcatccatccatccatgcgtgcatccatccatccatttatccatccatccatccatccatccgtcgtcccattcctttatccatccgttaatgcacctgtccatccatccatccattctccattcatctttccatccatgcatcatccatgcatccatccttttagttcatccagccactcatcaattgatacatccatctgtccaccatccactcatctatccatccattcacccatcctttcatcaatttacccatctaccatccatccatttatccgttcacccattcatctatccatctgtccatccatccacctatctgttcatccatccatccattcatctatccatccatccacctactcacccacccacccatccatccacccacccaaccatccatccacccaaccatccatccatacctccatccgtctacccacccactcatccacttaactacccatccatccacttatccatgcattcatccatccatccacctacctactcacccacctaaactcatctatccactcaaccatccatccacctatccacccttacctccatccatccccttactgcccatctttccactcatcccatccaactacccatccatccacccagctgtccacccaaccatccacccactcactaatttatccactcacccacgcatgcatccatccatccatccatccacccacccatttacccacccacccatccatccacttacctgcctgtccatccaccctcccagtccatggctctttcatgtattccttcagccagcataggttgaagttaaatgtactattggtgctatttgctgtggtccctgttttttgttctctgctttggaggtaacaaccagggcatcaatttgggcataaaagcaccattgtggatggaaggcctggatgtctggaggcacagagcagggactacacttgttcagggggtcagagagagttctcccaggaggggccctccctggacactgagcttccaagaatgagcagaggaaaccaggtgtaaggaagaggaagggcctcttctcagcctggtagacaagcagtaagagtgatgatggggcagctgcagttcatctcagactagaggagctgcaggggccagatggtgggcaacctctgttgccactgctgaggagtgcagatttaagctcccctgaagggtttgacgcagacagctgtgcggggacgcttaacctgcctaaggcccgtctttgggtaacagcatgcagaacaggtgggaggggctggggctatttttggcagagcgtggataagtcagtggagatagaagagaaggcacaagctattttaggagatattgaggaagttaaaatctgtaacaggtccctgcctgcagagttgaccacacgtttgcatcacatgggtaggctttaaaatatagatgcctgcatctcaccttggaaagtttctgatttaattagcctgggcatcaggacttaggaaaaccccacagatgtgtgtaatttgctgctggagttgagaactggggtgcggagctgtgctccttaaactgtaatgtgcttacagatcacctctggtaatacttgtgagaaagcgcttcaggtgggctagggagaggatcacggagggcttcctggagaaggtgacattctcccagggccttgaggggtgaatagacattttccaggttcagaaagaaggaatgggctttcatggccaggtagaggatccaatgaggcagacgaggggcccaaattctgtgaccccctacccctaccccacccccaggatgcccctgtatcagtcccatggtgtaacaaccaaattcacaagatgctgcagaggggaagagattttaaattttctgagaaagacaatgatatattttggacaccatgagaaatactgttattaacttgttttaacctaggtacacgcaatcttcatcattcagtgattctgtatttgtgacttgcctgcttactaaaatgtatttgtcatccccacatcaatattcctggcatttaatttttttattttaaactttcattttaggttcggggatacatgtgaaagtttgtgacttaggtaaacatgtgtcatgaggttttgttgtacagattatttcatcactgtggtattaaacccaggacccaatagttaccctttatgttcttctccttaccctcggctattttgttcatgcacagaacggcaaaaaaattgaactttttttttttattttttttggatggagtctccctctttcgccaaggctggagtgcagtggcgtgatcttggctcactgtaacctccgcctcctgtgttcaagtgattctcctgcctcagcctcccgagtagctgggattacaggcatgggattacagccaccacgcctggctaatttttgtatttttagtagagacggggtttcaccgtgttggccaggctgctctcaaactcctggcctcaagtgattcacccgcctgggcttcccaaaatgctgggattacaggcgtgagccaccacacctggccagaattgagcttctcaatagcacatgttctcagctgaggttcaacaaagccagaccctgccttctcgggccagcgcgtactgtcaacagggttctttgcaaggtctatttggtgtcccgtgttttgtgttttcgtgctttttgtcagtgattttgcgctttcaaatatccccaagtcggtgctgacatgctacctagcgtccctaagtacaggaaagctggcatggtctcacggggaaaatacacatttgatgagcgtcatttaggcacgagttatagtgctgttggcttcgagatcaatgtgagtgactccacaatgtctattcactgcggtgtctttaaacagaaacccacataaaacgcgcttaggtagtgattggttcatgacctctgggaacgtagtcctgtatttacgtgggagcaatagttcactattcgctaattcagtgttcgctgagactttataaaacgtaactgctttgaataacaaagctgtaattaacaaaccgagctgttaagtgtgtgtgtgtgtgtgtgtgtgtgtgtgtgtgtgtgtgtgtgtgttggcctcacatcattttacagagacacacagggctctgtgaactgctaatagttgggaccggcggaggggttatttcaagctagtccaaaactgcagggcagagaccactttgaaaggagatcagcagtcggggagtggctgggatgaagttggaaaaagtgctgaggcccctaagtcagtttccggtgtttccacgttagccttggggggtgatcactcagtttcctgtagggatgggatctgggctggcatctgcctgtggaaggggtgacagggacggagagcagggaaccccgagcagccctgccttgctgttgtctgagcctcagaactcctgaaggcggggtccttcagcatcaccctggagtttgttaaaaatgcaggctcatgagcctcaccccagaccacagaacgaaaatgtctgggggtgagacccaggattccacgtctccccaggtccctcgcagggcgattctgagaactgccggtgtgaggcgtgctcagcccagcccaaacattcacaccattctttggcctcttgtaaaacttggcgtagctcaggggacgttcccagagttatggcacacgaacaaaagaaagtttcccacttcttaccaaacatattgtaaaattacaggaaagagcttgttctttcacgtctatacccttgtgccgtcgtcctagttaggatgaagccgagatgttaccttgtaccttaggccaccgcagacaaggaagtatatgcagtttaaccacctgcatataatctttttcttttttcttttctttctttttttttgagacaaagtctcattctatcacccaggctagtgtgcagtggcacagtctcggctcactgcaacctccatctgccaagttcaagagattcttgtgcctcagcctcccaagtagctggaactacaggtacacgccaccatgcccagctaatttagcagagatggggttttgccttgttggccaggctggtctcgaacccctgacctcagtgatctgcctgcctcaacctcccaaagtgttgggattacaggagtgagccaccatgccctgcctattttttggaggcagggtctctctctgttgcccaggctggagtgccgtggtgcagtgtcagctccctgcaatctcaacctccacaagcgcaggccatcctcccgcctcagcctcccaagtagctgggaccatgggagtgcgtcacaacacctgtctaatttttgcattttttgtagagacggggtttcatcatgttgcccaggctgctgttgaactcctgggctcaagcaatcctcccaccttggcctcccaaagtgttgggattataggcgtgagccactgtacccggccacctatgtataattttcaagctaagaagacagagagacgagtttaactattgctacagacatgaagcccttccctttccatagtttgctagcagagagtgtttccagggcccggcggccactatcacccactgcgttcatagctttccatggggtgaacagattgcgctggactcagcggttaaatctaaagtgtaggatgtttggtgaactcggagttccttgcacttgtctgtgatctggcacattgtgttttctgtactcagatatgcagtcactggcacacatcctgttactgacgggaagctggacccagcactggagtatttctgagactatgacactctggtgtattcctgaaactatttatgacactattaagctcttttctgtaattttacaatatgtttggtaagatctcagcgccagatttttttaaatgatgtgtttatttcttttaattgacaaatacacattgtatgtgtttatgcggttgcacatggtgtcttgatgtatgtatccatggtgagatggatttaaatatgcatgacctcacagactttgcagcacttttttgtgtgtggtgagaacacttattcagaatgggctcctttagtcgttttcaaatattcaagccattgttactaattgcagtcgccatggtgtctctgagctttcctgaagttatttgtcctgtctcatggacgctttgtgccctgtgaccgatcgtctgcccggtgttaaatgacacatcttgaaaaagaggacaatacttccagagcgattcggttttatagcaacagaaaagtaagggtgttttgaccatttgaataaaatagtaaaatgaaatgtatcagctgcctcctgctattcccacacaggaggacttccggtgcttgctccaatgtggaggcattttctcttgcagcattctgagctacaattatctctaggctggggacccttcccgaggccccccaaacctggaatgaaagtttttagggtcagaccatgtgactggttccactcgacctccaaaacgttaaaaagaaaaaaaaaaaaagagccgggcgcggtggctcacgcctgtcatcccagcactttgggaggccgaggcgggcggatcacgagttcaggagatcgagaccatcctggctaccacggtgaaacccagtctctactaaaaatacaaaaaaatcagccgggcgtggtggtgggcacctgtagtcccagctactcgggaggctgaggcagcagaatggtgtgaacccgggaggcatagcttgcagtgagccaaaatcgggccaccgcactccagcctgggtgacacagagacactctgtctcaaaaaaaggaaaaaacaaaaaacaaaaaacgctttgcctttgcttggcatcagaggactcagcagcaagtaaagagcacacacgtgccctctgcaccacctcctcctccttttctacaatgtcctgaaagtttcgtgtttagtgggctttggaaaagggtgtggaaaaccagcaggagcagatgagtactggagtggccagcagcaggtgtgaacaccctggggtgatgctggggctgagtgaattggacatttttcagcagggacacccaggccagtggcgggtcttcatcctcccacccttaatggagatgaacggcattattgagaaagctgcaggcacacacagagcactgcttaaatgatgtccctggctgctgctgttactatgtaatgattgtgttattcttatgaaaatctgaaagttacaggaatcttggaactgcctaattttttttaattaattaattaatttatttcgagacagagtctcactctgtcgcccaggctggagtgcagtggtgcgatctcggctcactgcaacctccacctcccgggttcaagcgattctcctgcctcagcctcccaagtaactgggactacgggcgtgcaccaccacgcctggctcatttttaattttatgtgaaacacctgaatgatgtgatgatggggtttaagataacccaagtgttcgggcgcggcggctcacatctgtaatccctgcactttgggaggccaaggcaggcagatcacttgatgcccggagtttgagaccagcctggccaacatggcgaaactccatctctactaaaaacacaagaattagctggatgtggtggcacatgcccatagtcccagctactggggaagctgaggaaggagaatcacttgaacccaggaggtggaggttgcagtgagttgagatcatgctactgtactctagcctgggcaacagagcaaaactctgcctcaaaagaaaagaaaagaaaagaaaaaaacagcaaaaagagaacccaggtactggctctcctcctgcgtttgccccggttgagtgcattcctgcattagtgcaagccttagtcacgttgcagaggaactcacacaccccatgtggcctcggggacttcactctgggttcgtcctgttttttgagttgcctggctgatgagaaaaagtaaacatggtttgaatcagtagaaagtgtcttgtcagactgactcatgccatctgtcgtccgttccgccttgccctgatgagccattaccctgtcccggaaacatctggagctttgagagggccgggtggaaacagcagtggcagttgggggttctgctgagggtctggtctctttgcaaatttgcagagaggctgaatgccgtaaacgtgcaacacaggcacctgagttctccaccaggctccttctctgagggcatggttgcagctcttgctgggtgggttttgttggtgttttcttcacatttgtagccccggaggtcgttttcaggagcaaaaaggcaagtgggggtgtctgctgtgagcccgcaatttcctgcctaccacctgaaagctcagggaatgtgatgaattgggagatgaatcctaggcaataaagagagcagtggactgagttaggagacgatagcttcatttacagagattcctttactgactgatgatcattgattgggtttgcttccccatgaggcttcaagccaatagcacgtgcatttgcatccatttatatacacctgggggactgccttcctcacacacacctgggggactgcctccctcacacacacctggggaactgcatcccttcacatacatagggaactgtgtccctcacacacctggaagattagcctcagaggtgtctgcagtaccagattccaccagggagtgaacgtctgattatgggtgattcagggtgcccacgtctatatgaaatcgagagcgggtcacctccctttcctccctactctctgtggggtggtgtttggggagctgtcttaagtgttagtcacccgaggagaaaatggtgagggtgggactctgtatctgggagaaaggagaccttggaggcaggggacagactgacagagccttgagcgatggaagctgaggtcgagggcccaaggtcgatgatagaatgcttggggttgtctctcctctggtgtccttgtccttcaggcatcctggagtgacattgaaattgtttcaattaaaaactgtagaaacagcacagagataagaatggaagacaagctccaagtgcggggctgaggcgagttctccaaggactagggctaagggcagagggtgggagaaggggagaagggcgtgaggggcatactgtgtcctttgccacccactctcagacttgttgtcttggacctccgtcggctgagcttggggtccggggagcagtgggtttggacactcagtggtgacgtcagccgtagtcctgaagcagaggggaagttggcaatccaggcttgcctgggggtgacactggtggcgggagggcctgtgccctcccctgtaactgggtttgtgtggggtccatgggggcattggggtcagtggaaggaacatgaagtgagccagagcatcgtcactgtggcctctgagggcaggtggagcaagaaaaggaggaagcttctaagtgacacctggtcccagctcagtggctatgaccagggaagtcatgtggaggaaaaggctggtggactctgagggtgatggaggaggatgggaggggcaagctaggctggggaggtggcaggccatggacacacaccagacagacacacatgtgcatgcacacatacacaggcacatacatgcatgcacactcatgccatgcatatatgcatgcatgcacacgtgtgcacccacacagcaagtcacatgtgcacgtgagcacacatgaaaacacacaagcacatgcacatactcctgcagtgcacatgcacacccatatatgcatgcacacaggtgtgtgctcagatagcaccctcacacatatgcacacaagcacacaggcaaacacgcagacacatgaacaaatgcacatatatattcatgcagtgcacttgtgcacatatacacatgcaaacaggtgtgcattcagcacactcacaatgcacatgaaaacacgtgtgcacacacatgcagtgcaatacatatatgcatgcacatgtgtgcccacaccatacacccacacatacgtgcaggagcacacacgtgcacacacagaaaccacatgaatgcatgagcacgcgtatatgaaatacacatgtacacatgagcacatccacacgcgcacatgcatgaacatagacacacacatgcatgtacatagacacgcacatgcatgtacatagacatgcacacgtatacccaggccctgcattggaaaaaatccaaaatgtggcttggttgcaaagagcacatgaagagctgttgaatgcagaggtgcccagcaagaagcatggacctaaacccgaaggtggttgggggaagcttggggacacctgggtgggcaaatggcccccctgaggcccagggacagatgcaaaaacccagcaagccaggagggtctttgaaaaaaaaaatgtgtaccacatgtgacatttcccatgtgagggaagcatcgagatcatactgtgttttccctgtgccctgcgattttgcagctgacatgccctttctgtggaaatatatagcagtcctcatgctaggattgcgtgttctgtgtcaggcagctgggcatgggagtgcagggtgtggggtggaacctgggaggagagttctagttttaccactgtgttccggccgtggggtgtcctggggaatggaggccacctcctgacactggagtttcctgggttctgctgtgagcgaggagtgggagaagacaagactctggtcttagaaaccttccgagtctcgtacgcccttgactgccgtttctgagtatttcctgaagcttgggaaggatgagtcactttaaggggattgtcctatgttgctttgttttgtttctttagtgacggtgtctatgatcatcttctgtttatgagggtgaaattacagaaataagaagggttacacttaaaataatatctgtactttactttcacgtgtggggtttttttttgtcattgctgctgcttttttttctttaacattctgacagttctgtctgcttattattaagtcttcctacctttctaaagagaatgtctttcttgctaaagaatacattatggactcttggaatctctttgttggggtggagggggtggggacttgccctgacttgctgggaatgcccatagggtttagaagtcacgtctaccgctgaggcactaacaaaggtaagccttcaaggaagcactgtcatttccggggaagagagttttgaggaaattgaaacagttacgaattgatctagcagtccctctactaatgtatctacatatgaagatatgtagagatgactttttttttttttttttttttgagatggagtctccctctgtcacccaggctggagtgcagtggcatgatctctgctcactgcaacctctacttcccggattcaagcgattttcctgcctcagcctcctgagtagctgggattacatgcgcatatcaccacgcctggccaatttttttgtatttatagtagagacggggtttcaccatgttggttgggctggtctcgaactcctgacctcgtgatcctctcaccttggcctcccaaagtgctgagattacaggtgtgagccaccgcacccggccccagagatgacttctaaaccttcagggtattcccagcaagtcagggcaagtctatatatatataatatatatatgtgtatatatatatttgtataaatatataattcgtatatatagtatgtatatatagtatatatagtatgtatgtatatggtgtgtatatatgtagtgtgtgtatacatagtatgtgtatatacagtatgtatgtatatagtatgtgtatatatagtatgtgtgtgtattatatatatatatagtatgtgtatgtgtgtatatatatatatgtttatttgggataaggaaaggaaatcagtatgtcaaagagacactcccctcccatgtttattgcagcaccattcggagtagccaagacatgcagtcaatggaagagcccatcaagggatgaatgcagaaagaaaatgtgctatatcaactctgtacattcactaaaagccattcatttgcacagtgagaataagtgcctttcatgctatgtaaactatgcctcaataaagctattaaatgaacaaagaaaatagggtatattcacaatggaatggtattcagctttaaaaaagaaggaggttggctgggtgcggtggctcatgcctgtcatcctagcactttgggaggctgaggcaggtggatcacctgaggtcaggagttcaagaccagcctggccaacatggtgaaaccccgtctctagtaaaaatacaaaaaattagctgggcatgatgggcgggcgcctatagtcccagctactcaggaggctgaggcaggagaattgcttgaacccaggaggcggaggttgtagtgagccaagatcatcgcactccagcttgggcaacagagtgagactctgtctcaaaaagaaaaaagaaggaagtcctgccatttgcaacaacatggatggaactggaggacatgatgttaagtgcagtaagccgagcacagaaagacaaataccgtctgacccaaacacgcttacgtggaatctaaaaccactgaactcacagaagcagagtggaatggcggtgaccaaggggttgggagtgaggggtgggggaaatggggaaatgatgggtaaagggtacaacatttccatcagataggaagggataagttcaggggtctactgtactcagggtgactgtggttagtaagaatgcgttgcatacttgaaaatgcctaagacagtagctttgaactgtttgcaccacaaataaataggcgaggtaagatgtaaataaagaaaaaaaatacttcaaaaaatacaattacagatttctatggaaacatatgaacatgagtgcatatatatatttatatgtgcgtgtgtctgtacctgccttatggtttattctggatcagtaggatcctcccttgctaccgtctaaagatctgccgcatgctgcaggaggagctgtaattgcatttatgatgtctggcaagtgtcctgttgtggaaacagccatttcagggctctgaggttgtggaaacgactccactctggttgccggcatggggcccacagagctgttccgagcgttttgtctactttctacttattgttgacacacacagaaacacacacgcagccatgagtacacacacacacagacatacaagcagacgtggacacacctacctgtatgtacatactcaaaacacaccttcacactatactcacctacccatacacacacgtgcacacaactacatgtgtgcacacaaacacatgcatacatgcacctatgcatatgcacacgtggaaacacacctgcacactacacacacctacacatacacacacaaacccacaaatgcacacacccacacaggcacaaacacacaaatgcacacacccacacatgcacaaacacacctacacacataaacatattgacacatgcacacatgcacatgaaaaacacatatacacactacatccgcctacacatacacacacaaacccacatatacatgcacctacacacatgcacacataacacctacacacatgcatacagaacccacacatacatgcatccataggcacacagaaacacacctacacactgtgcacacctacatatgcacacacaaacccacatgaacatgcactgacacatatgcacacaaaaaacacactacacacacagaaacccacaaaatacacctccacacttacacaaaacacgcctacacatatgcacatacacaaacccacacatacatgcacctgcctatatgcacccacaacacatacacatatgcacacacagaactcacctacacaccccatacatgcacacaaaacccacaaatacatacatgtgcactgcaaatgcccaaatatacatgcacactcacacacacatacccctgtgacatatgcatgcacgcttcatttatacatgcaggagcatagcctggtcgtttgcacctgttgtggaactggacacacttccggtgttcacagggctcctgcgggttgttcttggacccctcgccacccaccgccaggtgcttcctgacggttgagagatgttgtatgcctttggtgctgaggagtggggacgctggatgttgacgattatcctaactcttcctccagttgaccaaacagtccaagtcgacttttccaaattttcctgaatttggcttttcttcagtgcgccagagatggccagccacgttgaagtagcattgaaattgttgtaattaaagactgtagaaacagggtagcctatcaataattcagcatgccagtttcctcattccgtgggattccatgagatttttttttaatgcataatgcacgtgtctttctgggttgtctagtgtttctactatattttggtttgtaattacaggaaagttgccaataaaaaagggagaattttgttccccatgttgttttcagtacatattcaaaattgttattcatctgtttgaaaggaacgacctgttaagaataatacacaaaatgatcgtgtttttacactattttaatttctactaagcttgaaggtcatcatttatttaaaacctaggctaacatattcttacttttaggcatggaagtgaatatttagaatgagaagagaaatcacgcaccttgtaaatttttttaagttgctgttttaaatatcacaaaaagaaaaatcgcatatcttttttatctctataatattcaaatttatttttatttttcttgtttctaagttgactctttttttctctcttagatggtggtttcgatttatccgatgcccttcctggtgagtatcaacatcattttttaaaatcccgtcaatattttatgttaacatagtatatacaggcatatcccagccatttccagctaggttctagaccaccgcaataacaggagtcatagcaatttttggcttcccagtacatataaatgttatgtttactctcaactgtagtctattaagtatgcaatagcattacctctaaaaacagtatactccaattgaaaataccttattgctaaaaaatgcagatacagagacaggaagtggggcacgtgctgttggaaaaaatgatgccgagagtctggcttgccacagggttgctgcaggccttccgtttgtaaaacacacagtatttgcaaagcaccttaagacaaagtgcagtgaaggaggtccgcctgtatgtgtccacctgccttattataaaaactagactcatagatgacgaggaaaagcaagatgcccttgttaagataaatgaaccaccctggtggaataattcacagtcctgtgatggtcagaggccgagcaaaaacttgccaggtccttggggaggggtctagaggaggtgagcaaatggaggtccccaggagagaggggcatccagtgctggcatcctccctctcgaaatcggcacccgctgtctccatggggccactccttccttcttctgcagctcttcctgtctcccgctcctcacccagagccctcggtgaagggcatgggaaaaggaattgaaggaattccgtcttatcactctatcagcttctgggtcttgtcatccctttgtatttgttttccggggctgccataaaaaggtgccaccaactgggggcttaaaccacagggatttatcatcttccagacctggacaacagaagtctgagatcaaggtgtagacagacccatgctccctctaggggctctaggggagggtccttcctgcctcttgcggcttccgggagctccaggtgtccctggacttgtggccgcatcactccagtctctgcctccttctccgtggggcctcctcctctgtgtctgtgtctccttttctttgtcttacaaggatacttgtcattgggtttagggccactctactccaggattatctaatctcaagatccttctcttaagcacatctgcaaagaccctatttccaaataaagtctcattaccaggttttaggctttaggatgtagatatatcttttgcggggaccactgctcaatccactgcagttatatccagttctttttggtggctctaggggaggatccttcctgcttctcccagcttttgagggcttcacgtgtccctgtgcttgtggctgcatcactgtaggctctgcctttgtgaacgctggtctcttccctgtgtctccatgtatctaaatttccttcctataagggcaccagtcattaggacctatcctaatctattataacctcatcttaactgattacaactgcaaagaccctgtttccaagtaagatcacctattgaggtttggggtgggtgtggatcttggaggaatgcttttcaacccaggacagccctcttcattttttttttttttttttccgagatggagtctctctctgtcacccaggctggagtgcagtggcacgatctcggctcactgcaacctctgcctcccgggttcaagtgattctcctgcctctgcctcccgagtaactgggattacaggcatgcaccaccatgcctagctagtttttgtattttcagtacagacggggtttcataatgttggtcaggctggtttcgaactcctgaccttgtgatctgcccgccttggcctcccaaagtgctgggatgacaggcatgagccactgagcccagccaccctcttcacttttttatgttttacttttttttttctgagacactgtctcgctgtgttgctcaggttggagtgcagtgttgggatcttggctcactgcagccttgaccgtctgggctcaagcagtcctcccacctcagcctgctgagtagctgggactacaggcatgtgccacctcacctggtacagtgagcaacacggggtctcactgtgttgctcagattggagtgccacggtgggatcttgtctcactacagccttgaccatgtgggttcgagcaatcctcccacctcagcctcccaaagtgctgaggcgtgagaggattgcagacacgagccactgcacctcgccagcttttaattttatgtcctgtggtgcagtgcagatggtttgagcggaaacagtgctgatggggatcatctctttcctgaccacctaccccttcttggcccttgggaacaaccattccctgcagtgggaggtgcccttagtcttacagcctccacctgatttgcctgattggcttccattctcagagggggcagcctaggcagaggcctgacggggccaaaagtgtgtttcatatgagaaatgtgaacagcctttcagccatcaatccggtgtctctccttctcatgcatagatctcgggctctgaaaagggcagtttttctcctaactttgccattctcctgccttcctggcttatgtctcagtcatagtcccattcaacgtcaagaagtggagaagggctgggcacggtggctcaagcctgtcatcccagcactttgggaggacgaggtgggtggatcacctgaggtcaggagttcgagaccaacctggccaacgtggtgaaaccccatctctgctaaaaatacaaaaaattagccgggagtgatggcatgcacctgtaagcccagctactcgggaggctgaggcaggagaatcgcttgaacccaggaggcagaggttgtggtgaacggagaccacaccattgcactccagcttgggtaacagagcaagacttggtctcaaaaaaaaaaaaaaaagaagtggagaaggggctcctggtctctgtggaaaccatggccggtagcagcctctgtgtctgtcttctgggctcaagagtcgttgtataaacctcagctcggtgtgggcaggtgagaaaaaacaatgctaaaaacattctccgactgtttccaagaaaatgaaacatccttaaccacaaaagagttgacacttgttttcccagctgcaacttttactaactgaaatatcttatctctttagacaatgaaaacaagaaacccactgcaatccccaagaaacccagtgctggtgagaagggcttcttcctagtatgcaaagaaaaagagcaaatcattttctcggacagcaggacgggacttaggcaactagaaagaagacagaagtgatttgagtgctccggctggagtctggttaatagttaatactggaattgtgttatgatgttacatttcatgtagtgattccagtaaaagaatggttgctgatgtgaaatgtttcggggccatttggacaacatctctgtgtgcttttattctaagggtctgagttactctgtctttagattttcttccctttttttttttttttttttttgagatggcgtttcattcttgtctcccaggctggagtgcagtggtgtgatcttggctcactgcaacctccacctcccgggttcagtgattctcctgcctcagatgcctcagtagctgggactgcaggcaccagccaccacacctggttaattgttgtatttttagtcgagacgaggtttcactatgtcggccaggctggtcttgaactcctgacttcaggcaatctgcctcccaaagtgctgggattacagcggtgagccaccatgcacggcctgtgtctttagatttcaacttcctaggagagagagcatttggtgctgagatctcccccatgatgaccaacaagtgaactcatctctcaacctgtgggcacacacctcatttgttctcagtgcttgctgttctttctttctttttttttttttttttgagacggagtctcgctctgtcgcccaggctggagtgcagtggcgcaatctcggctcactgcaagctccgcttcctgggttcacaccattcttctgcctcagcctcccaagtagctgggactacaggcagcggccaccacgcccagctaatttttttgtatttttagtagagacggggtttcaccatgttagccaggatggtctcgatctcctgaccttgtgatccacgcgccttggcctcccaaagtgctgggattacgggcatgagccaccacacccagccctcaatgctgttctttcaaacaaaagtcagaaacgaggtccacgtgatggaattgcccaagggtcaaccccactggcggataaacagagtaaaaatgatgctaaaacttatggcatcagtgtcttacagctaagacactgtcttgtcttagcacttctgagttttctaatataaaacattaatagctccacttcattattgggcttcctgtctagagtgtcagctcatgagcaaagggaccctgtgtccccagatccttgaactaagcaatcatgcagatagcaccaatgagtaggtgttgagcgtctgaatttatactatcatagtctccttgaggaagggactggaaattcccatatgtcactcaggatggctcagtacatgctgttgggtggatgccagcaaccattcctccatcttagttgggttttcaaaatcattcttcatactagaagacaagatctgaggccatggtgaactgtcacatcagttgcggagcacatatgggttgctagagccatgttttagacaccctctagcctaaatctgatcacagtcatctgtccccttctcttagggtctacctttccaaagttgttagggacctgggaggagaggatgatgggatggggagtcaacaggagaaaatcatgtgcaggcagaattggaatttcaacttggtccaggcaacacaattcatttataaattactttatttctctctctctctccccactgcctctcctctgagagcttctctcctagctttttatctgtctctgtctctctgttttttcctctttttatctgagagaatagtgatgtaaaaatggtcaggaattcactttttctaatgagatcctggtcaagctgatattcagaaaagtatttaggaatgtggggccgtggtgtgtttttgatctgttcacgaggtcattccttcctcgtttctctctggaatttggtattaactgctctttcccctcttttaggggatgactttgacttaggagatgctgttgttgatggagaaaatggtgagtattttcctttaatctcttctgctgctgatctgcttattatcacccaattatgatcatttcagagagaattctcccatttaaattataaagggaaccagttttcacagtggaaacctagggaataggtgtgtcggtttgttcttgctgttgtcgttgggtttttctttacaaccagtacgtgtgcttttattttaaaactcttacagtctttggaaggacatgagacaaatgtgcctaccctggccagggctggcttcaccagcatgtgacctgtgcagtggcacaggaccccatggcatgttggtttggcatgggaaccatactggtttactgctctgttgccgccatcttggaatacttaagaaaatttgaaaaatgggtcccacctttttattttggccctagaaattctgtagctggtgtggacacccgctttaatttttattaaacatagttgacattaagaactgtggctgaaagttgatgggaggaaactggcaggagactgtgtgtgtacaggtatccccaccaggacaaaggccaaggtccaatttctgttcagggaaccatctgtgtgtaaactgatgtttcattttctttactgcaaggcacttaaaattgcaactctcatctttcacaaacagacgacccacgaccaccgaacccacccaaaccgatgccaaatccaaaccccaaccaccctagttcctccggtaagagtctctgaccctgtgggatgtcttcatgttgttcagaattcagcgatatttatgtcagctgagaggaggtgatttcagatgagtgtgtgcttactgttgactgcctgtgcagtgtaatgcccatgttcatgtaatggaaaatgtacatttcaaaaatatatatttagcttggattttatttttagtttgcttttttttttttttttttttttgagacagagtcttgttctgtcacccaggctggagtgcagtggtgccatcttggctcactgcaacctccacctactgggttcaagtgattctcctgcatcagcctcctgagtagctggaattacaggcacacactgccatgcccggctaatttttgtatttttagtagagacagggttttgccatgttggccaggctggtcttgaactcctgacctcaagtgatccacccaccttggcctcccaaaagtgctgggatgacaggtgtgagccactgtgcctggactagtttgctacttttgtttccaagttccatcttatggaacttctaaaaaattgcatacaataatttaaatgtagacttgataaagagaaaagtattggcatacacattccttgtggagaagctagtgtgttttaaatctttctgcccttaaatatttaagtcagtttttctgacatatcacagcattttcagcgtaattcgaatagcaccagttttttttttttagctgaatggttgtcgaaagtttatatgtttaggtttttttgtttacatatttaatttttaacacagaagaatattaatgatgtccatatcttgttgacattttgatggctatttgtgctagtattttatatatcttttttttttcttttttgagacagggtctcactctgttgtccaggctagagtacagtgctgtgatcatattaaacataagagcataccacagcctccaactcctgggctagagagatccccctgcctcagcctttcaagtagctggggctacaggcacacagcatcgtgaccagttagttttttcattttttgtagaggtggggtctcagtatgttgcccaggctggtctgaaactcctggcctcaagcagtcctcttgcctcagcatcccaaatctctgagattacaggcacgagtcacctcacccagcctatatattaatctaaatgaaataaattttaaataaagttccaagtcttttgtttgtactgcattgtaacattactttttgcttactgatagtccatgaacattttttcatgtcatgtaatcatttctatcgtatgagttttactgataatcatgtactattacatactacatatataattatattcttcctgtaactaatccctaattctgaaaatgttatgtttcttctggcattttagaattatgaattaacaaagcaaatctgagtcaactccatgcgctatttttattcctttgaagacatttctagcattcaaatagtttagatcaacgtatatgagtactttcgtagcttttgacctggttgttaatttgctgcagatttttaccaatttattttgatgccaggggtgtgtgcaaatgtccctgtcttcacaccatctccaatattagttatcacctaggaaacctttgcaaatagtgtgaaattttctatcaactttctcctggtttcatgactttacttttaaaattaaaaaaaaaaaacaaacctgcatcaattggccgtggatacttcttattttgtgtattgtatgctttgccttttattcttacattctgatatgacattattgatttataagccttcttcatttatttacagacataaatattgccagcatgcaatattatgctcacgtttttccactttatttatggttttttgttttgttttgttttgagactgagtttagctcttcttgcccaggctggagtgcagtggtgccatcttggctcactgcaacctccacctccagggttcaagtgattctcctgcctcagcctcccgagtagctgggattacatgtgcctgtcaccacatccagctaatttttatattcttagtggagatggggtttcaccatgttgatgaacaggccggttttcatgagtttttcctttattctaagacatgaagacccttggaggagttccaggttgacaggtgatgctgtattttctttcctaggtagcttttcagatgctgaccttgcggatggcgtttcaggtggagaaggtacagttatcttgttttctgtctcttttctctctccatcccatgatgcccacctgctctgtagaatcactacagggtctaaactgtcagctctctgtgaactcacagtgaaatgttcagccatctctgtgggaactccgcctgtttgctgaggcttcaaggatgtgggaagtaaaggctgccccgtagaggttcggtcctcggagaagagttcagggcccaggcagctgccccacttttctgagggacagggcgtgatgaatgggcccttgtcaccacctcctcacccatccgttcacctgtgtgttcttgcaaataactagtgttgtttcagcttcattttattaggctgttttctgtaatttaaggaatgtgaatattaaagccctgagaatagtgataatgcctgggagtatgcgttctcagagtacccctagagtgtaacaggcagcacctcagctctgtagctgtgtaacatgcacccttagagtgtaataggcaggaccccagctctgtagctgggtaacatgtacccccgtagagtgtaagaagcaggaccccagcctcttcacggtcctggctgtgaatttttccttgaccccaaaccttcccattgcagacgttgtttttgtcttgcaggaaaaggaggcagtgatggtggaggcagccacaggaaagaaggggaagagggtaggtgcacctggcttctgtcttcttgtctctcccacgtggtgttgagaaggggaagcagaatgtctgagagctggcggactgcactggcattggcctcctaaagctactggcaggaggcacgggtgttctgtgccaagtgctcccaagtgatgtagctgcagaggtcccccagcaaaccagccctgctccgggtgcccacgtgacgcggattttatgtttggtcacctgcccacgatgccctggctggcgacccgacccctacatcacgcttcgccttgtccttgtgtttacaaaagctcctacactcaccctaacgatcagaggcttgtgacgcagtatcctcggttgcgcttggcccttgagaacgtcagtaaccaggtgggaggtgggaatgtggatcgcttccaccctggctgtaacaggcattgtgttctccatggaagtgccggtgatgtatctcctgtctcctttttcataaccttttcccttagatgggacaagaaaataatgacagacagaattccttttaaaactgtaaagaaaacaaaatgaggtaagaaagagaaacagagaagtagggaggaagaaaaaagggaaggagggaaggaaagaaggaaggagggatggagagaaggaaggaaggagggaagaagggaaggaaggaagggaggaaaagtgggtagtctacccttgttttaggtatttattatttttatgggtacagttcttgaattctaggctttctttgaagaggtagtaatctgtagccctcacctaggactacaaggtcattttttaaaaaatagctaagaaaacacatgtctggcatgtttatctcaggccatcgttcttggccttctagagagttaatgtctactatgtcacttcatcagggaggggtagttaagcttgaaaaatctttctatgacatgactgtgtcctgcacatattaaaaactggccgagtgaacacaccaccgacaggccatgtttggagccagtgtttttgctgaaagtcagacaattctccttccccgtcgtggagggcggagaagattctatctggagaagggtcctctgaagctcacatctggcatttggaatgaataatctcttcaatggccaggcacgctggctcatgcctgtcatcccagaactctgggaggctgaggcgggaggattgcttgaggccaagagttcgaaaccagcctggccaacatggtgaaaccccttttctacaaaaaatacaaaaattaggccaggtgtggtggctcacacctgtaatcctagcacttcgggaggccaaggtgggtggatcacttgaggtcaggagttcgagaccagcctggccaagatggtgaaaccccatctctacaaaaaatacaaaaattagctgggcgtgtgccatgcacctgtagtcctagctactcgggaggcacaagaattgcttgaacccgggaagcagaggctgcagtgagctgaaatcgtgccactgcactccagcctgggtgacaaagtaagactgcatttcaaaaaaaaaaaaaaactagccaggggtggtggcacacacctgtaatcccagctacttgggaggctgaggcaggagaatagcttgaacccgggacgcagaggttgcagtgagccgagatcgcaccactgcactccagcctgggcaacagagcaagactctgtctccccgccaaaaaaaaaagaattattgctggaataacataaaaaaaaaaaaaaaggctgagtgtggtggctcatgcgtgtaatcccagcattttgggaggcctaggcagcaggcaggttgctttaggctgggagttcgagatcagactgggcaacatagcaagaccccaattctataaaaccacagtaattaaccaggcatggtggtgcacacctgtagtcccagctactcggaaggctgaagtgggaggatctcatgagcccaggagtttgagattgcagtgagctgtgattacatcattgcactccagcctgtttgacagagcaagaacccatctcaaaataatacacaataataataattaattaaatagagatagatttaaaatgtctgcattgaaacccaaagctatcttcaaggggtgaaaaaggagcattctaacgatacaaaacgcattggcaaatgccccaagcattgcaggtctttgcttctttatcttctgcccctgcctgggctccttcctccaggtttgatgtccagctctctctttcttttttgttttgttttgttttgagatggtgaattgctctgtcgcccaggctggagtgcagcggcacaatctcggctcactgcaacctctgcctcccaggttcaagcgattctctggactcagcctcctgagtagctgggattaaaggcacccacccttactcccggctaatttttgtatttttcgtagagacgggttttaccatgttgaccaggctggtctcaaactcctgacctcaggcgattcacctgcctcggcctcccaaagtgctgggattacaggcgtgagccaccacgcccagccccagctctctttccatctgtctttgtctttttttgtctctgccttggttctgctgagcttctgcccgtacctcgctggcctctcttcatgtctcttttctcctgctccactccctccatggtctgaccaggtctgcccagcacgtgcgatgggagattgtgccttgctttgccttcctgtgtatcattctcggcatgcttcctttgcaaatcggtcagctcaggcgtctgagatgttctgaggatcttggtgctctcagactgactgtctctgccagccactgccccctgggatcttctctgcaccgtgcgtgtctcaatcacgatgctgtgtgcttcctcctgcagccgacgccccaggcgtgatccccgggattgtgggggctgtcgtggtcgccgtggctggagccatctctagcttcattgcttaccagaaaaagaagctatgcttcaaagaaaatggtaagtctcagtccgccggtgcctctccttcatgccttgctgattggaaaactgtgctttctttaaaaggcagaaaccaaactcgggctggcacgaaacaggtgcacgatggctgatggttcgtgaaactgctaaaattctggaatcgaaccttctggctttgatttcagggctgttctgccttgtgttttgttgtgtgaaagtttacaagttccccactgctgcagtgcttgggttgtttacgtctaccaagtgggaaatggttggtacatatgccgcggaattgttgctggggttagagacagtcctgcaggaaagccgctacaagttaccctgcagagagcaaaggtggaagacacttagctctgatcattcctgccctgttatttacaaccgatgtcatcatcaggaggagagccgtgaccagggggccgccacggtcctttctccactgagagttaagttaaaagccggcacaaggccggacatggtggctcacacctgtaatcccagcactttgggaggccgagacgggcggatcacgaggtcaggaggagatcgagaccatcctgggtaacatggtgaaaccccgtctctactaaaaatacaaaaaattagccgggcatggtggcgggcgtctgtagtcccagctactcggaaggctgaggcaggagaatggtgtgaacctgggaggcagagcttgcagtgagctgagatcatgtgactgcactccagcctgggcgacagagtgagactccgtctcaaaaaacaaaacaaaacaaaaaccagcacagcggattccctttctgttagtaccgaaaacccacaggcacccaggacctgggaagtttcttggatcgggactaaaatttacaggggaattaggaggaggacgtactcaccattgcaatcctcctaggtcagctggcaggctctttgggaccttgtattgggatccgccgtgaagctgggaagtaagccctgctatttggaacacagctaacgtgcatgcatcactgggcacttacatttagctcttgccttccctcttgcatgaccaagcattgtggtttgcaggaatcccatcgaccgggaacagctactcttattttttatttcttgagacagagtttcgctctgttgcccaggctggagtgcagtggcgcaatctcagctcactgcagtctccaccccacaggttcaagtgattctcctgcctcagcctcctgagtagctgggattataggcacccgccaccacgcccggctaatttctgtatttttagtagagatggggtctcaccatgttggccaggctggtctccaactcctcacctcaagtgatccacccgcctcggcctcccaaagtcttgggattacaggcgtgaggcaccacacctggccaacagctactgttttatggaggagcccctggggtccctcacgcctctgggtgtctgaacttctcaccctacttagatcttaagtccttattcattcttggtcactgatgtcattcactcaaagcactgcctcctgaagattttagagggattcctagaacatttgaatagatgctggtgtggacaaagttagactgtaggggtggagtttccccgtaatctcccatcattccagcatttgacatccacaaacattatttagagcgtgaaatggagagtcctaaacagctttcggatctcaagactttaaatgagctgctcgtgtttatttccccgttcttgctgtggggttttgggcagtgcgtggaagacagttgcctcctacctggtgggcagacgagtgggaaatggtgtttggttgtttcttttttttttttttttttttttgagatggagtctcactctgtcacccaggctggaatgcaatggctccatcttggctcactgcaacctccacctcccgggttctcctgcctcagcctcccgagtagctgggattacagatgtgcaccaccacgcacagctaatttttgtttttttagtagagatggagtttcgtcatgttggtcaggctggtctcgaactcctgaccttggatgatccgcctgccttgacctcccaaagtgttgggattgcaggcgtgagccaccgtgcccagctggtgtttggttgattgaatggcagttttgagcgggacccaaatggacagatgaccacattcaaggagatgcctgtaagagacgtacgattagaatcacgttggaaaaaagcaaacagcataacattcttctcccctcttgcttcttctagaagtagcggaggggttaaaacagtagggactcaatggaagggaatttttgtttgcttttcaatgacatttctttttcttttctgaaactgttcaactcacagcataatattcaaccaggaggtaaggaaggcttgtttgccaggacaggatgcgtaatattctagatgttgtatttcaaactctctggcttttttttttttttttttttgagacggagtctcgctctatcgcccagaatggagggcagtggtgcaatcttggctcactgcaacctcgcgggttcaagcaattctcctgcctcagcctccgaagtaactggaattacaggtgtgcatcaccacacccggctaatttttgtatttttagtagagatgggggttcaccatgttggacacactggtctcgaactcgtgacctcaggtggttcccccccgcaatcttggcctcccaaagtgttgggattataggcgtgagtcaaagcacccggcctcttttttagaatcccagacaattgttgaacacttttgcattaaactacaaagtctctgattgatgattctctgaaaatctttaggtcaacccaaattggattcatgagttgcaaaggatgtttattaccttgtgcgtgcagacgtaggaacttttgggatcttgtaagcctatttcatattcacatcctgtattagtccgttttcacactgctatgaagaactgcctaagactggataattcatgaaggaaagaggattcattgattcacagttcagcatggctggggaggcctcaggaaacttaacaatcatggcagaaggggacgcaaggcaccatcccattatcacgagaacagcatgggggaaccttcgctatggttcagtgaccccaacctggtctctccctggacacatggggattatgggaattacaatttaagatgagatttgggtggggacacagaggctcaccatatcacatctgaagacacacaaacttgggaaagcacccaggaggcttaatagacttgattttgtcaaaaattttgaaatagaattgggaaaaggaaaaacaacttttcctctaccttatccgccccgccacccctgggtcttggtcttgggtggaagcattatctttttttattgcaggaggtggggcaggcatgaacaatgaaagctctcactgggtagaaacaattttcctagattcttcaagaacaaaagcaaatatgtcctggcgaggtggccgacacctgtaatcccagtgctttgggagtccaaggaaagaggattgcttgagcccaggagttcaagatcagcctgggcaacatagtgaaacctcatctctacaaaaaatgtaaaaaattagctgggcgtgcttgcgcctgcctgtggtcccaactactctggaggccgaggtgtgaggattgcttgagcccaggaattggaggctgcagtaagccatgattgcaccactgcactccagcctggacgacagacagagaccctgtctctagatataaaaataaaaatacctttttttttttttttgagacggagtctcactctgtcacccaggctggagtgcaatggcgtgatctcggctcactgcagcctctgcctcccgggttcaagcgactctcctgcctcagcttcccgagcagctgggactacaggcgcgtgccaccacgtccagctaatttttcatatttttagtagagacggagttttgccgtgttagccaggatggtcttgatctcctgacctcatgatccacctgccttggcctcccaaagtgctagaattacaggcatgagccaccgtgcccggcccccaaaataattttttttaaaaaagcatcctttctgaagaattggctcaggggagtccaagattcactttatactaatgagatgctaggctaattttcttctaatattttctataagtctcttattctgatgccaaattaacagaaggtccaactttcaattcctggtttgctttctagttatcctgggattgattttcttggccttttgtaaatgcacaaagcaaagggccaaaaagaaaataaaataaagtataacaaagagaagcaagagatggtgaaaccccgtctctactaaaaatacaagaattagctgtgcgtgatggtgggcacctgtaatatcccagctacttgggaggctgaggcagggaattgcttgaacccgggaggcagaggttgcagtgagccaagattgtgccaccacactccagcctggacaacagagtgagactctgtctcaaaaaaaaaaaaaaaaaaagagaaagaaaacaaaaacaaggcactcttctataaataccaagaccctacctcaaaagaggacctttccaactgcatccactcacagcttggtttttatacctgaattataaaatgagtttaatatttatctcagtgacatgattttgttagtagacatggaattgtgatgttggatcgagttatccggaagacgaaagatgtcagagccctcagcctctggggcaggattttgctttatgggttcgatttccgggatggtgattttgagatctggcaaccccataggttcatggggagcttggagatttcataagaaggatgtgagtatagcatgccctggtccttcaagaaaccatgggccaggcgcggtggcttacgcctgtaatcccagcactttgggaggccaaggcgggtggatcacctgaggtcaggagtttgagaccagcctggccaacatggtgaaaccctggctctactaaaaatacaaaaattagccaggcatggtggtgcacacatgtatttccaggtactcgggaggctgaggcaggagaatcgcttgaacccaggaggcagagttgcagtgagccgagatcgagccactgcactccagcctggggacaagagcgagactttgtctcaaaaaagaaaaaagaaaagaaaaaccatgcccagttttggggatactgttattctaccagacaggctcattttccgggactgtgtcattgcattgaaatctgtggtgtttgttaaatttgtattaaaatgagtcccaggcgagtgagtagacataggtgagtcttcggcatctttccaacaaggagatgcctttatcaaatcctgtgacttgatatagatttactgagaagctttgcagtgttatattttggggttcacggattagaaactccttgtggaatcagatggctctgtctgttataggttggtgcaaaaataactgcggtttatgccattaaaagtaatagcaacatagcaagacctcgtgtctacaaaaaacgtaaaaaaaaaaaaattagctgagtgtggtggctcccagctaattttttacctttttttgtagagacagagtcttgctatgttgccattacttttaatggcaaaaaccacaattacttttgcaccagcctccgttcctcccttcctacagatttgagtttgtggtgcttgggcttctcctggtttttgtccatgtgatacgaaggggcctgttgaagctgcttctctcatgcactcggggtctgtgacttcgcatctgggtgtgttggcttcgcgggggacctggctcagaccactaaccacacggagcctgaccacttcccacagagcccagcttccgtggctggcaaggggtgttcaggatgctgtcctttggctgtggtggctggtcctactgctctgtttgccagggtcctgggctcacagtgggtttcttgaggctttggcaagatgggcgattggctctccctgtctccttctttctctttcttcttctctgcctttcttccttccctcctcctttctttccccctccctccttcttttctctcttccttccctgcttttctctttcttcctttgccctcagttctccctctctctctcttttcattctttcttgaactctccctctttcttcctccctccctcccttcttcttttcctccttttcctttttctctcttccttttctctatctcttcctttcttccttctcttttcttcttatgtacctctttcttttttctctcttctttccttccttcctttctttccatccctccctccttctttccttttcccctctccatcccttcctcctttccttccttcctttctttttttcctctctattctttgtctctcttcatccatctctcctgttcttacatgcctcttttcttccttccttctttcttctctccctccttcccttctttccttccttccttcccttcctccttccctctctccttcccttcctccctccctccctcatttccttcctccctgcttcacttcttcctccctcccttcctccatacctccctgcttccttttttccaacctccttccctcctcgttccttccctctttctgccttcctcccttccttcctcccatcccttcttcctgcttccctcctgctctccctgttccctgcctccctccctgccttcctctgtctctcccttcctccactccttaattttggtttccacttcccactctcacactttgagcctctatcccattacttccttgctcagagcagctctttctaacacctccctgctgctgggagccccagcgcacagcaaaagcagacccagcaccagtttactttttgtattattattttttatcgttttcaaccttccatttcagatggctgaagacctaggggtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaacagggcagtgacttccatgttttaatgagttttgtccctaagtccatccctgccaagggaacaaactggggcccagggtggccaccctcttccctgcagtgtcctaggttaagctcactcacgtcctaaggatttgaccttccaggtcatgcatggatttttaaatcttcaacgtttttggccgttgacttgcatttctcactgcacttcctatgaagcagttcttaactctttctgtgatcagtgttccaaacaggtacacaccttggttcctagaaaaacaaaattcatacgttgaggaatcacctaaacatctcctgatcttcacactgtaaggcgtgttgggaattggtgggtggtcaggtccctattcacacatttgagcacggagcctctgcggccgtcttccttggattctctcatatccctgaaaaacacaaattgtacctggattttccttctgtttccaaagtccaccaacttgttcttcaatgtaattgattttaacttgttttctttcttttacttttcttatttttttctttcttttcatttttttcttatttcttttccttctatttattttacttttcttatttgttatatgttatttctttttcttttcttacttttcttcttttttcatttttcttttttaaattggagtctcactctgttgcccaggctggagtgcagtggtgcaatcttggctcactgcagcctccacctcctgggttcaagcgattctcctgcctcagcctcccgagtagctgggactacaggcacacaccaccacacccagctaatttttgtatttttagtagagacggggtttctccatgttggccaggctgatctcgaacttctgacttcaggtgatctgcctgcctcaaccttccaaagtgctgggattacaggtgtgagccactgtgcctggccctttttcttttttctttttttttttctcttatttcttttttcttatttgttttcctttttgctttttctttttatcttatttcttttacttatttttcttttttttacttttatttcttctccgtttttcctcattcttttcctcttatttctttgacttttctgatttctttttttttcttattttcctttttttttcatattccttttaattttttcttacttcttttacttttcttatttgccctcttgtggaaatgaggcacagcctcccttatggttgagccgtagttctagctgagcacggatggtttgatcctcctgtgttggggcactgtatggtgtgagggcacaaaaccttgacccacatgggtctggtcaccttctcacagaggtcacctttacagccccccaactctttgaaggatgtgtcccaaggtgtctcaagtctgatgcaatgaaagctgccccccattgaccacaggactgagtccagaatgtcctgcgtgtttcccagagtgtctgtcctaacaccgcttaaagattagccactgctagacagtgatcctcaggtatatggtctcaggattggccccaagcacacggtgtgtgtgtgtgtataaatatatcttcacaaagcataggtacccattaaagccatattgctttgctgaatggttctaatagctacagatgatttctagcctgaaagaaaagcaccacgaattgtttgaagttgacttgtcagatgtggcatgcttggtctaagttttgacaggaagggtatgtgggtaggggtgtacggagcatctcatgagaccagttctcctcctgagaggtccgtgatgttggaactgttgccccagatggactttgcccttgtgagactttatacttttcaatgcagtttttccctctttaaaactcgccagcttttatgtagtgttttataaaattacaggaataaaaagaatatcttttatgctttttaaccaatgaggggagagggagaaattatttgtcctctgaaatgaatgcaggttttcaatttctagccaggacagtttgctgcaaaatgcacccgtgttgacaacttgtgactggcagaacaaatgacatttgtggtgaacattttcggatcatttcgaatgttcttctcttcagggggttttcctctctttttcttaaatcaaagaatttggccctttatgtgggagtcatttagtggttagggagaacagttgaaactgtggagttcacgtagcgtaaactggcgaggctgtctctgctgctgtcattaaaagttacgctgctggcttggcacggtggttcacacctgtaatcccagcattttgggaggccgaggtgggcagatcacgaagtcaggagatcgagaccatcctggctaacatggtgaaaccccgtctctactaaaaatacaaaaaattagctgggcatggtggcgggcgcctgtagtcccagctactcgggaggctgaggcaagagaatggcgtgaaccctggaggcggaggttgcagtgagccgagatcgcgccactgcgttccagcctgggcgacagagcaagactctgtctcaaaaaaaaaaaaaaaagaaaagaaaaagaaaagttacgctgctgcaccatacaaacgtgttcctttatgaaggcatttgaaccacagatggggccgttttacaaatagcacggtctttgtgagggggaaacgcatggccacagattcgatgagcttctgctgcttccctttgtgttgaaaacgtgggtgttccttcacaccaacactggaaataaataaatacctattgatctgtgcatctcttacgcgtttccaattctgttggcttatgctgtgggtcagaaaagaagcgacaccgacaacatttggggacttgaccctgtttgcattgcggcatgtttgaaacattttttaatggaaatttgggaatagagggccgggcgtggtggctcaggcctgtaatcccagtactttgagaggccgaggtgggcggatcacaaggtcaggagatcaagaccatcctggctaacacggtggaaccccatctctactaaaaatacaaaaaattagccaggcgtggtggtgcatgcctgaaatcccagctactcaggaggctgaggcaggagaattgcttgaacccgggaggcggaggttgcagtgagctgatatcgcgccactgcactccagcctgggcgacagagcgagactctgtctcaaagaaataataataataataaataaataaataaataaataaatttgggaatggaaacaagactgggaaaaaatgctggaggaggaagaaaaccgggtacacaagacgccttggctgtcttgtcctttgatggctggggaagctcttagtgctcggagtcctcactcacctctctgcattctgagggaggtagaaggggggacaggagagccaattcaacctgagaaggatgattggtggaggtgggtaaaggaagaaagtcccctttccctaggtactgaaaagatgctaatctgctgagattctctgtatttatttttatttattttaatttttattttgagacagtcttgctctgtcacccacgctggagtgcagtgccacgatctcagctcactgcaacctccacctcttgggttcaaatgattctcctgtctcagcctcccaagtagcggggactacaggtgcacgccaccacgcccagctaatttttgtatttttaatagagacggggtttcaccatgttggccaggatgggctcgatctcttgacctcgtgatccgcccgcctggcctcccaaagtggtgggattacaggtgtgagccaccatgcccagcctctgcatttatttttatttatttatttttatttttattttgagacagtcttgccctgtcacccaggctggagtgcaatagtgtgatctcggctcactgcaacctccacctcctgggttcaaacgatcctcctgcctcagcctcccgagtagctgggagtataggtgcacgccaccacgcccagttaacttttgtattttttagtagagacggggtttcaccatgttggccaggctggtctcgaactcctgacctcaagtgatccacctgcctcagcctcccaaagtgctgggattacaggcgtgagtcaccacgcccagccgtctgcatttgtttgatgagtttgggggcagttataaataagaatcttattttcacagatgcacgtactttttttttttttatagaaagagcttccatgtgcgtgttcctcagtgtttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagcagaacaaggggaggtggacatggagagccaccggaatgccaacgcagagccagctggtaagaaggacggggaacgatggcttgcacacgtggccagtgttcccattttatcttctccatcctctcccatcttgctgtcctgctcacattctcaaatttggttgcatggctttgaatgtcttcctttatgtctcgttgctttggagggatactttcaaaagacaatgaatgtgtaaacttcctagggcctgggccttcagagaagacctatatgtgcctaagtctctgtttaacaaaatattaaggaagttttcccaggagttcgagaccagcctggccaacatggtgaaaccctgtctgtactaaaaatacaaaattagctgagtgtggtggtgggcgcctgtaatcccagctacttgggaggctgaggcaagagaactgcttgaacctgggaggtagaggttgcagtgagccgagatcgtgccattgcactccagcctgggcgacacagtgagacatgtttcaaaaaaaaaaaaagttccaagtggcacacgattggtgcatagttgggaagtccacagctggctggtgtgcactgggaattaaaagcccatctcctgaaatataactcgttaagttttgctgtcaactttttttttgttgttagagatagggtctcactctgtcgcccaggctggagtgcagtggcacgatcataacttactgcagcctcgatctcctgggctcaagggatcctcccacctcagcctcctgataagctggaaccacaggcgtgcaccaccgtgtccggctgatttgttgttgttttttttttattttgtagagacaaggtctcactaggttgcccagacagggtctcactatgttgcccatcctgagctcaagcaaccctccgacctcagcttcccagagtgctggggttctaggcgtgaactaccgcacccagcctgctatcaccttctaaaaatcctctcaaccaggtggaaaatgtggttaagaagagactttaattcgtgagaaacttctcagggtaaaaggcaggcattttgccatcagaaccacttttgaaaatggcaagaaaaaaatgtgtgtgtgtatatgtgcgtgtatttttttattttgtttgtgcatacattggaaccttctcatttgcctgagagatgcagtgcttatttttaatagcagctgtcaaattgagagggatttttaatgaaatgatttaaaatattttaattttttttctttttgagatggagtgtctctctgtcacccaggctggagtgcagtggtgcgacctctgctcactgcaacccctgcctcccagtgtcaagtgattctccttcctcagccttctgagtagctgagaccacaggcacccgccatcatgccccactaattttctttctgtttttactagagacggggctttcgccatgttggccagagtggtctcgaactcctgacctcaagtgatctgcccaccttggcctcccaaagtgctaggattacaggcatgagccaccgtgcctggcattccattttaaagatagagacttctacaaagttagtgtctcgccagacgcggtggctaatgcctgtagtcccagcactttgggaggctgaggtgggcggatcacctgaggttgggagttcgagaccagcctgaccaacatggagaaaccacgtctctactaaaaattaaaaaaaaaaaaaaaaaaaaaattagccaggcatcgtggcgcatgcctgtaattccagctactcagaaggctgaggcaggagaatcgcttgaacccgggaggcggaggttgtggtgagccaagattgcgccattgcactccagcctgggcaacaagagcaaaactctgtctcaaaaataataataataataataaaagaaagttagtgtcttgttgactgctctttcgagtcagggaaagatgtttagaacaagctatatcttaaagagaaaaggaagattccttctgcccactgcaatgaagttgtctggcttcattagccagtacattggtatatgtgtgtggagccctcgtgacttgaagggcgtggcattccagtgttttctgccaccattgttcttaattccttcttccaaatcccagcttctccctccaaaatagttttaagactgacatgcagaataaagtttccaaaacttaaatgaatggaccagaaaatctcagcccagcatcattgcaaatcaataaaaactgcacactctcatttagaagatttattcttccatttggtaagttataggcatttgttagtgtctctgtgacgtcgttagtggaaattgccttctgctgttttccttctgctttttctgcagcatccattttttttaatgaatggcatcattcaatgaaattgattgaattgattgagatttagggttttgctttctcgtgatgagttttgggcccatttttcttatgcagaaataaaaccactggctcctgaaagttgtaggaactgtgtccacgtgagtgctcagggacctgggaatgactttcttttgtctctgtctcccacagttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 4175 - DNA, 34873 bp, human
ggcgttgggggcgccccgcggggacacccggagcctcctccctgcccggcaggacgcgctgtgcccacgggggcccaggcccggaggaggcgcccactttctccccaacgcttttcctggagccgttccagagagaaaagtcagcgtttgttgtcggagttgcaaactcttacatgtggggcggccttgggagaggtgcgtccgatttttcccaatctaggggaccttcttacagatctctctccctttgcatgagcccctcaccccaccccgttatctacccccagggtttggggacctgcgtcttcaggccgcgcgcggaggccgccctggagttgcctgtcacagccacgccctgcgtcccgggcctaaatttggaatcgctaggagcctgagacccgggtggtggggggaagggaaggaaaagttagaaaaaaactttgagccctgaaaatgttcaaaaatactctgtggatgcgggctccgggaatttcagcgcgtgctgtgcgccaagcaacacggggcgcagaaagaaacgtgtgcttaccaaattgtccatctgcggcggtggagaattcggaaaacagaaaaagtgggcagggaagaaagagccacggtcaccctcccacgccctaaaccgggcctatttctaattattactttaatcatgtttttctgtttccctccctttgaaacggaaacggagaccctgccggatgtggtatgttataaattcttttttcatgttataaattcttttttcaatggtcagtgcattttttgctcttcgtatgggcaggcttttaagtagaccggcttgcgggcagtgtggacttcaggacgggccttatcagggctggacgtatttaggaaggagacgcgggaacgcccggccctggggaggacggaggaggcccgatttgtgttgataggatctagctcagcctagagctgcggtgactaggccgggtctctatttttagggaggagttgctaatggatttacaccctctttaaaggggtcccgggtatcctagaaattgtgctttcacttggtagagattagagataatgaagcctgctccgtagaggaaaacttggaggactttccagcctgcaggggaggttccaagcagagcttcctgtttctcccttttcttcctaaatgtccttcttgcgggcaacctgtcaccacggacgggatggctctgtagggttttatcagctgcatttgttccccaggcacctgcagatgaacgggtttttcacttgtctctctgcgaatgcattccttcatccttcatgcctgccttccttcttttgcacctactgtgggcttggggtcagggaaatatatccaagggagtgctggtggcctaagaattcagtttcctggagaacagaggcatctgaacaggcagacgggagacagggccacagggacctttatagttccatcacgaaataactcaggggttcccagtggtaaatcttggtgaggggcttggctggattttgaagccctagggacagatttgccggctggtctggcgttccaggtcattggagcagagtgagtggaaagccttatattctctaagccccaaacaagtcgttgcacagtttttttgtttttgttggtggtggtggttttttttttttggacggagtttcactctgtcaccagtctggagtgtagtggcacgatgtcggctcattggcgttgcacagtttttaaacccacagcagtgttcatctggaactcctgattttggaagcagactgggcttaggaactccagctgctgatgctttgagtaaagggaagagtacctgtctatggggtgggtgggtagggaagagcagtgggataggggcataacaggggccaacctatccttccaattgcagaggagggcctggccgtcagcactgatggatctccttgagggacgcttctcaccccttctttgcagtctgaccctgctagagatggagacagaaacagcctgtcccaataatattaatacacgtttcatcgggaaagttgacttttgagttggtgatgctcagaacacactttcttatagcaacgtgcatcaggctgcaaaaccccgttgagcctgaagtaggttctcagactggtgctgatagctctggcctgatctcagagtgttggggaccctgtgttccttggttccttcataaattctcaggggtacaggtgggatgtggtgagggatggatggacagagggaggtgtatagaggaaaagaggaggcttcagctttgtagagagcaggatgtccccacagggcgacgttggccccgaggagacactttgtgatggttgcagacatttttggttgccaccctggggtgggacatcccaccatcctgcaatgggtggggcagcttagggaagctgctcagaatctttcaagggccaggacggcctccagcacaaagaattcatctggtcccaaatgccagtggtgttgagggtggaaaaccctgaggagggcttgggagttgcatgtatgcgctgattcagggctgcccctgcagttaggagcctgccgtcccgacagtagagtcgcacacatccgatgcatccctgctctctggcaaaggctgatttgccccaccccccggggcaacggcacagcggcctgtgcggtttgaaaaactccaaacatctacggaaccgacatctcttgaacaataccaggcctcttcaggattccctcgccccagtagagcaagtgtgggcttcgttgtttttttttttttttaactctctccagagctcttgtctcctgcccctgtgggtgtgtgtggaagttattaggagaatgtttctgggcagaggaagtgggttttatcatccagcgagtttgccttgattttccatcagcgcgtttggctctggtaaaagttgattgctttgcatttaactccctactttaggccgagcacggtgactcaggcctgtaaatcccagcactttgagaggccgagggccggtgggtcacatgaggccaagagttcgagaccagcctggccaacatggcaaaaccccgactctactaaaaatacaaaaattagccgggcgtggtggtgagcgcctataatcccagctactcaggaggctgaggcaggaaaatcacttcagcccgggaagcagaggttgcagtgagctgagatcgtgtcaccgcattatggcctgggtaacagagagagactcagtctcaaagaaaaaaaaaaacttcctgctttagctctttctcctttctctgtgtatgagacagagttttcatgtaaagacaaatacatgtctttacactttggagatactcaagtaaatgattgtttgtctggaaatcatttttcttcctgaaggtcctatggtgggtacatgctgtcatttagaaagaaatgcagctcatacaatacttttcccaattcagcatttaggaatcatggcgggatttcatggatactgtctggaatgttttcggactcagatatcttcccccggggaaatagacttctcagtagccacgtggaccttgtgctggttttcagtcctgctgaaaatgttctgagcactcttgttactttaggggaaaagaattacgtgtcctttgtgatttatagacacagtaagaaataagacctgtgtgtctctcggggtgcgaaggaggaaaagtcttttttttttgagatggaattttcctctgttgtccaggctggagtgaagtggcacgatctcagctcatggcaatctctccatctcaggttcaagcagttctcctgcctcagcctcccaattagctgggactacaggcatgcactgcatatctggctaatttttgtatgtttagtagagaaggggtttcactatgttgaccaggctgaaaaatatttttttgaggtggggtctctgttgcccagactggagtgcaggggtgcaatcagggctcactacagcctccacctcctgggctcaagcaatccttccacctcagcctctgtagtagctgggactacaagcacacaccactgtgcctggccacttttaaatttttttgtagagacagggtcttgctatgttgcccagactgaaaaaaaagtcttttttttttttttgagacagtgtctcactgtgtcacccaggctggagtgcaatggcaggatcttggctcactgcgacctgtgtctcccgggctcaggcaattctcctgcctcagacacctgaatagctgggaatacaggcacatgtcaccacacctggctattttttgtatttttagtagagacggtgtttcaccctgttggacaggctggcctcaaactcctggcctcaagtgatctgcccaccttggcctcccaaagtgctgggattacaggtgtgagccacctgaaaaatcattgtaaaaatcaactgtcctacattcttatttggaagtgactcctctaaccaaagacagggaaaaacaaaccaaactttattaacatgcgtttttcattgatacatgagagatacctagaaatgggtagttttcaaggaagtggcttggattctagctgctctagtaccctcaacaaagaacagtccatttttagagaattggcagagaaagacaaaggactttgagtcttcaggggcagcaacaaaatggcagagaaaggctggttattgaagcttgttcattctgagtcctgtgttccatgtcccaggcccatgtggattttctgctgtcttccgtgcttcacctctgttctcccagttggggaggtggggttcggattgcttgtgaatgtgggctcatcgttgctggtgtagctgcaggctgcaggctgtccagggcttgaggatttgctgatattctttcttttcttttctttttattttgagatgaagtctcgctctttttccccaggctggagtgcgatggtgcgatctcggctcactgcaacctctgcctcccaggttcaagcaattctcctgtctcagcctcctgagtacctgggattacaggtgcccgccaccacacctggctaatttttgtatttttttagtagaggtggagtttcaccatcttggccaggctggtttcgaactcctgacctcaggtgatccgcccgcctcggcctcctaaagtgtattcttttttgatttattcccagtctcttggctgaaacatggtagctcaccagcatttctactcccatttgtccaactgacggtatcttttcacatctctagagaccagaaggacttcctcttcttgaatttcctgttcagtattctttcttggcttggttccttggtgagttttgaggagatggtgcatgggtgtgtttttcggctttgttttagtatgactcagggttgccaccatgccttgtacggtctcctagtcatagtattaaagtttccgcttagcaggaaaccagaaacttcctttcttctcccccagagtcagattcaaaccagtgtttctcaagtgggctgtgaaagtagcttgcagccacccaccttgcaaagaagaaaattcaacagaggagaggagaaaatgcccacagggtacatggaaagccttgctaaagaagccgcatgggcaaagcttttgttccgctccctctgtcccggtgggctgggctgagatataatatatgtttgtcattgtggacggcagctggatgagtctgaaagcggttgcaaacccctttaattcactttgctttctcaactttgaatggtgtcgtgggctggggtgggtcccctgtttttgagaatcacctgaaagagtctgattttctgcatcttttcggggagtaaagctgttgctccaaagcgctgtttaaaagctgataatagtgtatctggttgagctaacagcccttcttgaggaggcagcagactggccagagggttctgcaggcattactcatcagcgacacctgagtttgcccaggtagcctgactcttgtttgtttctgctttgcctgaccctgcaaaattattgtccaaatgcaccctggcaagcattgatccacgaggggatgctgaccagaaggagctttcgtttctgcacgatggactggaacacgatggactggaatgatgacaagaataaacacactgcattgtcttttagggccaatggacttggaggcatagagattttataactactgccagaacccaaatattgccagtcggcctcttctgctgctgttgctagctgtcttcttctgggggaaatgggttgggttctaaatatgaattaacacagggctgtcttcgatgaattcagcacaaaatgttctcagcaattgaacactcggagagaagtgttaggcatttagtgcagactcatagaatagcaggacagggagggatttggatctgggcaagcaggagatggatatgaacatctgtcttttgagaccgtgccgaggtggcaatgaaggtagaggccccctgtgttgaggtctttactcaagaggctgtggtcctttgggactaacatagcatccgatagacagacaagatggacagctacagccacctatgggaagcggtttctactcttaaaccacaagcccctagacactcatcatatcataaacatatcaccgggcagtggcttgcaatctttttttttctttgtttctttttttttttttttttagacttgcccaggccggagtgcagtggcacgattgtagctcactgcagtcttgacctcctgggtgcaggtgaatctctcacctcagccttccaaggagctgggaccacaggcatgtgccaccctcagctaatttttaaaatctttttgtagaatcggagtctgactacattgcccaggctggtcttgaactcctgggctcaagcaaacctctcgcctcagcttcccaaagtgctggggttacaggcgtgagccaccatgctcagcctgcaatcattttttttgagacaggatctcactctgtcgcccaggctgaagtgcagtggtgtgatctcagctcactgcagcctcgaacccccaggctcaggtgacctgcccaccttagccttctgtgtagttgggactatgggcacatgccaccacactcaattaatttttaccttttttgtagatacagagttttgttctgtcgcccaggctggtggacatattttaatcctacagagtccaggctaaaaacacaccagtaactgtgatgcccatccctcctgcattcctgatttctgagtgatggtttcagacacaaacctgcttgaccaccctccagtagctcttgctgacctagatccgaggttctcagctttggccccattgcgggaagcttggaaacgtcactcttgcccagggttacctgggtagtctggtttatagacgtgttaggtgttttaatttttttttttttttgagacaagattttgctctgtcacccaggctggagtgcagtggtacagtcatagctcactgcagcctcaacctcctgggttcaagcagcccacctacctcagcctcgaaagaagctgggaccacaggtgcacctcaccatacccagctaatcttttctttctttttgtttttttcttttctttcctcttcttttcttttcttttgttttctcttctctcttttctttcttcttcttcttttttttagacagagtcttgctgtgttgcccaggctggagtgccttggtgcaatcttggctcactgcaacttccgcctccctggttcaagtgcctctcttgcctcagcctcctgagtagctggaactacaggcacgcaccaccacgcctggctaatttttgtatttttagtagagacgggatttcactatgttggccaggatggtctcgaactcctgacgtcgtgatctgcccacctcggcttcccaaagtgctgggattacaggtgtgagccaccgcgcccagccttttttttttttttttttttaaattacagagtctcactctgtcaccaggctggagtgcagcgatgcaatcttggctcgctgcaacctctgccacccaggttcaagtgattcttctgcctcagcctccctcaggcgtgagctggcacgcccagccaaatttttcattttttgtagagacagggtctccctatgttgcccagtttagtcctgaactcctgagttcaagccatccacctgccttggcctggcaaagtcttgggtttataggcgggagccactgcatcccgctattaggaatttttaaaaagcccctcggagggtcttcatgtgtggctgagttgtcaagaatcattgttattttactagatattctgtttcttccctcctacatgagatttcccatgaccgcctctcggatgtgaatgtctatgccatggattacatttttcaaagagcattcagtttgttatttcatcttcagcgagcccttaagatatttctcatgggccttttgtagataaagacactggggtcagagagttcaggagcttgctggtgatcacatggtcagcatggggaaaaatgcatgtggacatgagttctgttggtggtgagacgtgggcacaggggttgctgggcttgggagttggtggctgcgtgtgtgggctgaacagagctccccaggcacggccttgtggaccttgagggatgcctgccttcaccactagtgtgacttgaaggggaggagaatgtcctgaatcagtgatgggcattttgatatggaagagaactcccttgaatcctggtggtgaacttagaccagtcactgaggcctctccagctcctcagggtctccgtgttctaggtatccatgtgtccttccatccatttatccatccatttatgcatccatgcatccatccagccatgcatcctccttttatccatccatccatcaacccatcctcccattcatttacccatccatccgttcgtccatccatccatccatcaacccatcctcccattcatttacccatccatccattcatccatgcatccatccatccatgcgtgcatccatccatccatttatccatccatccatccatccatccgtcgtcccattcctttatccatccgttaatgcacctgtccatccatccatccattctccattcatctttccatccatgcatcatccatgcatccatccttttagttcatccagccactcatcaattgatacatccatctgtccaccatccactcatctatccatccattcacccatcctttcatcaatttacccatctaccatccatccatttatccgttcacccattcatctatccatctgtccatccatccacctatctgttcatccatccatccattcatctatccatccatccacctactcacccacccacccatccatccacccacccaaccatccatccacccaaccatccatccatacctccatccgtctacccacccactcatccacttaactacccatccatccacttatccatgcattcatccatccatccacctacctactcacccacctaaactcatctatccactcaaccatccatccacctatccacccttacctccatccatccccttactgcccatctttccactcatcccatccaactacccatccatccacccagctgtccacccaaccatccacccactcactaatttatccactcacccacgcatgcatccatccatccatccatccacccacccatttacccacccacccatccatccacttacctgcctgtccatccaccctcccagtccatggctctttcatgtattccttcagccagcataggttgaagttaaatgtactattggtgctatttgctgtggtccctgttttttgttctctgctttggaggtaacaaccagggcatcaatttgggcataaaagcaccattgtggatggaaggcctggatgtctggaggcacagagcagggactacacttgttcagggggtcagagagagttctcccaggaggggccctccctggacactgagcttccaagaatgagcagaggaaaccaggtgtaaggaagaggaagggcctcttctcagcctggtagacaagcagtaagagtgatgatggggcagctgcagttcatctcagactagaggagctgcaggggccagatggtgggcaacctctgttgccactgctgaggagtgcagatttaagctcccctgaagggtttgacgcagacagctgtgcggggacgcttaacctgcctaaggcccgtctttgggtaacagcatgcagaacaggtgggaggggctggggctatttttggcagagcgtggataagtcagtggagatagaagagaaggcacaagctattttaggagatattgaggaagttaaaatctgtaacaggtccctgcctgcagagttgaccacacgtttgcatcacatgggtaggctttaaaatatagatgcctgcatctcaccttggaaagtttctgatttaattagcctgggcatcaggacttaggaaaaccccacagatgtgtgtaatttgctgctggagttgagaactggggtgcggagctgtgctccttaaactgtaatgtgcttacagatcacctctggtaatacttgtgagaaagcgcttcaggtgggctagggagaggatcacggagggcttcctggagaaggtgacattctcccagggccttgaggggtgaatagacattttccaggttcagaaagaaggaatgggctttcatggccaggtagaggatccaatgaggcagacgaggggcccaaattctgtgaccccctacccctaccccacccccaggatgcccctgtatcagtcccatggtgtaacaaccaaattcacaagatgctgcagaggggaagagattttaaattttctgagaaagacaatgatatattttggacaccatgagaaatactgttattaacttgttttaacctaggtacacgcaatcttcatcattcagtgattctgtatttgtgacttgcctgcttactaaaatgtatttgtcatccccacatcaatattcctggcatttaatttttttattttaaactttcattttaggttcggggatacatgtgaaagtttgtgacttaggtaaacatgtgtcatgaggttttgttgtacagattatttcatcactgtggtattaaacccaggacccaatagttaccctttatgttcttctccttaccctcggctattttgttcatgcacagaacggcaaaaaaattgaactttttttttttattttttttggatggagtctccctctttcgccaaggctggagtgcagtggcgtgatcttggctcactgtaacctccgcctcctgtgttcaagtgattctcctgcctcagcctcccgagtagctgggattacaggcatgggattacagccaccacgcctggctaatttttgtatttttagtagagacggggtttcaccgtgttggccaggctgctctcaaactcctggcctcaagtgattcacccgcctgggcttcccaaaatgctgggattacaggcgtgagccaccacacctggccagaattgagcttctcaatagcacatgttctcagctgaggttcaacaaagccagaccctgccttctcgggccagcgcgtactgtcaacagggttctttgcaaggtctatttggtgtcccgtgttttgtgttttcgtgctttttgtcagtgattttgcgctttcaaatatccccaagtcggtgctgacatgctacctagcgtccctaagtacaggaaagctggcatggtctcacggggaaaatacacatttgatgagcgtcatttaggcacgagttatagtgctgttggcttcgagatcaatgtgagtgactccacaatgtctattcactgcggtgtctttaaacagaaacccacataaaacgcgcttaggtagtgattggttcatgacctctgggaacgtagtcctgtatttacgtgggagcaatagttcactattcgctaattcagtgttcgctgagactttataaaacgtaactgctttgaataacaaagctgtaattaacaaaccgagctgttaagtgtgtgtgtgtgtgtgtgtgtgtgtgtgtgtgtgtgtgtgtgtgttggcctcacatcattttacagagacacacagggctctgtgaactgctaatagttgggaccggcggaggggttatttcaagctagtccaaaactgcagggcagagaccactttgaaaggagatcagcagtcggggagtggctgggatgaagttggaaaaagtgctgaggcccctaagtcagtttccggtgtttccacgttagccttggggggtgatcactcagtttcctgtagggatgggatctgggctggcatctgcctgtggaaggggtgacagggacggagagcagggaaccccgagcagccctgccttgctgttgtctgagcctcagaactcctgaaggcggggtccttcagcatcaccctggagtttgttaaaaatgcaggctcatgagcctcaccccagaccacagaacgaaaatgtctgggggtgagacccaggattccacgtctccccaggtccctcgcagggcgattctgagaactgccggtgtgaggcgtgctcagcccagcccaaacattcacaccattctttggcctcttgtaaaacttggcgtagctcaggggacgttcccagagttatggcacacgaacaaaagaaagtttcccacttcttaccaaacatattgtaaaattacaggaaagagcttgttctttcacgtctatacccttgtgccgtcgtcctagttaggatgaagccgagatgttaccttgtaccttaggccaccgcagacaaggaagtatatgcagtttaaccacctgcatataatctttttcttttttcttttctttctttttttttgagacaaagtctcattctatcacccaggctagtgtgcagtggcacagtctcggctcactgcaacctccatctgccaagttcaagagattcttgtgcctcagcctcccaagtagctggaactacaggtacacgccaccatgcccagctaatttagcagagatggggttttgccttgttggccaggctggtctcgaacccctgacctcagtgatctgcctgcctcaacctcccaaagtgttgggattacaggagtgagccaccatgccctgcctattttttggaggcagggtctctctctgttgcccaggctggagtgccgtggtgcagtgtcagctccctgcaatctcaacctccacaagcgcaggccatcctcccgcctcagcctcccaagtagctgggaccatgggagtgcgtcacaacacctgtctaatttttgcattttttgtagagacggggtttcatcatgttgcccaggctgctgttgaactcctgggctcaagcaatcctcccaccttggcctcccaaagtgttgggattataggcgtgagccactgtacccggccacctatgtataattttcaagctaagaagacagagagacgagtttaactattgctacagacatgaagcccttccctttccatagtttgctagcagagagtgtttccagggcccggcggccactatcacccactgcgttcatagctttccatggggtgaacagattgcgctggactcagcggttaaatctaaagtgtaggatgtttggtgaactcggagttccttgcacttgtctgtgatctggcacattgtgttttctgtactcagatatgcagtcactggcacacatcctgttactgacgggaagctggacccagcactggagtatttctgagactatgacactctggtgtattcctgaaactatttatgacactattaagctcttttctgtaattttacaatatgtttggtaagatctcagcgccagatttttttaaatgatgtgtttatttcttttaattgacaaatacacattgtatgtgtttatgcggttgcacatggtgtcttgatgtatgtatccatggtgagatggatttaaatatgcatgacctcacagactttgcagcacttttttgtgtgtggtgagaacacttattcagaatgggctcctttagtcgttttcaaatattcaagccattgttactaattgcagtcgccatggtgtctctgagctttcctgaagttatttgtcctgtctcatggacgctttgtgccctgtgaccgatcgtctgcccggtgttaaatgacacatcttgaaaaagaggacaatacttccagagcgattcggttttatagcaacagaaaagtaagggtgttttgaccatttgaataaaatagtaaaatgaaatgtatcagctgcctcctgctattcccacacaggaggacttccggtgcttgctccaatgtggaggcattttctcttgcagcattctgagctacaattatctctaggctggggacccttcccgaggccccccaaacctggaatgaaagtttttagggtcagaccatgtgactggttccactcgacctccaaaacgttaaaaagaaaaaaaaaaaaagagccgggcgcggtggctcacgcctgtcatcccagcactttgggaggccgaggcgggcggatcacgagttcaggagatcgagaccatcctggctaccacggtgaaacccagtctctactaaaaatacaaaaaaatcagccgggcgtggtggtgggcacctgtagtcccagctactcgggaggctgaggcagcagaatggtgtgaacccgggaggcatagcttgcagtgagccaaaatcgggccaccgcactccagcctgggtgacacagagacactctgtctcaaaaaaaggaaaaaacaaaaaacaaaaaacgctttgcctttgcttggcatcagaggactcagcagcaagtaaagagcacacacgtgccctctgcaccacctcctcctccttttctacaatgtcctgaaagtttcgtgtttagtgggctttggaaaagggtgtggaaaaccagcaggagcagatgagtactggagtggccagcagcaggtgtgaacaccctggggtgatgctggggctgagtgaattggacatttttcagcagggacacccaggccagtggcgggtcttcatcctcccacccttaatggagatgaacggcattattgagaaagctgcaggcacacacagagcactgcttaaatgatgtccctggctgctgctgttactatgtaatgattgtgttattcttatgaaaatctgaaagttacaggaatcttggaactgcctaattttttttaattaattaattaatttatttcgagacagagtctcactctgtcgcccaggctggagtgcagtggtgcgatctcggctcactgcaacctccacctcccgggttcaagcgattctcctgcctcagcctcccaagtaactgggactacgggcgtgcaccaccacgcctggctcatttttaattttatgtgaaacacctgaatgatgtgatgatggggtttaagataacccaagtgttcgggcgcggcggctcacatctgtaatccctgcactttgggaggccaaggcaggcagatcacttgatgcccggagtttgagaccagcctggccaacatggcgaaactccatctctactaaaaacacaagaattagctggatgtggtggcacatgcccatagtcccagctactggggaagctgaggaaggagaatcacttgaacccaggaggtggaggttgcagtgagttgagatcatgctactgtactctagcctgggcaacagagcaaaactctgcctcaaaagaaaagaaaagaaaagaaaaaaacagcaaaaagagaacccaggtactggctctcctcctgcgtttgccccggttgagtgcattcctgcattagtgcaagccttagtcacgttgcagaggaactcacacaccccatgtggcctcggggacttcactctgggttcgtcctgttttttgagttgcctggctgatgagaaaaagtaaacatggtttgaatcagtagaaagtgtcttgtcagactgactcatgccatctgtcgtccgttccgccttgccctgatgagccattaccctgtcccggaaacatctggagctttgagagggccgggtggaaacagcagtggcagttgggggttctgctgagggtctggtctctttgcaaatttgcagagaggctgaatgccgtaaacgtgcaacacaggcacctgagttctccaccaggctccttctctgagggcatggttgcagctcttgctgggtgggttttgttggtgttttcttcacatttgtagccccggaggtcgttttcaggagcaaaaaggcaagtgggggtgtctgctgtgagcccgcaatttcctgcctaccacctgaaagctcagggaatgtgatgaattgggagatgaatcctaggcaataaagagagcagtggactgagttaggagacgatagcttcatttacagagattcctttactgactgatgatcattgattgggtttgcttccccatgaggcttcaagccaatagcacgtgcatttgcatccatttatatacacctgggggactgccttcctcacacacacctgggggactgcctccctcacacacacctggggaactgcatcccttcacatacatagggaactgtgtccctcacacacctggaagattagcctcagaggtgtctgcagtaccagattccaccagggagtgaacgtctgattatgggtgattcagggtgcccacgtctatatgaaatcgagagcgggtcacctccctttcctccctactctctgtggggtggtgtttggggagctgtcttaagtgttagtcacccgaggagaaaatggtgagggtgggactctgtatctgggagaaaggagaccttggaggcaggggacagactgacagagccttgagcgatggaagctgaggtcgagggcccaaggtcgatgatagaatgcttggggttgtctctcctctggtgtccttgtccttcaggcatcctggagtgacattgaaattgtttcaattaaaaactgtagaaacagcacagagataagaatggaagacaagctccaagtgcggggctgaggcgagttctccaaggactagggctaagggcagagggtgggagaaggggagaagggcgtgaggggcatactgtgtcctttgccacccactctcagacttgttgtcttggacctccgtcggctgagcttggggtccggggagcagtgggtttggacactcagtggtgacgtcagccgtagtcctgaagcagaggggaagttggcaatccaggcttgcctgggggtgacactggtggcgggagggcctgtgccctcccctgtaactgggtttgtgtggggtccatgggggcattggggtcagtggaaggaacatgaagtgagccagagcatcgtcactgtggcctctgagggcaggtggagcaagaaaaggaggaagcttctaagtgacacctggtcccagctcagtggctatgaccagggaagtcatgtggaggaaaaggctggtggactctgagggtgatggaggaggatgggaggggcaagctaggctggggaggtggcaggccatggacacacaccagacagacacacatgtgcatgcacacatacacaggcacatacatgcatgcacactcatgccatgcatatatgcatgcatgcacacgtgtgcacccacacagcaagtcacatgtgcacgtgagcacacatgaaaacacacaagcacatgcacatactcctgcagtgcacatgcacacccatatatgcatgcacacaggtgtgtgctcagatagcaccctcacacatatgcacacaagcacacaggcaaacacgcagacacatgaacaaatgcacatatatattcatgcagtgcacttgtgcacatatacacatgcaaacaggtgtgcattcagcacactcacaatgcacatgaaaacacgtgtgcacacacatgcagtgcaatacatatatgcatgcacatgtgtgcccacaccatacacccacacatacgtgcaggagcacacacgtgcacacacagaaaccacatgaatgcatgagcacgcgtatatgaaatacacatgtacacatgagcacatccacacgcgcacatgcatgaacatagacacacacatgcatgtacatagacacgcacatgcatgtacatagacatgcacacgtatacccaggccctgcattggaaaaaatccaaaatgtggcttggttgcaaagagcacatgaagagctgttgaatgcagaggtgcccagcaagaagcatggacctaaacccgaaggtggttgggggaagcttggggacacctgggtgggcaaatggcccccctgaggcccagggacagatgcaaaaacccagcaagccaggagggtctttgaaaaaaaaaatgtgtaccacatgtgacatttcccatgtgagggaagcatcgagatcatactgtgttttccctgtgccctgcgattttgcagctgacatgccctttctgtggaaatatatagcagtcctcatgctaggattgcgtgttctgtgtcaggcagctgggcatgggagtgcagggtgtggggtggaacctgggaggagagttctagttttaccactgtgttccggccgtggggtgtcctggggaatggaggccacctcctgacactggagtttcctgggttctgctgtgagcgaggagtgggagaagacaagactctggtcttagaaaccttccgagtctcgtacgcccttgactgccgtttctgagtatttcctgaagcttgggaaggatgagtcactttaaggggattgtcctatgttgctttgttttgtttctttagtgacggtgtctatgatcatcttctgtttatgagggtgaaattacagaaataagaagggttacacttaaaataatatctgtactttactttcacgtgtggggtttttttttgtcattgctgctgcttttttttctttaacattctgacagttctgtctgcttattattaagtcttcctacctttctaaagagaatgtctttcttgctaaagaatacattatggactcttggaatctctttgttggggtggagggggtggggacttgccctgacttgctgggaatgcccatagggtttagaagtcacgtctaccgctgaggcactaacaaaggtaagccttcaaggaagcactgtcatttccggggaagagagttttgaggaaattgaaacagttacgaattgatctagcagtccctctactaatgtatctacatatgaagatatgtagagatgactttttttttttttttttttttgagatggagtctccctctgtcacccaggctggagtgcagtggcatgatctctgctcactgcaacctctacttcccggattcaagcgattttcctgcctcagcctcctgagtagctgggattacatgcgcatatcaccacgcctggccaatttttttgtatttatagtagagacggggtttcaccatgttggttgggctggtctcgaactcctgacctcgtgatcctctcaccttggcctcccaaagtgctgagattacaggtgtgagccaccgcacccggccccagagatgacttctaaaccttcagggtattcccagcaagtcagggcaagtctatatatatataatatatatatgtgtatatatatatttgtataaatatataattcgtatatatagtatgtatatatagtatatatagtatgtatgtatatggtgtgtatatatgtagtgtgtgtatacatagtatgtgtatatacagtatgtatgtatatagtatgtgtatatatagtatgtgtgtgtattatatatatatatagtatgtgtatgtgtgtatatatatatatgtttatttgggataaggaaaggaaatcagtatgtcaaagagacactcccctcccatgtttattgcagcaccattcggagtagccaagacatgcagtcaatggaagagcccatcaagggatgaatgcagaaagaaaatgtgctatatcaactctgtacattcactaaaagccattcatttgcacagtgagaataagtgcctttcatgctatgtaaactatgcctcaataaagctattaaatgaacaaagaaaatagggtatattcacaatggaatggtattcagctttaaaaaagaaggaggttggctgggtgcggtggctcatgcctgtcatcctagcactttgggaggctgaggcaggtggatcacctgaggtcaggagttcaagaccagcctggccaacatggtgaaaccccgtctctagtaaaaatacaaaaaattagctgggcatgatgggcgggcgcctatagtcccagctactcaggaggctgaggcaggagaattgcttgaacccaggaggcggaggttgtagtgagccaagatcatcgcactccagcttgggcaacagagtgagactctgtctcaaaaagaaaaaagaaggaagtcctgccatttgcaacaacatggatggaactggaggacatgatgttaagtgcagtaagccgagcacagaaagacaaataccgtctgacccaaacacgcttacgtggaatctaaaaccactgaactcacagaagcagagtggaatggcggtgaccaaggggttgggagtgaggggtgggggaaatggggaaatgatgggtaaagggtacaacatttccatcagataggaagggataagttcaggggtctactgtactcagggtgactgtggttagtaagaatgcgttgcatacttgaaaatgcctaagacagtagctttgaactgtttgcaccacaaataaataggcgaggtaagatgtaaataaagaaaaaaaatacttcaaaaaatacaattacagatttctatggaaacatatgaacatgagtgcatatatatatttatatgtgcgtgtgtctgtacctgccttatggtttattctggatcagtaggatcctcccttgctaccgtctaaagatctgccgcatgctgcaggaggagctgtaattgcatttatgatgtctggcaagtgtcctgttgtggaaacagccatttcagggctctgaggttgtggaaacgactccactctggttgccggcatggggcccacagagctgttccgagcgttttgtctactttctacttattgttgacacacacagaaacacacacgcagccatgagtacacacacacacagacatacaagcagacgtggacacacctacctgtatgtacatactcaaaacacaccttcacactatactcacctacccatacacacacgtgcacacaactacatgtgtgcacacaaacacatgcatacatgcacctatgcatatgcacacgtggaaacacacctgcacactacacacacctacacatacacacacaaacccacaaatgcacacacccacacaggcacaaacacacaaatgcacacacccacacatgcacaaacacacctacacacataaacatattgacacatgcacacatgcacatgaaaaacacatatacacactacatccgcctacacatacacacacaaacccacatatacatgcacctacacacatgcacacataacacctacacacatgcatacagaacccacacatacatgcatccataggcacacagaaacacacctacacactgtgcacacctacatatgcacacacaaacccacatgaacatgcactgacacatatgcacacaaaaaacacactacacacacagaaacccacaaaatacacctccacacttacacaaaacacgcctacacatatgcacatacacaaacccacacatacatgcacctgcctatatgcacccacaacacatacacatatgcacacacagaactcacctacacaccccatacatgcacacaaaacccacaaatacatacatgtgcactgcaaatgcccaaatatacatgcacactcacacacacatacccctgtgacatatgcatgcacgcttcatttatacatgcaggagcatagcctggtcgtttgcacctgttgtggaactggacacacttccggtgttcacagggctcctgcgggttgttcttggacccctcgccacccaccgccaggtgcttcctgacggttgagagatgttgtatgcctttggtgctgaggagtggggacgctggatgttgacgattatcctaactcttcctccagttgaccaaacagtccaagtcgacttttccaaattttcctgaatttggcttttcttcagtgcgccagagatggccagccacgttgaagtagcattgaaattgttgtaattaaagactgtagaaacagggtagcctatcaataattcagcatgccagtttcctcattccgtgggattccatgagatttttttttaatgcataatgcacgtgtctttctgggttgtctagtgtttctactatattttggtttgtaattacaggaaagttgccaataaaaaagggagaattttgttccccatgttgttttcagtacatattcaaaattgttattcatctgtttgaaaggaacgacctgttaagaataatacacaaaatgatcgtgtttttacactattttaatttctactaagcttgaaggtcatcatttatttaaaacctaggctaacatattcttacttttaggcatggaagtgaatatttagaatgagaagagaaatcacgcaccttgtaaatttttttaagttgctgttttaaatatcacaaaaagaaaaatcgcatatcttttttatctctataatattcaaatttatttttatttttcttgtttctaagttgactctttttttctctcttagatggtggtttcgatttatccgatgcccttcctggtgagtatcaacatcattttttaaaatcccgtcaatattttatgttaacatagtatatacaggcatatcccagccatttccagctaggttctagaccaccgcaataacaggagtcatagcaatttttggcttcccagtacatataaatgttatgtttactctcaactgtagtctattaagtatgcaatagcattacctctaaaaacagtatactccaattgaaaataccttattgctaaaaaatgcagatacagagacaggaagtggggcacgtgctgttggaaaaaatgatgccgagagtctggcttgccacagggttgctgcaggccttccgtttgtaaaacacacagtatttgcaaagcaccttaagacaaagtgcagtgaaggaggtccgcctgtatgtgtccacctgccttattataaaaactagactcatagatgacgaggaaaagcaagatgcccttgttaagataaatgaaccaccctggtggaataattcacagtcctgtgatggtcagaggccgagcaaaaacttgccaggtccttggggaggggtctagaggaggtgagcaaatggaggtccccaggagagaggggcatccagtgctggcatcctccctctcgaaatcggcacccgctgtctccatggggccactccttccttcttctgcagctcttcctgtctcccgctcctcacccagagccctcggtgaagggcatgggaaaaggaattgaaggaattccgtcttatcactctatcagcttctgggtcttgtcatccctttgtatttgttttccggggctgccataaaaaggtgccaccaactgggggcttaaaccacagggatttatcatcttccagacctggacaacagaagtctgagatcaaggtgtagacagacccatgctccctctaggggctctaggggagggtccttcctgcctcttgcggcttccgggagctccaggtgtccctggacttgtggccgcatcactccagtctctgcctccttctccgtggggcctcctcctctgtgtctgtgtctccttttctttgtcttacaaggatacttgtcattgggtttagggccactctactccaggattatctaatctcaagatccttctcttaagcacatctgcaaagaccctatttccaaataaagtctcattaccaggttttaggctttaggatgtagatatatcttttgcggggaccactgctcaatccactgcagttatatccagttctttttggtggctctaggggaggatccttcctgcttctcccagcttttgagggcttcacgtgtccctgtgcttgtggctgcatcactgtaggctctgcctttgtgaacgctggtctcttccctgtgtctccatgtatctaaatttccttcctataagggcaccagtcattaggacctatcctaatctattataacctcatcttaactgattacaactgcaaagaccctgtttccaagtaagatcacctattgaggtttggggtgggtgtggatcttggaggaatgcttttcaacccaggacagccctcttcattttttttttttttttttccgagatggagtctctctctgtcacccaggctggagtgcagtggcacgatctcggctcactgcaacctctgcctcccgggttcaagtgattctcctgcctctgcctcccgagtaactgggattacaggcatgcaccaccatgcctagctagtttttgtattttcagtacagacggggtttcataatgttggtcaggctggtttcgaactcctgaccttgtgatctgcccgccttggcctcccaaagtgctgggatgacaggcatgagccactgagcccagccaccctcttcacttttttatgttttacttttttttttctgagacactgtctcgctgtgttgctcaggttggagtgcagtgttgggatcttggctcactgcagccttgaccgtctgggctcaagcagtcctcccacctcagcctgctgagtagctgggactacaggcatgtgccacctcacctggtacagtgagcaacacggggtctcactgtgttgctcagattggagtgccacggtgggatcttgtctcactacagccttgaccatgtgggttcgagcaatcctcccacctcagcctcccaaagtgctgaggcgtgagaggattgcagacacgagccactgcacctcgccagcttttaattttatgtcctgtggtgcagtgcagatggtttgagcggaaacagtgctgatggggatcatctctttcctgaccacctaccccttcttggcccttgggaacaaccattccctgcagtgggaggtgcccttagtcttacagcctccacctgatttgcctgattggcttccattctcagagggggcagcctaggcagaggcctgacggggccaaaagtgtgtttcatatgagaaatgtgaacagcctttcagccatcaatccggtgtctctccttctcatgcatagatctcgggctctgaaaagggcagtttttctcctaactttgccattctcctgccttcctggcttatgtctcagtcatagtcccattcaacgtcaagaagtggagaagggctgggcacggtggctcaagcctgtcatcccagcactttgggaggacgaggtgggtggatcacctgaggtcaggagttcgagaccaacctggccaacgtggtgaaaccccatctctgctaaaaatacaaaaaattagccgggagtgatggcatgcacctgtaagcccagctactcgggaggctgaggcaggagaatcgcttgaacccaggaggcagaggttgtggtgaacggagaccacaccattgcactccagcttgggtaacagagcaagacttggtctcaaaaaaaaaaaaaaaagaagtggagaaggggctcctggtctctgtggaaaccatggccggtagcagcctctgtgtctgtcttctgggctcaagagtcgttgtataaacctcagctcggtgtgggcaggtgagaaaaaacaatgctaaaaacattctccgactgtttccaagaaaatgaaacatccttaaccacaaaagagttgacacttgttttcccagctgcaacttttactaactgaaatatcttatctctttagacaatgaaaacaagaaacccactgcaatccccaagaaacccagtgctggtgagaagggcttcttcctagtatgcaaagaaaaagagcaaatcattttctcggacagcaggacgggacttaggcaactagaaagaagacagaagtgatttgagtgctccggctggagtctggttaatagttaatactggaattgtgttatgatgttacatttcatgtagtgattccagtaaaagaatggttgctgatgtgaaatgtttcggggccatttggacaacatctctgtgtgcttttattctaagggtctgagttactctgtctttagattttcttccctttttttttttttttttttttgagatggcgtttcattcttgtctcccaggctggagtgcagtggtgtgatcttggctcactgcaacctccacctcccgggttcagtgattctcctgcctcagatgcctcagtagctgggactgcaggcaccagccaccacacctggttaattgttgtatttttagtcgagacgaggtttcactatgtcggccaggctggtcttgaactcctgacttcaggcaatctgcctcccaaagtgctgggattacagcggtgagccaccatgcacggcctgtgtctttagatttcaacttcctaggagagagagcatttggtgctgagatctcccccatgatgaccaacaagtgaactcatctctcaacctgtgggcacacacctcatttgttctcagtgcttgctgttctttctttctttttttttttttttttgagacggagtctcgctctgtcgcccaggctggagtgcagtggcgcaatctcggctcactgcaagctccgcttcctgggttcacaccattcttctgcctcagcctcccaagtagctgggactacaggcagcggccaccacgcccagctaatttttttgtatttttagtagagacggggtttcaccatgttagccaggatggtctcgatctcctgaccttgtgatccacgcgccttggcctcccaaagtgctgggattacgggcatgagccaccacacccagccctcaatgctgttctttcaaacaaaagtcagaaacgaggtccacgtgatggaattgcccaagggtcaaccccactggcggataaacagagtaaaaatgatgctaaaacttatggcatcagtgtcttacagctaagacactgtcttgtcttagcacttctgagttttctaatataaaacattaatagctccacttcattattgggcttcctgtctagagtgtcagctcatgagcaaagggaccctgtgtccccagatccttgaactaagcaatcatgcagatagcaccaatgagtaggtgttgagcgtctgaatttatactatcatagtctccttgaggaagggactggaaattcccatatgtcactcaggatggctcagtacatgctgttgggtggatgccagcaaccattcctccatcttagttgggttttcaaaatcattcttcatactagaagacaagatctgaggccatggtgaactgtcacatcagttgcggagcacatatgggttgctagagccatgttttagacaccctctagcctaaatctgatcacagtcatctgtccccttctcttagggtctacctttccaaagttgttagggacctgggaggagaggatgatgggatggggagtcaacaggagaaaatcatgtgcaggcagaattggaatttcaacttggtccaggcaacacaattcatttataaattactttatttctctctctctctccccactgcctctcctctgagagcttctctcctagctttttatctgtctctgtctctctgttttttcctctttttatctgagagaatagtgatgtaaaaatggtcaggaattcactttttctaatgagatcctggtcaagctgatattcagaaaagtatttaggaatgtggggccgtggtgtgtttttgatctgttcacgaggtcattccttcctcgtttctctctggaatttggtattaactgctctttcccctcttttaggggatgactttgacttaggagatgctgttgttgatggagaaaatggtgagtattttcctttaatctcttctgctgctgatctgcttattatcacccaattatgatcatttcagagagaattctcccatttaaattataaagggaaccagttttcacagtggaaacctagggaataggtgtgtcggtttgttcttgctgttgtcgttgggtttttctttacaaccagtacgtgtgcttttattttaaaactcttacagtctttggaaggacatgagacaaatgtgcctaccctggccagggctggcttcaccagcatgtgacctgtgcagtggcacaggaccccatggcatgttggtttggcatgggaaccatactggtttactgctctgttgccgccatcttggaatacttaagaaaatttgaaaaatgggtcccacctttttattttggccctagaaattctgtagctggtgtggacacccgctttaatttttattaaacatagttgacattaagaactgtggctgaaagttgatgggaggaaactggcaggagactgtgtgtgtacaggtatccccaccaggacaaaggccaaggtccaatttctgttcagggaaccatctgtgtgtaaactgatgtttcattttctttactgcaaggcacttaaaattgcaactctcatctttcacaaacagacgacccacgaccaccgaacccacccaaaccgatgccaaatccaaaccccaaccaccctagttcctccggtaagagtctctgaccctgtgggatgtcttcatgttgttcagaattcagcgatatttatgtcagctgagaggaggtgatttcagatgagtgtgtgcttactgttgactgcctgtgcagtgtaatgcccatgttcatgtaatggaaaatgtacatttcaaaaatatatatttagcttggattttatttttagtttgcttttttttttttttttttttttgagacagagtcttgttctgtcacccaggctggagtgcagtggtgccatcttggctcactgcaacctccacctactgggttcaagtgattctcctgcatcagcctcctgagtagctggaattacaggcacacactgccatgcccggctaatttttgtatttttagtagagacagggttttgccatgttggccaggctggtcttgaactcctgacctcaagtgatccacccaccttggcctcccaaaagtgctgggatgacaggtgtgagccactgtgcctggactagtttgctacttttgtttccaagttccatcttatggaacttctaaaaaattgcatacaataatttaaatgtagacttgataaagagaaaagtattggcatacacattccttgtggagaagctagtgtgttttaaatctttctgcccttaaatatttaagtcagtttttctgacatatcacagcattttcagcgtaattcgaatagcaccagttttttttttttagctgaatggttgtcgaaagtttatatgtttaggtttttttgtttacatatttaatttttaacacagaagaatattaatgatgtccatatcttgttgacattttgatggctatttgtgctagtattttatatatcttttttttttcttttttgagacagggtctcactctgttgtccaggctagagtacagtgctgtgatcatattaaacataagagcataccacagcctccaactcctgggctagagagatccccctgcctcagcctttcaagtagctggggctacaggcacacagcatcgtgaccagttagttttttcattttttgtagaggtggggtctcagtatgttgcccaggctggtctgaaactcctggcctcaagcagtcctcttgcctcagcatcccaaatctctgagattacaggcacgagtcacctcacccagcctatatattaatctaaatgaaataaattttaaataaagttccaagtcttttgtttgtactgcattgtaacattactttttgcttactgatagtccatgaacattttttcatgtcatgtaatcatttctatcgtatgagttttactgataatcatgtactattacatactacatatataattatattcttcctgtaactaatccctaattctgaaaatgttatgtttcttctggcattttagaattatgaattaacaaagcaaatctgagtcaactccatgcgctatttttattcctttgaagacatttctagcattcaaatagtttagatcaacgtatatgagtactttcgtagcttttgacctggttgttaatttgctgcagatttttaccaatttattttgatgccaggggtgtgtgcaaatgtccctgtcttcacaccatctccaatattagttatcacctaggaaacctttgcaaatagtgtgaaattttctatcaactttctcctggtttcatgactttacttttaaaattaaaaaaaaaaaacaaacctgcatcaattggccgtggatacttcttattttgtgtattgtatgctttgccttttattcttacattctgatatgacattattgatttataagccttcttcatttatttacagacataaatattgccagcatgcaatattatgctcacgtttttccactttatttatggttttttgttttgttttgttttgagactgagtttagctcttcttgcccaggctggagtgcagtggtgccatcttggctcactgcaacctccacctccagggttcaagtgattctcctgcctcagcctcccgagtagctgggattacatgtgcctgtcaccacatccagctaatttttatattcttagtggagatggggtttcaccatgttgatgaacaggccggttttcatgagtttttcctttattctaagacatgaagacccttggaggagttccaggttgacaggtgatgctgtattttctttcctaggtagcttttcagatgctgaccttgcggatggcgtttcaggtggagaaggtacagttatcttgttttctgtctcttttctctctccatcccatgatgcccacctgctctgtagaatcactacagggtctaaactgtcagctctctgtgaactcacagtgaaatgttcagccatctctgtgggaactccgcctgtttgctgaggcttcaaggatgtgggaagtaaaggctgccccgtagaggttcggtcctcggagaagagttcagggcccaggcagctgccccacttttctgagggacagggcgtgatgaatgggcccttgtcaccacctcctcacccatccgttcacctgtgtgttcttgcaaataactagtgttgtttcagcttcattttattaggctgttttctgtaatttaaggaatgtgaatattaaagccctgagaatagtgataatgcctgggagtatgcgttctcagagtacccctagagtgtaacaggcagcacctcagctctgtagctgtgtaacatgcacccttagagtgtaataggcaggaccccagctctgtagctgggtaacatgtacccccgtagagtgtaagaagcaggaccccagcctcttcacggtcctggctgtgaatttttccttgaccccaaaccttcccattgcagacgttgtttttgtcttgcaggaaaaggaggcagtgatggtggaggcagccacaggaaagaaggggaagagggtaggtgcacctggcttctgtcttcttgtctctcccacgtggtgttgagaaggggaagcagaatgtctgagagctggcggactgcactggcattggcctcctaaagctactggcaggaggcacgggtgttctgtgccaagtgctcccaagtgatgtagctgcagaggtcccccagcaaaccagccctgctccgggtgcccacgtgacgcggattttatgtttggtcacctgcccacgatgccctggctggcgacccgacccctacatcacgcttcgccttgtccttgtgtttacaaaagctcctacactcaccctaacgatcagaggcttgtgacgcagtatcctcggttgcgcttggcccttgagaacgtcagtaaccaggtgggaggtgggaatgtggatcgcttccaccctggctgtaacaggcattgtgttctccatggaagtgccggtgatgtatctcctgtctcctttttcataaccttttcccttagatgggacaagaaaataatgacagacagaattccttttaaaactgtaaagaaaacaaaatgaggtaagaaagagaaacagagaagtagggaggaagaaaaaagggaaggagggaaggaaagaaggaaggagggatggagagaaggaaggaaggagggaagaagggaaggaaggaagggaggaaaagtgggtagtctacccttgttttaggtatttattatttttatgggtacagttcttgaattctaggctttctttgaagaggtagtaatctgtagccctcacctaggactacaaggtcattttttaaaaaatagctaagaaaacacatgtctggcatgtttatctcaggccatcgttcttggccttctagagagttaatgtctactatgtcacttcatcagggaggggtagttaagcttgaaaaatctttctatgacatgactgtgtcctgcacatattaaaaactggccgagtgaacacaccaccgacaggccatgtttggagccagtgtttttgctgaaagtcagacaattctccttccccgtcgtggagggcggagaagattctatctggagaagggtcctctgaagctcacatctggcatttggaatgaataatctcttcaatggccaggcacgctggctcatgcctgtcatcccagaactctgggaggctgaggcgggaggattgcttgaggccaagagttcgaaaccagcctggccaacatggtgaaaccccttttctacaaaaaatacaaaaattaggccaggtgtggtggctcacacctgtaatcctagcacttcgggaggccaaggtgggtggatcacttgaggtcaggagttcgagaccagcctggccaagatggtgaaaccccatctctacaaaaaatacaaaaattagctgggcgtgtgccatgcacctgtagtcctagctactcgggaggcacaagaattgcttgaacccgggaagcagaggctgcagtgagctgaaatcgtgccactgcactccagcctgggtgacaaagtaagactgcatttcaaaaaaaaaaaaaaactagccaggggtggtggcacacacctgtaatcccagctacttgggaggctgaggcaggagaatagcttgaacccgggacgcagaggttgcagtgagccgagatcgcaccactgcactccagcctgggcaacagagcaagactctgtctccccgccaaaaaaaaaagaattattgctggaataacataaaaaaaaaaaaaaaggctgagtgtggtggctcatgcgtgtaatcccagcattttgggaggcctaggcagcaggcaggttgctttaggctgggagttcgagatcagactgggcaacatagcaagaccccaattctataaaaccacagtaattaaccaggcatggtggtgcacacctgtagtcccagctactcggaaggctgaagtgggaggatctcatgagcccaggagtttgagattgcagtgagctgtgattacatcattgcactccagcctgtttgacagagcaagaacccatctcaaaataatacacaataataataattaattaaatagagatagatttaaaatgtctgcattgaaacccaaagctatcttcaaggggtgaaaaaggagcattctaacgatacaaaacgcattggcaaatgccccaagcattgcaggtctttgcttctttatcttctgcccctgcctgggctccttcctccaggtttgatgtccagctctctctttcttttttgttttgttttgttttgagatggtgaattgctctgtcgcccaggctggagtgcagcggcacaatctcggctcactgcaacctctgcctcccaggttcaagcgattctctggactcagcctcctgagtagctgggattaaaggcacccacccttactcccggctaatttttgtatttttcgtagagacgggttttaccatgttgaccaggctggtctcaaactcctgacctcaggcgattcacctgcctcggcctcccaaagtgctgggattacaggcgtgagccaccacgcccagccccagctctctttccatctgtctttgtctttttttgtctctgccttggttctgctgagcttctgcccgtacctcgctggcctctcttcatgtctcttttctcctgctccactccctccatggtctgaccaggtctgcccagcacgtgcgatgggagattgtgccttgctttgccttcctgtgtatcattctcggcatgcttcctttgcaaatcggtcagctcaggcgtctgagatgttctgaggatcttggtgctctcagactgactgtctctgccagccactgccccctgggatcttctctgcaccgtgcgtgtctcaatcacgatgctgtgtgcttcctcctgcagccgacgccccaggcgtgatccccgggattgtgggggctgtcgtggtcgccgtggctggagccatctctagcttcattgcttaccagaaaaagaagctatgcttcaaagaaaatg

SEQ ID NO: 4176 - DNA, 64446 bp, human; identical to SEQ ID NO: 2913

SEQ ID NO: 4177 - DNA, 62350 bp, human; identical to SEQ ID NO: 2914

SEQ ID NO: 4178 - DNA, 63877 bp, human; identical to SEQ ID NO: 2915

SEQ ID NO: 4179 - DNA, 22700 bp, human; identical to SEQ ID NO: 2916

SEQ ID NO: 4180 - DNA, 62496 bp, human; identical to SEQ ID NO: 2917

SEQ ID NO: 4181 - DNA, 59291 bp, human; identical to SEQ ID NO: 2918

SEQ ID NO: 4182 - DNA, 13842 bp, human
ttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaata

SEQ ID NO: 4183 - DNA, 64446 bp, human; identical to SEQ ID NO: 2913

SEQ ID NO: 4184 - DNA, 62350 bp, human; identical to SEQ ID NO: 2914

SEQ ID NO: 4185 - DNA, 63877 bp, human; identical to SEQ ID NO: 2915

SEQ ID NO: 4186 - DNA, 62496 bp, human; identical to SEQ ID NO: 2917

SEQ ID NO: 4187 - DNA, 59291 bp, human; identical to SEQ ID NO: 2918

SEQ ID NO: 4188 - DNA, 13842 bp, human; identical to SEQ ID NO: 4182

SEQ ID NO: 4189 - DNA, 64446 bp, human; identical to SEQ ID NO: 2913

SEQ ID NO: 4190 - DNA, 62350 bp, human; identical to SEQ ID NO: 2914

SEQ ID NO: 4191 - DNA, 63877 bp, human; identical to SEQ ID NO: 2915

SEQ ID NO: 4192 - DNA, 62496 bp, human; identical to SEQ ID NO: 2917

SEQ ID NO: 4193 - DNA, 59291 bp, human; identical to SEQ ID NO: 2918

SEQ ID NO: 4194 - DNA, 13842 bp, human; identical to SEQ ID NO: 4182

SEQ ID NO: 4195 - DNA, 64446 bp, human; identical to SEQ ID NO: 2913

SEQ ID NO: 4196 - DNA, 62350 bp, human; identical to SEQ ID NO: 2914

SEQ ID NO: 4197 - DNA, 63877 bp, human; identical to SEQ ID NO: 2915

SEQ ID NO: 4198 - DNA, 62496 bp, human; identical to SEQ ID NO: 2917

SEQ ID NO: 4199 - DNA, 59291 bp, human; identical to SEQ ID NO: 2918

SEQ ID NO: 4200 - DNA, 54095 bp, human
tgaggccaaggcaggaggattctttgaggccaggagttcaaaaccagcctgggcaatatagggagaccttgtctctacaaaaaaatagaaaataaagaaattacccaggtgcagtggtgcatgcctgtagttccagccactccagaggctgagactggaggatctttcgagcttaggaggctgaggctgcagcgagctcttatcacaccagtgcactccaacttgggtgacagaatgagaccctgtctctaaaagaaaaagaaaaaaagagattagtaaattctttagaaaccaagattttaccatgagcagttgcatgaaggtggaaaacctttctgtgattataagtagggattctgaaagaagtcctcaaagtgaatacttattccatggagaaacagaatgaattgagagagtcctggaagctgggaggagaggaatctgtagaaagcagagtcacttaactaattcaccaatgagactgcaaaccgatggtcatggagctgccatgggaatctgaattacagtcacttttattctttgtattttattgtttggattgaaaatgcggccaggcacggtggctcatgcttgtaatcccagcactttgggaggctggggtgggtggatcacctgagatcaggagtttgagaccagcctgaccaacatggtgaaaccccgtctctactaaaaatacaaaaattgggattccattccaagatggccaaatagaaacagctccggtctacagctcccagcgtgatcaacacagaaaacgggtgatttctgcatttccaactgaggtatcttgttcatctaattgggactggttggacagtgggtgcagcccacagagggcaagccgaaacagggcagggcattgcctcacctgggaagtgtcagaggatttccctttcctagccaaggaagctgtgacagactgtacctggaaaactgggacactctcgcccacatactgcacttttccaatggtcttagcaaagagcacaccaggagattatatcctgcacctggctcggcagttcccactcccacagagccttgctcactgctagcacagcagtctgagattgaactgtgaggcagcagcctggctgggggggtgggcatccaacattgctgaggcttgagtaggtaaacaatgtggccagggaagctcgaactgggcagagcccactgcagctcagcaaggcctactgcctctgtagattccacctctgggggcagggtatagctgaacaaaaggcagcagaaacttctgcagacttaaacgtccctgtctgacagctctgaagagagcagtggtgctcccagcatggtgtttgaggtcttagaatggacagactgcctcctcaagtgggtccctgacccccttgtagcctaactgggagacacctcccagtaggggccaactgacaactcatacaggtggtgcccctctgggacaaagcttccagaggaaggatcaggcagcaatatttgctgttctgcaatatttgctgttctgcagcctccactggtgatatccaggcaaacagggtctggagtggacctccagcaaactccaacagacctgcaggtgagggatctgactgtcagaaggaaaactaacaaacagaaaggaatagcatcaacatcaacaaaaaggacatctacaccaaaactccatctgtaggtcaccagcatcaaagacaaaaggtaggtaaaaccacaaagatggagagaaaccagagcagaaaagctgaaaattctaaaaaccagagtgcctcttctcctccaaagggttgcagctcctcacgagcaacggaagaaagctggatggagaatgactttgacgagctgacagaagtaggcttcagaaggtcggtaataacaaacttctccgagctaaaggaaatgttcaaacccatcgcaaggacgctaaaaaccttgaaaaaagattagacgaacagctaactagaataaatagtgtagagaagaccttaaatgacctgacggagctgaaaaccacagcataagagctacgtgatgcatgcccaagcttcaatagccgattcaatcaagtggaagaaagggtatcagtgattgaagatcaaatgaatgaaataaagtgataagagaagtttagagaaaaaagagtaaaaagaaatgaacaaagcctccaagagatatgggactatgtgaaaagaccaaatctacatctgattggtgtacctgaaagtgacagggagaatggaaccaagttggaaaacactcatcaggatattatccaggagaacttccccaacctagcaaggcaggccaacattcaaattcaggaaatatagagaaagccacaaagatactcctcgagaagacacataattgtcagattcaccaaagttgaaatgaaggaaaaaatgttaagggcagccagagagaaaggtcgggttacccacaaagggaagcccatcagactaacagtggatctctcggcagaaactctacaagccagaagagagtgggggccaatgttcaacattcttaaagaaaagaattttcaatccagaatttcatatccagccatactaagcttcacaagtgaaggagaaataaaatcctttacagacaagcaaatgctgagagattttgtcaccaccaggcctgccctacgagagctcctggaggaagcactaaacatggaaaggaacaaccagtaccagccactgcaaaaacatgccaaattgtaaagaccatcgatgctaggaagaaactgcatcaactaacgagcaaaataaccagctaacatcataatgacaggatcaaattcacacctaacaatattaaccttaaatgtaaatgggttaactgccctgattaaaagacacagactggcaaattggatagagtcaagacccaacagtgtgctgtattcaggagacccatctcatgtgcagagacacatgtaggctcaaaataaagggatggaggaagatctaccaagcaaatggaaagcaaaaaaaaagcagaggttacaatcctagtctctgataaaacagactttaaaccaacagagatcaaaagagagaaagaaggccgttacataatggtaaagggatcaattcaacaagaagacctaactatcctaaatatatatgcacccaatacaggagcacccagattcataaagggagtccttagagacctacaaagagacttagacttccacacaataataatgggagactttaacaccccactgtcaatattagacagatcaacgagacagaaggttaacaaggatatccagtacttgaattcagctctgcaccaagtggacctaatagacatctacagaactctccaccccaaatcaacagaatatacattcttctcagcaccacatcacacttattcaaaaattgaccacatagttggaagtaaagcactcctcagcaaatgtaaaagaacagaaatcacaacaaactgtctctcagaccacagtgcaatcaaattagaactcaggattaagaaactcactcaaaactgctcaactacatggaaactgaacaacctgctcctgaatgactactgggtaaataacgaaatgaaggcagaaataaatatgttctttgaaaccaatgagaacaaagacacaacataccagaatctctgggacacatttaaaacagtgtgtagagggaaatttatagcactaaatgcccacagaagaaagcaggaaatatctaaaatcaacaccctaacatcacaatgaaaagaactagagaagcaagagcaaacacattcaaaagctagcagaaggcaagaaataactaagatcagggcagagctgaaggagatagagacacaaaaaacccttcaaaaaaatcaatgaatccaggagttggttttttgaaaagatcaacaaaattgataggccgctaacaacactaataaagaagaaaagagagaagaatcaaatagatgcaataaaaaatgataaaggggatatcaccaccaatcccacagaaatacaaactaccatgagagaatactataaacacctctatgcaaatgaactagaaaatctagaagaaatggataaatttctggacacatacaccctcccaagactaaaccaggaagaaattgaacctctgaatagaccaataacaggctctgaaattgaggcaataattaatagcctaccaaccaaaaaaagtccaggaccagatggattcacagccaaattctaccagaggtacaaagaggagctggtaccattacttctgaaactattccaatcaatagaaaaagagggaatcctccctaactcattttatgaggccaacatcatcctgataccaaagcctggcagagacacaacaaaaaaagagaattttagatcaatatccctgatgaacatcagtgcaaaaatcctcaataaaatactggcaaaccaaatccagcagcacatcgaaaagcttatccatcatggtcaagttggcttcatccctgggatgcaaggctggttcaacatatgcaaatcagtaaacataatccatcacataaacagaaccatcaacaaaaaccacatgattatctcaatagatgcagaaaaggcctttgataaaattcagcagcccttcatgctaaaaactctcaataaactaggtattgatgggacgtatctcaaaataataagagctatttatgacaaactcacagccaatatcatactgaatgggcaaaaactggaagcattccctttgaaaactggcacaagacagggatgctctctttcaccactcctattcaacatagtgttggaagttctggtcagggcaatcaggcaagagaaagaaagaaagggttttcaattaggaaaagaggaagtcgaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcctgtacaccaataacagacaaacagacagccaaatcatgagtgaactcccattcacaattgctacaaagagaataaaatacctaggaatccaacttacaagggatgtgaaggacctcttcaaggagaactacaaaccactgctcaacgaaataaaatgacacaaacaaatggaagaacattccatgctcatggataggaagaatcaatattgtgaaaatggccatactgcccaaggtaatttatagattcaatgtcatctccatcaagctaccaatgactttcttcacagaattgggaaaaacgactttaaagttcatatggaaccaaaaaagagcccagattgccaggtcaatcctaagcaaaaagaacaaagccggaggcaccatgctacctgacttcaaactatactacaaggctacagtaaccaaaacagcatggtactcataccaaaacagagatatagaccaatggaacagaacagaggcctcagaaataacaccatacatctaccaccatctgatctttgacaaacctgacaaaaaccagaaatggggaaaagattccctatttaataaatggtgctgggaaaactggctagtcatatgtagaaagttgaaactggatcccttccttacactttatacaaaattaattcaagatggattaaagacttacatgttagacctaaaccataaaaaccctagaagaaaacctaggcaataccattcaggacataggcatgggcaaggacttcatgactaaaacaacaaaagcaatggcaacaaaagccaaaatagacaaatgggatctaattaaactaaagagcttctgcacagcaaaagaaactaccatcagagtgaacaggcaacctacagaatgggagaaaatttttgcagtgtacccatctgacaaagggctaatatccaaaatctacaaagaacataaacaaatttacaagaaaaaaacaaacaaccccatcaaaaagtgggcaaaggatatgaacagacacttctcaaaagaagacatttatgcagccaaaagacacatgaaaaaatgctcaccatcactggccatcagagaaatgcaaatcaaaaccacactgagataccatctcacaccagttagaatggcgatcattaaaaagtcaggaaacaacagatcctggagaggatgtggagaaataggaacacttttacactgttggcgggagtgtaaactagttcaaccattgtggaagacagtgtggcaattcctcaaggatctagagctagcaataccatttgacccagtaatcccattactgggtatatacccaaagcattataaatcatgctgctatcaagacatatgcacactattcacaatagcaaagacttggaaccaacccaaatgtccatcaatgatagactggattaagaaaacctggcacatagacaccatggaatactatgcagccataaaaaatgataagttaatgtcctttgcagggacatggatgaagctggaaaccatcattctgagcaaactatcacaaggacagaaaaccaaacactgcatgttctcactcataggtggtaattgaacaatgagaacacttggacacagggtgggggacatcacacaccgggcctgttgtggggtggggggttgggggagggatagcattgggagagatacctaatgtaaatgacgggttgatggatgcagcgggccagcatggcacatgtatacctatgtaacgagcctgcatgttgtgcacatgtaccctagaacttaaagtataataaaaataaataaataaataaataaataaataaaataaaatcaggagaaaaaaaattggccagtcatggtggcaggtgcctgtaattccagctactcaggaggccgagacaggaaaatcgtttaagaccaggaggcagagattttagtgagctgaaattgtgctgctgcactccagcttcggcaacagagtgagactctgtctcaaaaaaaaaaaaaaatgcacatgccctttatatgtaaattttcattttagggaataagttcacatcttcttaacatatattattttggtgtttttagacaattccagttcaaaattcctctccaggtacatttacctgaagaaatctgcatctctggtctaatgcaagatctggtttccaggctgggcgcagtgactctcgcctataatcccagcactttgggaggccgagatgggaggattgcttgagcccaggagtttgagaccagcctgggcaacatagtgagattatgtaaaaatacaaaaattatccatggactagtgggtgcctgtagtcccagctattcgggaggctgaagcaggaggatcactcgagcctggaagtcgaggctgcagtgagctgtgatcaccataattttactccagcctgggtaacagagagacaaccagtctcataaacaaaacaaaacaaaatctggtttctagagtttatagaatcatacaacagcatgtttcatggagcgttccatctcacaaggtggtgtttggtttagagagggttatgtatgccctctgatattctcaaatctttatttaaaatgctgggagagttgctatctggctttgcatcagtgtttaatataatagccatccttttggggtgggtgttgacgaacagcacacctgccatcttccaaattataccccacactttgtcttgttgaatattattaagatataaagacagggaagaccttccatttccctcccacgtccccaccacctttagttgggagcacagatgtccctgaggcactgctatagaccatgaggtcaccgcaacacaagggacatcaaatgggattgctctggctcaaaacagccagtcttaattctggtgcgatgaatggctttggtggtcgtcccagataagaacattcagcgtcagcaagaaaggctgtaggtatttggctgaatgtaatgttttgttgttgatgtgctgttgtttttcttttcctgggtgtgtagtaggagttgcaaatgcgggctgcagattagcaacgggaaccatctgggtgagcctagcagggaccagccctcccatgggagagagaggtgacacggagcagctgatgctttcgtaatgattcgaggcagctgccaaaagaggcagagcctttgcagaacagcctgtctgttctgctcctagacattagagagataatacggctgataggtgagttggggaaggcttgtttggacacattttctcagccttttttttttttttttaacctctggtagaaacgggcatagttgaaagatccattgacctattgtattctgaaactcaatggatcatcagcttaggcactgagaaatggattccaaaccaattttagtgtgagcaagtttctctcctttctgttactctcataccctttcttctttcttccctccctccctcccttcctttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgagtcaacatgctgtctttatatggctggccataagatgtctaagttcattctctcgacttagtaagtgtgtaagttttttaaaaaggtaggagttaggcaattgatagagatgtaaactgtaaatttccaacagatacatatgagtttatgtttatttttatttattttagagacagggtttcacagggttttgctctgtcacccagggtagacgacagtggtgcagtcatagctcactgcaacctccaactcctgggctcaagagatcctccagcctcagcctccagagtagctgggacctcaggtgcttatcgccacgcccagctaattttttatttttattttttgtagagacaggttctcattttgttgcccaggttggtcttgaactcctgggctcaaggaatccccccgcctcagcctctcaaagtgctgggattacaggtgtgagccaccattgtgcccagccgtatacatgattttaaagtgttgtaaaaacaggaggtgaaaaaattcaactaactttgcatagatgaaaagcatttctataacttcggggatttggcccacagtcctgagcatgtagcttttgcctgcaagacattctcaatcttcaaggagatgtttgcatacagcaaaaaaattgtactcttctgtggctgtcattgtttcagagtatttacaaaggactctgagagccaatagggatgaactcctgtttgtattttttctctcagaggagatatttgaagtgggttttgaaacatgtatagacatgagataggaattgaatcaataatccacatgtccaatattcattacctgataactgagtagggatatgctgagaagagcgtcatgtgtttccttaagaaaatatgacctcagctgggactgagcaaaactatgaagtggactcaggtggtcctcagagtccacgtttctttcttttcctcaattcagttctttccccaacttccacttttcctttacttggtaattccttattttattttatttatttatttttttgcttgtttttcttttctccagccaaagctgctattctcacactttttcttcttttgagggtctcgtcctgtagcccaggctagagtgcagtggcgcaatctcagctcactgcaggcttgaactcctgagctcaagcgatcctcccacctcagcctccagagtagctgggactacaggcatgcaccaccacacccagttcatttttacatttttttgtagggatggggtctcactatgttacccaggctggtgacgaactgattctcctgcctcagccccccaaagagctgggattacaggtgtgagccactgcaacctgactttttaaaaatttggagtaatgataaattgcatgtatttattctttttatattatgaatattttatttttatttattttttctttctttttaaattcatttttctttttatttttttcctttttaaatttctttttctttttttattgtcccttgagtcaaaaaagctgacatataaacattgcatagatttatggtgtacaacttgatgttttgaaatacgcctgcattttggaatagctcaattatgctaatgcatgttacctcatccacttacctatttgtgatgagaacactttgagtagattttatcagtaattttcaactctaaaatacattcttattaactacagtcagcacaagtacaatagattctttgaacttatttctcctgtcaaattgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacatgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaaattcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtgtatgaatatgaaaatttgatatggatagatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctgattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctctgtatctctctctgtgtctctttctctcttttcatctctccctgtttgtctctctctgtttttctttctgtctccctccatctgtctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtgttagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcgcttgaacccgggaggcagaggttgcagtgagccaagattgtgccactgcattccagcctgggtgacagagcgagactctgtctcaaaacaaacaaacagcaacaacaaccaaaaacccacaaagtcataaaccaagaaatagctatcagatttttggacaactttcatcacagcattttacccatggagacagtagtattatccccttgctcaatttatatcaattttattttatttattattattattattattattattatttttgaaatggagtctcgctctgttacccaggctggagttcagtggtgcaatctcggctcattgcaacctctgcctcctgggttcaagtgattctactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaagccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaatcatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggaggcagaggttgcagtgagctgagatcatgccactgcactctagcctgggcagcagagtgagatttcatgtcaacaacaacaacaaaaaaaaaaaaaaaaaaaaaagagagagagagaaaaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaggtccggagatgcagaccatcctggccaacatgatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcactgctgcactccagcctggtgacaaagcgagacttcatctcaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacgctgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaagttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatgaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaatgtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctatctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatagatacatacatacatacatacatacatacatacatagatacatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcctggtagagatatcaccttcctgccttttataattatcataggtggccgggcgcggtggctcacgcctgtaatcccagcactttgggaggccaaggcgggtggataacgagttcaggcaatcaaaaccatcctggttaacactgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgtgtctatttggtagaatgatttatttccctttgggtagacacccagtaatggcattgctgggtcagagggtagttctgttttaagttatctgagaaatctccaaagtgctttccacagtggctgagccaatttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccattagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatatatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaataatttatactacttaaaaataaagtatcataaattgtttaggccaggtgtggtggctcacgcctgtaatcccagcactttgggatgccgaggcaggcagatcacctgaggtcgggagttcgagaccagcctgaccaacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatttatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaatttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattatt

SEQ ID NO: 4201 - DNA, 45873 bp, human
ttctgctcctagacattagagagataatacggctgataggtgagttggggaaggcttgtttggacacattttctcagccttttttttttttttttaacctctggtagaaacgggcatagttgaaagatccattgacctattgtattctgaaactcaatggatcatcagcttaggcactgagaaatggattccaaaccaattttagtgtgagcaagtttctctcctttctgttactctcataccctttcttctttcttccctccctccctcccttcctttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgagtcaacatgctgtctttatatggctggccataagatgtctaagttcattctctcgacttagtaagtgtgtaagttttttaaaaaggtaggagttaggcaattgatagagatgtaaactgtaaatttccaacagatacatatgagtttatgtttatttttatttattttagagacagggtttcacagggttttgctctgtcacccagggtagacgacagtggtgcagtcatagctcactgcaacctccaactcctgggctcaagagatcctccagcctcagcctccagagtagctgggacctcaggtgcttatcgccacgcccagctaattttttatttttattttttgtagagacaggttctcattttgttgcccaggttggtcttgaactcctgggctcaaggaatccccccgcctcagcctctcaaagtgctgggattacaggtgtgagccaccattgtgcccagccgtatacatgattttaaagtgttgtaaaaacaggaggtgaaaaaattcaactaactttgcatagatgaaaagcatttctataacttcggggatttggcccacagtcctgagcatgtagcttttgcctgcaagacattctcaatcttcaaggagatgtttgcatacagcaaaaaaattgtactcttctgtggctgtcattgtttcagagtatttacaaaggactctgagagccaatagggatgaactcctgtttgtattttttctctcagaggagatatttgaagtgggttttgaaacatgtatagacatgagataggaattgaatcaataatccacatgtccaatattcattacctgataactgagtagggatatgctgagaagagcgtcatgtgtttccttaagaaaatatgacctcagctgggactgagcaaaactatgaagtggactcaggtggtcctcagagtccacgtttctttcttttcctcaattcagttctttccccaacttccacttttcctttacttggtaattccttattttattttatttatttatttttttgcttgtttttcttttctccagccaaagctgctattctcacactttttcttcttttgagggtctcgtcctgtagcccaggctagagtgcagtggcgcaatctcagctcactgcaggcttgaactcctgagctcaagcgatcctcccacctcagcctccagagtagctgggactacaggcatgcaccaccacacccagttcatttttacatttttttgtagggatggggtctcactatgttacccaggctggtgacgaactgattctcctgcctcagccccccaaagagctgggattacaggtgtgagccactgcaacctgactttttaaaaatttggagtaatgataaattgcatgtatttattctttttatattatgaatattttatttttatttattttttctttctttttaaattcatttttctttttatttttttcctttttaaatttctttttctttttttattgtcccttgagtcaaaaaagctgacatataaacattgcatagatttatggtgtacaacttgatgttttgaaatacgcctgcattttggaatagctcaattatgctaatgcatgttacctcatccacttacctatttgtgatgagaacactttgagtagattttatcagtaattttcaactctaaaatacattcttattaactacagtcagcacaagtacaatagattctttgaacttatttctcctgtcaaattgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacatgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaaattcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtgtatgaatatgaaaatttgatatggatagatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctgattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctctgtatctctctctgtgtctctttctctcttttcatctctccctgtttgtctctctctgtttttctttctgtctccctccatctgtctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtgttagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcgcttgaacccgggaggcagaggttgcagtgagccaagattgtgccactgcattccagcctgggtgacagagcgagactctgtctcaaaacaaacaaacagcaacaacaaccaaaaacccacaaagtcataaaccaagaaatagctatcagatttttggacaactttcatcacagcattttacccatggagacagtagtattatccccttgctcaatttatatcaattttattttatttattattattattattattattattatttttgaaatggagtctcgctctgttacccaggctggagttcagtggtgcaatctcggctcattgcaacctctgcctcctgggttcaagtgattctactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaagccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaatcatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggaggcagaggttgcagtgagctgagatcatgccactgcactctagcctgggcagcagagtgagatttcatgtcaacaacaacaacaaaaaaaaaaaaaaaaaaaaaagagagagagagaaaaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaggtccggagatgcagaccatcctggccaacatgatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcactgctgcactccagcctggtgacaaagcgagacttcatctcaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacgctgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaagttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatgaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaatgtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctatctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatagatacatacatacatacatacatacatacatacatagatacatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcctggtagagatatcaccttcctgccttttataattatcataggtggccgggcgcggtggctcacgcctgtaatcccagcactttgggaggccaaggcgggtggataacgagttcaggcaatcaaaaccatcctggttaacactgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgtgtctatttggtagaatgatttatttccctttgggtagacacccagtaatggcattgctgggtcagagggtagttctgttttaagttatctgagaaatctccaaagtgctttccacagtggctgagccaatttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccattagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatatatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaataatttatactacttaaaaataaagtatcataaattgtttaggccaggtgtggtggctcacgcctgtaatcccagcactttgggatgccgaggcaggcagatcacctgaggtcgggagttcgagaccagcctgaccaacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatttatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaatttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattatt

SEQ ID NO: 4202 - DNA, 71255 bp, human
gtggagacaggctctcaccatgttgaccaggctggtctcgaactcccgacctcaagtgatccgccggcctcggcctcccaaagtgctgggattacaggcgtgaaccaccactcctggcccttctgttacttttccactgctgttgagatagaagtcactgttgggatccaacctttttgtttgtataaactggtgagtttgtgttgatatctcttgctagagttctgaagtaaaagctataggatctttgtgtgagtgtgcatgcgtatttagatgtgtttatgtacatgcacatatgtgtgcacatatacattttttacgtgctttagccctgaagtgtcaaattggcttcaagtcaaagagtactcataaattaaataataagccaaaacgcttttcaagttcacgtgacttacataaatctttaataaataagctggctttaaaattattggtacgatagtattagaaatatcttaaaaattgtcagcatacatgtttgtttgcatttactgatcaagcagtttcatatttacctctgacagatattataaggtgtcaaaatttggcataaggcttacaaaactataaacccagcaacccagcatgaaacacaataatctttgtttctgtactttttgagaaataagacgtttaatgttattagtgtagtaaaaagagctaaatcccaagttatcagtaaaatatatatatatttaaaatttttgcttaggcaaacacagaaaattcatagactataaaaatggttaacagggaaataactttaaatgatgactatcagagttttcacagataatctaggtaaaagattttataaaattaattaggtaaatgtaatgaaacaaatgcctgtaaataaatataatttagaatctaaagttaaataatagatattcactaaatgtctgggccattttcaatttaaataaattgtattatagaaaaacttttctaaaaaatatgttcttattcaaagctaagttattttcatctaattccatgtttatttatttatattttttgagatggagcctcgctctgtctcccaggctggagtgcaatggtgcagtctcagctcactgcaacctctgcctcccaggttcaagcgattctcctgcctcagcctcccttgtagctgggattacaggtgcccaccaccatgcctggctaatttttgtaattttagtagagataggggtcttgccatgttggccaggctggtctcgaactcctaacctcaggtgatccacccacctaagcctcccaaagtgctgggataacaggtgcaagccaccgcacccggccagattctaggtttatttaagggttatttatgaaatatggtaaaaggaaccaagaaacaagagatgtaaagaaagttaggctgcgtgcattgggtcacacctgtaatcccagcactttgggaggctgaggcaggcggatcatgaggtcaggagtttgagaccagcctgaccaacacagtgaaaccccacctctactaaaaatataaaaattagtcaggcatggtggcatgtgcctgtaatcccagctactcaggaggctgaggtaggagaattgcttgcacccgggaggcagaggttgcagtgagccaagatcgtgccactgcactccaggctgggtgacagagcgagactactccatctcaaaaaaaaagaagaagaaagttacaaggaggtatttttggtaagaaatgttaaaagaaaaataattttgtatgagaaagaatcttgttgtttaagagagatgtttaggacagaacagaaaatccaagcaggttgtatatggtctgtgcaagtcataatacagtctgtaaaaaaggaattcaaaaaaatttttatgtaattaagtttgctataactaaaaggaaattataatcattctaggtattggacttcaataataaaaatacagtaatgcaaaaggagatcattggttagaacaagattttcttaaaatactgatgtactcagtgaaattgcaagaagttttttatttttgaattccataatctcttcttgaaattcttcagatggacatcctaggggttccacttctgctgcatcctgcttgcctcagagctttccctcttttgaaaaggcctgggatggtaactctctccttcaacttttgctggctcccgtaattttttaaaaattaatagtctaaaggaagagagagaatttttgaaaacaggcaagtgaaaaatgttataggatgtgcctctatctgtgtgtctgtctataagtttatttattgtctgtttgtttgattgatttgtttattttggagacagggtctcactctgtcacccaggctggagcgcagtggtgtgatcttggttcactgttcccttgagcactgggctcaagggatcctcctgcctcacctcagccatccatgtagctggaaccacaggtgcatactatctcgcccagctaattttttgtattttttatgtagagatggggttttgccatgttggccaggctggtctcagtcctgagctcaagcgatccacccgtcttggcctcctaaagtgctaggattacaggcgtgtggcaccatgcctggccttgtctgtaagtttctatctgtcatgaggaagtaatatttcagtaccaaattatatgaaagagctctaatcaaatggcttaaagaaaagtaagtgcttatcagacaaccaaaagctagctcagatgcttttaattgacattcctttagtaatctttggtaagactaatttggtaaatttaatttcaaaatcctgtccagtggtttaaaatcttagagtcacgttagatgggactgttcccctgaccttgacccccttcgtgggcaggaactggagtggctcatgttactcagcctgcagtttgtggacagctatgtgttaacagctcagtgaagggtcaaggtgacagccttctgcatctgtccttttggacaccgacttcttgtttggtgtccaagaatcatcaggtcacacaaactgaaagatgatgaatgtggaggactttattgagcagtggaagtggctcttggtggaagaggagctggaaaggggatggtgtgtgaagaaggtgatgtttctctgaagcctagccttctctggctgggctcccctccaaaaccacaccgtctgaagttagtcatgtttatctgtagtctccaatgctcagttacttctctgctcgccactcagtagcttgtatccctgccggtcagctgcttgtgttgcttttttctttttctttttcgtttttcttcctgccagctggtctggtccttatgggcacaggatagggggcagggcaggccaaaaaggcaatcatctgggcagagaaacgaggtcagctgctttcactagggccgagcttccagacttgaggttgtagtttagccgggagcccagccatcctgtatcaatgttagattaaattaggcaatcctaggttttgcactggaaattagggttactgggagttggaatagtaggagagtaagatgtatttttggtgaggtttataaaaacacaaagatgtggtttttgccaaagaaaatgtaatgtttagaggctatttaaaggtcactttaaaataaatggaaaattatgtagataaaactcattggagaaagagaaaaataaagaggtggggaatgagaaacctttgacttttgggtggccacgtggtcacacatggtaatgaagtggcatcattttctggggtaaatacccgagattcattgtctcatggccacagaaatcgaggacgtggacacacagaatgaggttgagagcagaagtttagtaggcaaaagaaagagaagagctctctgcagcagagcggggtcctggagaagtgggttgctgcttctttgctgaaatgcagcaagttttatagatgagcttgaggaggcagtgtatgatttacataggacgcaaaagattggttggaccaggtgtaccattttcatagggcatgtaaagctggttaggactagatgtgtcatttgcatagggcatgaaaagctgggctaatcttttttttttttttttttgagatagaattttgctcttgttgcccaggctggagtgcaatggcgccatctcggctcactgcaacctccacctcccgggttcaagtgattctcctgcctcagcctcctgagtagctgggattacaggtgcctgccaccacacctggctgatttcgtacttttagtacagatggggtttctccatgttggtcaggctggtctcaaactcctgacctcaggtgatctgcccacctcggtgcctaatcttttattatgcagatggactctttacctggctagtgccatgtcgcctgttttttttgtttgttttgttttgttttgttttttgagacggagtttcactcattttgcccaggctggggtgcagtggcgtgatcttggcctaatgcaacctctgcctcccgagttcaagcaattctcctgcctcagcctcctgagtagctgggattacaggcatgtgccaccacgcctggctaatttttgtatttttttaagtagagacggggtttcaccatgttggccaggctggtctcgaactcctaacctcagatgatccgcccgcctcggcctcccagagtgctgagattacaggcgtgagccactgcgcctggcctctggttttttactgtacacgtggtgacaaagaaaagggaagacggagcctccatgttgaacatacctggcttccaggtagccctttcccattggcacagctgccagcatttacccattcaagcttccagcttgcttattatctatgcctgcagctctattttccaggctgctctttgttaaaaagaaatgatttgggggctcctttttaaaaagggaaattctgccaaggactcttttaccctcactatctgcctgaataatttctttctagttcctctatcagtaaggagatgcagctggcttgtcttcagtcactaaaggtcaaagccaccagaggaatttagagatggatcctactcatagtcccagggaatttcgttcactggatatatagcaaatgcaaattaataaggaaaaagtgaactattcaatcccttgcttactgcctctgtagttgctaaaatgaaagtaaaagagtgctgccttgggcgtgaaggcagcaccaagctcagatgtgggtctgtctcagatcaggccagtgacctcaaagcttcctacacaaggaaaaattaagccacgtcaaccaaaagttacctctgagacctgtgattaccaagaagatagacatgtggaggaagggcaaaaccaagtaactattaaacccagagggtatttacagggctgttcaatcttttggcttccctgggccacactggaagaaaaattgtcttgggccatgcataaaatacacaaacactaatgatagctgatgagaaaaaaaaaaggcaagaaaatgtcgtaacattttcagaaagtttacacatttgtgttgggccacattcaaagctgtcctaagccacgtgcggcccgcgggccgtggattggacaagcttgaaaaggaattggttcatcttctagattggtatcgtcagcttcctgagttcccttttctaaaatgggttgtaagaatgactactttaagaacagtatgtttaatttttttttttttgagaaagggtctcattctgtcacccagactggagtgcagtggcatgatctcagctcatcgcaacctccacctcctgggttcaagtaattctcccacctcagcctcctgagaagctgggattacaggcacacgccaccatgcccggctaatttttctattttttggtagagatggaatttcaccatgttggccagactactcttgaactcctgacctcaggtgatctgcccaccttggcctcccaaagtgctgggattacaggcgtgatccactctgcccaccgatatgcttaatttttaaatgccacagaaagaaagagcatgtttgggctggtgcagggcccgcagctcactcactattaaacacttgctgatgagtgtatgggacccagatgcacaggaagtttttcctgaggaaatggccagcctggtggactaggtaaacaccactacaaggtctgtttatcctgaaaaggggactgcccagccctccctataaaatgccaagtggagcaccctagataaagcagctgatgtgcttcatatgcaagccatgtgggattggcttaatgatgaccgggatattcaccagctgaatatgcccattacccaatgtattagtccgttttcatgctgctgataaagacatacccgagattgggcaatttacaaaagaaagaggggtaattagacttacagttccacgtggtgggggaagcctcacgatcatggtggagggcagggaggaacaagtcacatcttacatggatggtggcaggcaaagaaagagagccaagcgaaaggagtttctccttgtaaaaccatcagatctcgtgagactcattcactaccacaagaataatatggaggaaactgccaccagaattcaattatctcccaccaggtccctcccacaacaatgggaattatgggagatacaattcaagatgagctttgggtgtggacacagtcaaactatatcaccgaggtcatagtgtgaaaggaaaataaatctcaggaccccaaaatcactaagccaagggaaaagtcaagctgggaactgtgtcaggcaagcctgcctcccatttgattcttaaataagacagctacaaagataagaagctacatacccccctcacaatttgtgcttaaggaaattccttgtggacaaaggacagacggaactcaaagtcatccttccaaggctcccctgagacaaatgcttatctgataacttcctctgcctcattgcttatgtaaaagtacagattcacggagccagcctaaattgtgtattcagtggaaagctgatcaaggactcaaaagaatgtaaccttttgtctcgtgtctacttctaatctgaaagctcccacttcaagttgtcctgaattactgaactgagcccatgtatgtcttacacatattgattgatgtctcatgtctccctaaaatatataaaagcaagctgtgccctgaacaccttgggcacatgtcgtcaggacttcctgaggctgtgtcacaggtgcacgttctcaaccttggtaaaataaactttctaaattgactgagacctgtctcagatattttgggttcgcaatagattctcagtgtattaatgatgttaggtgaagaactgtgaagctcataaatttggaaaggaaaggtttatttctataaatgttgtggttcaagggtccccttctacaagagcaccccaggtgacattactcttgcagaatcaaacaatggtttgagaaaccttatcaaatttgcagttgtagctttccctcatgggtcttacagatgctaccaaaagactagggtgtcaacgagaagagacaaactgtaaatttttttaagaggtttattctgagccaaatatgagtgaccatggccgcccgtgacgcagacttcaggagatcctgagaacatgcgcccaatgtggtctgcgtacagcttggttttctacattttagggagacatgagatatcgatcaatacatgtaagacgtacattgtttccattcaaaaaaggtgagataactcaaagtgggggattccagctcatggatggacaagacacagaaggttgcattcttttcggtctttgatcagaatacacaatttacatgtgacggaggttggggggtgggggtggtgggtagaggaatagtgactgatgcctgttcagtgaatctgcaagtttgcgtaaacaatagggcaggggaatctatcagatatgcatttgtctcaggtgagcagagagggctgactttcacttctgtctctcctttgacccacacctgtgaagataagccaaggtgaaattgaacagaactgttttagggtaaagatcttgaggtccacaaaaaatttctttgtgggcaaattatgaaagaggtatgtagctttttgttttgttttgtttgtttgtttgtttgtttttgtctccatagctgtcttatttaggagaaaatgggaggcaggtttttctgatgcagttcccagcttgccttttccccttggcttggggattttggtttcctttcactaattaacaaacaaaattaataaattaacaaacaaaaacagggaagggaaaagtgagtcaaagggctcatgccagaagggtggaaatctttagataattattttgttattattattaatttttctttttttgagatggagtttcgctcttgttgcccaggctgacatgcaatggtgccatcttggctcactgcaaccccacctcccaggttcaagtgattctcctgcctcaacctcctgagtagctgggattacaggcacctgccaccacgcccagctaatttttttgtatttttagtagagacgaagtttcacaatgttgggcaggctggaatctttagataattgttaagaaataaaagaaaaggaaaattgatggagttaaaacaaaagactttacaacatgatcaaaggttgggtgggccacagggagccccaactggtcccccaacatgaaggggccccatgccagttttcttcatttgcctcagattggagaagtttaagaaaaattgaggctgggcatggtggctcaagcctgtaatcccagaactttgggaggccaaggcaggcggatcatctgaggtcaggagttcgagaccaggctggccaacatggtgaaaccccgtctctactaaaaatacagaaaaatttgctgggcgtcgtggcacgcacctgtaatcccagctactcaggaggctgaggcaggagaatcgcttgaacccaggaggcagaggttgcagtgagcagagatcatgccattgcactccagcctgggcaacaagagcgaaactctgtctcaaaaaaaaaaaaaaaaagttttagagcaggaatgaaaagaaggaaagtacacttggaagatggccaagtagctgacctaagagatcaagtgtatggttgacctttagacttggggttttataggttggcatgcttctggagtcttgtgtcccttctccgctgagtcttcccttggggttgggctgtccacatgcacagtggcctgccagcacttgggaggggagcatgcgcagtgtgtttactggagttggacgcatgctcacttgaggcgttcttcccttaccagctgaatgttcctagaaggttatagaccagttaaactccaccgttttgcttctcagtgtgcatgcttgagcccactcactcacctcctgagatcgtattgggaaactgctgaccaccagttttaggtgttttctatttactgggagacggcctttccctggtgctgactgtgaccaattattattttagagagacagtttaataaccgcctgatgctcgcctgacattcctggtggggctggggagagcctttcctgccttgctcatgcctgactagctacctactgtaacaataactgaactctttctaccgatttccagtgagaaaatctatgcatctatctatgacctgcaagcccccactttgaagtgtgtcacctttcctggctgaaccaatgtccatcttacatgtattgaggggtgtcttatgtctccctaaaatgcataaagccaatctgtaactcaacaaccctgagcacatgttctcaggatctcctgagggctgtgctatgggccagtagtcactcatatttggctcagaataaatatcttagaatagtttacagagtttgacccttttcatcagcagaggcatacactcttgctatgggatgttaaccgaagctaatggaaataatggtgtccaaaagagttccgtgatgaaacgtaaatggttcatgtaggacctgctacctggggaatgcaaagataatatacaaggagggagcttctttttcctcttcagactgactctgtaactgtgagaagatttttgccttccaaagttattagtgtgttcatttttatctcttaggaaaaaagtggcaaagttggagatggtgtacactttcctttattgcttgactgaggttaaaaatttggccaggcatggtggctcactcctgtaatcatagcattttgagagcccaaggccaaggatagcttgagccaagaagttcaagaccagcctgggcagcatagcgagaccttgtctctacaaaaaataaaaaaattagctgggtgtggtggtgaacacctgtaatcacatctacttggggggctgaggtgggaggattgcttgagctcaggagctggaggttgcagtgagccaagattataccactgcactccagcctgggcaaccaagcgagatgctgtctcaaaacaacaacaacaacaaaaagaacaacaaaaaacaaaaaaaaacttgtattctattgtctcccatcagattatttttaactaattttattttaatcacttactgttgagtcacctctgagattttctattccagtggcgtccttataaaatgaagcttccttgtcaactgcacttgttataacaccgagcttctgctaagaaaaagcaaatgcataactctgtataacctatctcccatgacagggtctatgcctcgctgtatttaagcattcattttagttttcagcaatgtagtactttcacctatattttgtcaaattcaaacacttgcaatacttcatttattttttctgcatgtccttcatattttggctttgctagtccactttggccaaaaagctttgattctttaagtataggcctaaatatcctatcttaagcatgggtgtaattttcttctattaccaacagaggttcttttatagtttttgaaatcactgattaaaaagaaacagctcaaattatattctactgtaaaaatgatacattcagcctgggcacggtcagtcacatctgtaatcacaatacgttgggaggctgaggcaggaggatcacttgagtccaggagttgaggctgcagtgagctgtgatcacaccactgcactctagtgtgggtgacagtgagaccctgtctcaaaaaaaaaaaaaaaaagatacattcaaagaagtcaaaataaaacagtataaaacctatctccctgattgcagctacctttttttatgcatacgcctgcaatccttttacacctatcacacactaaaaatgttttacagttattgttattgcacacagaaggcatctaggaatgttttaaagaacctgtctctctgaagttcatcctgcttatctaacttgtctatcaaggaaattattttcttgattattattgctgagaaagactgggtgaggttgctaccccagaattagcagatgcaaatcaggaggaagtgaacaggctgcaaattagcaagttctggcatggggtgaggcaatggcagaaaatcggtttcctgggaaccatgcccaggaactagcctgacattgtgagaaagctcccaacattcataatgagttgcatattaaattccagggaagggcactgtaggtaagatggaccacatttggaaatacactttttcagacgttttatttagggagaatttctgacatgtcctccgataatttgaacttccttgatttgcagttgtacattgagagatcatttcttggtcaaaataaatgttcagcaggtgtgaatgctgtatccacaacttttttttttttttttttttgagacagtctcactctgttgcccggggtgaagtacagtggtgtgatctcagctcactgcaaactctgcctcccaaattcaagcaattctagtgcctcagcctcccgagtagctgggattacaggcatgtgccaccatgcctggctaattacaacttaatttttaaatttgggcagatttacaaaactatcaagctattaccctgcagcatccttagccctaagcttgtcactacttgtaatgtatttttattttatttatttattttttgagacagagtttcactcttgtcgcccaggctggggtgcagtggcatgattgcggctcactgcaacctccacctcctgagttcaagcgattctcttgcctcagccttccggaccacaggtgcatgccaccacgcctgggtaattttttttttttttttttttgaggtggagtttcgttcttgtcattcaggctagagtgcaatggtgtgatcttggtttactgcaacctccacctcccaggttcaagcgattttcctgcctcagcctcccaagtagctgggattacaggtgcccaccaccacacccggctaatttttgtatttttagtagagacagggtttcaccatgttggccaggctggtcttgaactcctgacctcaggtgatccacctgcctcggccttccaaagtgctgggattacaggcatgagccactgcacccagcctacctactggactttttttcggagacacactgtagtttctcaagaaagaatgcctgttcctggtcccagctgcacactcactttacagtgtgtgctgtacttggtcaagtgtattgatattgaaacacaagccagactggatggaccttggtcataaatcatggggcagctctccttcactgtcagataaaatccaaattctctattactacctccaaggtcccagcattgacgatctgttcttttcttcctgaagggacatcacccccggttctcagggtgtctcctcacaggcttcttacaaatgcctttcctcaggaatgtggctccacaatgacttttttttaattaaaaaatttgcagcctacaatcagcctcctcaattattattattattattaattgttattatcattacttgaaacagggggagagtctcactatgtggtccagactggtttcaaactccttgtctcaaaccatcgtcttgccttgacctcccacagtactgggatgacaggtgtgagcccccgcacctaagtgtcctcttaaaacccatgaagtcttttagggctgtctacttttctctatggaattcaaatcgctaagcattcatgaaagtttagataaggtggaaataaatccaacctttaggatggatgcatgaaactgctctcttttttttttttttggtagagttttgctgttgttgcccaggctggagtgcaacggcacgatctcggctcactgcaatctccgcctcccaggttcaagcgattctcctgcctcagcctcccgagtagctaggattacaggcatgtgccactacgcctggctaatattttttgtatttagtagagacagggtttcaccatattggtgggctggtcttgaactcctgacctcaggcgatctacccacttcagcctcccaaaagtgctgggattacaggcatgagccaccacatccagccaaaactgcacttaaaatccaatctttggccgggcgcagtgactcatgcctgtaatcccagcactttgggaggccaagacgggcagatcacctgaggtcaggagttcgagaccagcctgaacaacatggagaaaccccgtctctactaaaaatacataattagccgagcatggtggcacatgcctgtaatcccagctactcggaaggctgaggcaagagtatcacttgaacctgggaggcggaggttgcagtgagcccagatcgcgccactgcactccagcctgggcaacaagagcaaaactccatttcaaaaaaaaaaaaaaaaaaaaaaatctaatattgtccccaattcctacttttgggagtaaactatgcctatttcaaactattgctggacaagattgcctggtttctgcttccccttatccctcttgttcaagtcaaccagtcaggaaatataaagaatgatcaaggaaacctccaagttaacacagaaatacgtatatatggtgaatgctgtctgcagacagcttatggccccatggtactagccgtcatagcacatggcaaagttgtcctattgactctgctgtcagcccctgcgtggaagaccaaataaaggtgctgggacagaaggatgaaaaggaatcctaggataaatatctcatcttcatcgtccctgggttggataattctgagggtctgtcgttgaatctcagtgtttctgcacagcactcagcttcaatagcccagtggcaagctgcttcataagtacaacctctactggcttcctgcctttccctgtctctcttcctctttccctgaccaatgctccctcaattacctccctaataacctacttggatttaaggtttgaaaaagaaatgcggcatcattctttttgtcttaaatttttaattaaaaaaaatttttttcgagatgggatcttgctctgttgcccgggctgtagaacagtggtggaattacgatacggctcattgcagcctcaaaccctttagctgaagcaatcctcccacctcagcctcctgagtaactgggaccacaggtgtgtgccaccgtgcctggataatttttgtaaaatattttttgtagagacagggtctcactagttgcccaggctggtctcaaactcccaggctcaatcaatctgcctgtctcaacctctcaaggtgttgggattacaggcgtgagccactgcgccgggtcgcaccatcattcctattttttttttttttttttggaaatgaagttccctctgtcacccaggctggagcacagtggcgctatctcggctcactgcaacctctgcctcccgggttcaagtgattctcctgtctcagcctcctgagtagttgggattacagtcatgtgccaccacacctggctaatttttatatttttagtagagacggcgtttcgccctgttggccaggctggtctcgaactcctgggctcaagccatctgcttgcctcaactcccaaagtggtgagattccaggcatgagccaccactcctggacgaagcatcattcttaatttcaatgtctagtctagacatttaaaagaattgaacatattggatcgtatcaaaacaacatcttgttgaagagaatgaccctctccacccaacctgaaacagatggaggcagtgctgactttatctcaatcttaaacaaaatctgtttcactcaattttcttgtagacaggccgactgctttattagaaaacaggagaacattgacctttttctatgattctcttccgatcaccctaggtagaattcctttcactttctaacctgtgtctgtttcaacccaggatacattaagcttgttgtctgtgacactttattgaactttttaatagccacgactgacactgatcctctctgctgagagaggagctattctgattccattcattgtgactccaaagtctaccctggaagtcagatgctcaggtgggattttataaatattccatgaacaaatgaacttcggctttggggtaaaagagtcggttgcccatcatttgatagatccctggatattttttcataaaaaacaccctagcaggttgcttattgcaaaatgacatgtgtcatatcttctctggagctgaatattgttaagcaaaatttatattaatgagaagcaaaaaaaagtttgtttgttttgctttgcttcagcaagaattatctgttgcatcagaaatgcagggagcacttttgctctttattagcgtttttttccccagaaactctgacattactaggacacttggtcatctgtgatctgcttaaaagctctcttcagctcctggaagagtaggtggttctgattctctttcggtgagatggtttatggagccctcttcatcccataattctgaagagtaacaggcagaacgtcttattagggggcagctgaaatcgtctagggaatgtggctagggagtgtcgtcatctttacatcaaaggctatgcacagataacacgccaatcctgatttcacccatgagaaaagtgaactccaagaatttcaggaatgtagacgtgtcgatgataaacattgcatttattacaatttcactttatttcctagaagaggggacattatatttcctggccagatgctaccctttgaaagaaatgcaaactttgataaaatagacatgctatcaatttccttaggggagctttatcttcactgggtcactatacccagcatgacagtaaagtctgccatgtgtttcttgtcccactggaaaaaaatacatagaaaagctatgtacaaggactgtattaagattcatctatgtctttcagagatggcaggcaagtgccatttctgaacaatttgggtgaagtcagacacatgcaccttaccccgacaaccactcaatggacagcagaacattgcaaatcatgacctgtaataggactgtctttgacttacacagctcaggaaacaacacttggtttggtcaaaggtttgttccttttcatttcgtgttctagtgttttcttttcctgcccttatgacagttgtgtgcaatggcattattgcattaaatagacacgactgattaggtagcatgaaccatagtttagaatttggctaagtgtggctatgttactgtctgttttttctttttctttttttaggagatagggtcttgctgtgttgcccaggctggagtacagtggctattcagacatgtgattccaccactatcagcacgagagttttgacctgctgcatttgtgacttagggtggttcaccaggccttaggcagcctggtggtcttctgctcctgggaggtcaccaagctggtgctgaacgtagtgcagatacttgatcagcctagcgcaccatagcccagaacttctgggccgaagcgatcccccacctcagtctcctgagtagccgggaccacaggcaggctacttgctgtttttgtcaacataaaagggagtcagaaaaggcagaacatatcaagatcagtaaatctaggctgggcatgatggctcacacctataatcacagtgcttcatgaggccaaggcaggaggattctttgaggccaggagttcaaaaccagcctgggcaatatagggagaccttgtctctacaaaaaaatagaaaataaagaaattacccaggtgcagtggtgcatgcctgtagttccagccactccagaggctgagactggaggatctttcgagcttaggaggctgaggctgcagcgagctcttatcacaccagtgcactccaacttgggtgacagaatgagaccctgtctctaaaagaaaaagaaaaaaagagattagtaaattctttagaaaccaagattttaccatgagcagttgcatgaaggtggaaaacctttctgtgattataagtagggattctgaaagaagtcctcaaagtgaatacttattccatggagaaacagaatgaattgagagagtcctggaagctgggaggagaggaatctgtagaaagcagagtcacttaactaattcaccaatgagactgcaaaccgatggtcatggagctgccatgggaatctgaattacagtcacttttattctttgtattttattgtttggattgaaaatgcggccaggcacggtggctcatgcttgtaatcccagcactttgggaggctggggtgggtggatcacctgagatcaggagtttgagaccagcctgaccaacatggtgaaaccccgtctctactaaaaatacaaaaattgggattccattccaagatggccaaatagaaacagctccggtctacagctcccagcgtgatcaacacagaaaacgggtgatttctgcatttccaactgaggtatcttgttcatctaattgggactggttggacagtgggtgcagcccacagagggcaagccgaaacagggcagggcattgcctcacctgggaagtgtcagaggatttccctttcctagccaaggaagctgtgacagactgtacctggaaaactgggacactctcgcccacatactgcacttttccaatggtcttagcaaagagcacaccaggagattatatcctgcacctggctcggcagttcccactcccacagagccttgctcactgctagcacagcagtctgagattgaactgtgaggcagcagcctggctgggggggtgggcatccaacattgctgaggcttgagtaggtaaacaatgtggccagggaagctcgaactgggcagagcccactgcagctcagcaaggcctactgcctctgtagattccacctctgggggcagggtatagctgaacaaaaggcagcagaaacttctgcagacttaaacgtccctgtctgacagctctgaagagagcagtggtgctcccagcatggtgtttgaggtcttagaatggacagactgcctcctcaagtgggtccctgacccccttgtagcctaactgggagacacctcccagtaggggccaactgacaactcatacaggtggtgcccctctgggacaaagcttccagaggaaggatcaggcagcaatatttgctgttctgcaatatttgctgttctgcagcctccactggtgatatccaggcaaacagggtctggagtggacctccagcaaactccaacagacctgcaggtgagggatctgactgtcagaaggaaaactaacaaacagaaaggaatagcatcaacatcaacaaaaaggacatctacaccaaaactccatctgtaggtcaccagcatcaaagacaaaaggtaggtaaaaccacaaagatggagagaaaccagagcagaaaagctgaaaattctaaaaaccagagtgcctcttctcctccaaagggttgcagctcctcacgagcaacggaagaaagctggatggagaatgactttgacgagctgacagaagtaggcttcagaaggtcggtaataacaaacttctccgagctaaaggaaatgttcaaacccatcgcaaggacgctaaaaaccttgaaaaaagattagacgaacagctaactagaataaatagtgtagagaagaccttaaatgacctgacggagctgaaaaccacagcataagagctacgtgatgcatgcccaagcttcaatagccgattcaatcaagtggaagaaagggtatcagtgattgaagatcaaatgaatgaaataaagtgataagagaagtttagagaaaaaagagtaaaaagaaatgaacaaagcctccaagagatatgggactatgtgaaaagaccaaatctacatctgattggtgtacctgaaagtgacagggagaatggaaccaagttggaaaacactcatcaggatattatccaggagaacttccccaacctagcaaggcaggccaacattcaaattcaggaaatatagagaaagccacaaagatactcctcgagaagacacataattgtcagattcaccaaagttgaaatgaaggaaaaaatgttaagggcagccagagagaaaggtcgggttacccacaaagggaagcccatcagactaacagtggatctctcggcagaaactctacaagccagaagagagtgggggccaatgttcaacattcttaaagaaaagaattttcaatccagaatttcatatccagccatactaagcttcacaagtgaaggagaaataaaatcctttacagacaagcaaatgctgagagattttgtcaccaccaggcctgccctacgagagctcctggaggaagcactaaacatggaaaggaacaaccagtaccagccactgcaaaaacatgccaaattgtaaagaccatcgatgctaggaagaaactgcatcaactaacgagcaaaataaccagctaacatcataatgacaggatcaaattcacacctaacaatattaaccttaaatgtaaatgggttaactgccctgattaaaagacacagactggcaaattggatagagtcaagacccaacagtgtgctgtattcaggagacccatctcatgtgcagagacacatgtaggctcaaaataaagggatggaggaagatctaccaagcaaatggaaagcaaaaaaaaagcagaggttacaatcctagtctctgataaaacagactttaaaccaacagagatcaaaagagagaaagaaggccgttacataatggtaaagggatcaattcaacaagaagacctaactatcctaaatatatatgcacccaatacaggagcacccagattcataaagggagtccttagagacctacaaagagacttagacttccacacaataataatgggagactttaacaccccactgtcaatattagacagatcaacgagacagaaggttaacaaggatatccagtacttgaattcagctctgcaccaagtggacctaatagacatctacagaactctccaccccaaatcaacagaatatacattcttctcagcaccacatcacacttattcaaaaattgaccacatagttggaagtaaagcactcctcagcaaatgtaaaagaacagaaatcacaacaaactgtctctcagaccacagtgcaatcaaattagaactcaggattaagaaactcactcaaaactgctcaactacatggaaactgaacaacctgctcctgaatgactactgggtaaataacgaaatgaaggcagaaataaatatgttctttgaaaccaatgagaacaaagacacaacataccagaatctctgggacacatttaaaacagtgtgtagagggaaatttatagcactaaatgcccacagaagaaagcaggaaatatctaaaatcaacaccctaacatcacaatgaaaagaactagagaagcaagagcaaacacattcaaaagctagcagaaggcaagaaataactaagatcagggcagagctgaaggagatagagacacaaaaaacccttcaaaaaaatcaatgaatccaggagttggttttttgaaaagatcaacaaaattgataggccgctaacaacactaataaagaagaaaagagagaagaatcaaatagatgcaataaaaaatgataaaggggatatcaccaccaatcccacagaaatacaaactaccatgagagaatactataaacacctctatgcaaatgaactagaaaatctagaagaaatggataaatttctggacacatacaccctcccaagactaaaccaggaagaaattgaacctctgaatagaccaataacaggctctgaaattgaggcaataattaatagcctaccaaccaaaaaaagtccaggaccagatggattcacagccaaattctaccagaggtacaaagaggagctggtaccattacttctgaaactattccaatcaatagaaaaagagggaatcctccctaactcattttatgaggccaacatcatcctgataccaaagcctggcagagacacaacaaaaaaagagaattttagatcaatatccctgatgaacatcagtgcaaaaatcctcaataaaatactggcaaaccaaatccagcagcacatcgaaaagcttatccatcatggtcaagttggcttcatccctgggatgcaaggctggttcaacatatgcaaatcagtaaacataatccatcacataaacagaaccatcaacaaaaaccacatgattatctcaatagatgcagaaaaggcctttgataaaattcagcagcccttcatgctaaaaactctcaataaactaggtattgatgggacgtatctcaaaataataagagctatttatgacaaactcacagccaatatcatactgaatgggcaaaaactggaagcattccctttgaaaactggcacaagacagggatgctctctttcaccactcctattcaacatagtgttggaagttctggtcagggcaatcaggcaagagaaagaaagaaagggttttcaattaggaaaagaggaagtcgaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcctgtacaccaataacagacaaacagacagccaaatcatgagtgaactcccattcacaattgctacaaagagaataaaatacctaggaatccaacttacaagggatgtgaaggacctcttcaaggagaactacaaaccactgctcaacgaaataaaatgacacaaacaaatggaagaacattccatgctcatggataggaagaatcaatattgtgaaaatggccatactgcccaaggtaatttatagattcaatgtcatctccatcaagctaccaatgactttcttcacagaattgggaaaaacgactttaaagttcatatggaaccaaaaaagagcccagattgccaggtcaatcctaagcaaaaagaacaaagccggaggcaccatgctacctgacttcaaactatactacaaggctacagtaaccaaaacagcatggtactcataccaaaacagagatatagaccaatggaacagaacagaggcctcagaaataacaccatacatctaccaccatctgatctttgacaaacctgacaaaaaccagaaatggggaaaagattccctatttaataaatggtgctgggaaaactggctagtcatatgtagaaagttgaaactggatcccttccttacactttatacaaaattaattcaagatggattaaagacttacatgttagacctaaaccataaaaaccctagaagaaaacctaggcaataccattcaggacataggcatgggcaaggacttcatgactaaaacaacaaaagcaatggcaacaaaagccaaaatagacaaatgggatctaattaaactaaagagcttctgcacagcaaaagaaactaccatcagagtgaacaggcaacctacagaatgggagaaaatttttgcagtgtacccatctgacaaagggctaatatccaaaatctacaaagaacataaacaaatttacaagaaaaaaacaaacaaccccatcaaaaagtgggcaaaggatatgaacagacacttctcaaaagaagacatttatgcagccaaaagacacatgaaaaaatgctcaccatcactggccatcagagaaatgcaaatcaaaaccacactgagataccatctcacaccagttagaatggcgatcattaaaaagtcaggaaacaacagatcctggagaggatgtggagaaataggaacacttttacactgttggcgggagtgtaaactagttcaaccattgtggaagacagtgtggcaattcctcaaggatctagagctagcaataccatttgacccagtaatcccattactgggtatatacccaaagcattataaatcatgctgctatcaagacatatgcacactattcacaatagcaaagacttggaaccaacccaaatgtccatcaatgatagactggattaagaaaacctggcacatagacaccatggaatactatgcagccataaaaaatgataagttaatgtcctttgcagggacatggatgaagctggaaaccatcattctgagcaaactatcacaaggacagaaaaccaaacactgcatgttctcactcataggtggtaattgaacaatgagaacacttggacacagggtgggggacatcacacaccgggcctgttgtggggtggggggttgggggagggatagcattgggagagatacctaatgtaaatgacgggttgatggatgcagcgggccagcatggcacatgtatacctatgtaacgagcctgcatgttgtgcacatgtaccctagaacttaaagtataataaaaataaataaataaataaataaataaataaaataaaatcaggagaaaaaaaattggccagtcatggtggcaggtgcctgtaattccagctactcaggaggccgagacaggaaaatcgtttaagaccaggaggcagagattttagtgagctgaaattgtgctgctgcactccagcttcggcaacagagtgagactctgtctcaaaaaaaaaaaaaaatgcacatgccctttatatgtaaattttcattttagggaataagttcacatcttcttaacatatattattttggtgtttttagacaattccagttcaaaattcctctccaggtacatttacctgaagaaatctgcatctctggtctaatgcaagatctggtttccaggctgggcgcagtgactctcgcctataatcccagcactttgggaggccgagatgggaggattgcttgagcccaggagtttgagaccagcctgggcaacatagtgagattatgtaaaaatacaaaaattatccatggactagtgggtgcctgtagtcccagctattcgggaggctgaagcaggaggatcactcgagcctggaagtcgaggctgcagtgagctgtgatcaccataattttactccagcctgggtaacagagagacaaccagtctcataaacaaaacaaaacaaaatctggtttctagagtttatagaatcatacaacagcatgtttcatggagcgttccatctcacaaggtggtgtttggtttagagagggttatgtatgccctctgatattctcaaatctttatttaaaatgctgggagagttgctatctggctttgcatcagtgtttaatataatagccatccttttggggtgggtgttgacgaacagcacacctgccatcttccaaattataccccacactttgtcttgttgaatattattaagatataaagacagggaagaccttccatttccctcccacgtccccaccacctttagttgggagcacagatgtccctgaggcactgctatagaccatgaggtcaccgcaacacaagggacatcaaatgggattgctctggctcaaaacagccagtcttaattctggtgcgatgaatggctttggtggtcgtcccagataagaacattcagcgtcagcaagaaaggctgtaggtatttggctgaatgtaatgttttgttgttgatgtgctgttgtttttcttttcctgggtgtgtagtaggagttgcaaatgcgggctgcagattagcaacgggaaccatctgggtgagcctagcagggaccagccctcccatgggagagagaggtgacacggagcagctgatgctttcgtaatgattcgaggcagctgccaaaagaggcagagcctttgcagaacagcctgtctgttctgctcctagacattagagagataatacggctgataggtgagttggggaaggcttgtttggacacattttctcagccttttttttttttttttaacctctggtagaaacgggcatagttgaaagatccattgacctattgtattctgaaactcaatggatcatcagcttaggcactgagaaatggattccaaaccaattttagtgtgagcaagtttctctcctttctgttactctcataccctttcttctttcttccctccctccctcccttcctttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgagtcaacatgctgtctttatatggctggccataagatgtctaagttcattctctcgacttagtaagtgtgtaagttttttaaaaaggtaggagttaggcaattgatagagatgtaaactgtaaatttccaacagatacatatgagtttatgtttatttttatttattttagagacagggtttcacagggttttgctctgtcacccagggtagacgacagtggtgcagtcatagctcactgcaacctccaactcctgggctcaagagatcctccagcctcagcctccagagtagctgggacctcaggtgcttatcgccacgcccagctaattttttatttttattttttgtagagacaggttctcattttgttgcccaggttggtcttgaactcctgggctcaaggaatccccccgcctcagcctctcaaagtgctgggattacaggtgtgagccaccattgtgcccagccgtatacatgattttaaagtgttgtaaaaacaggaggtgaaaaaattcaactaactttgcatagatgaaaagcatttctataacttcggggatttggcccacagtcctgagcatgtagcttttgcctgcaagacattctcaatcttcaaggagatgtttgcatacagcaaaaaaattgtactcttctgtggctgtcattgtttcagagtatttacaaaggactctgagagccaatagggatgaactcctgtttgtattttttctctcagaggagatatttgaagtgggttttgaaacatgtatagacatgagataggaattgaatcaataatccacatgtccaatattcattacctgataactgagtagggatatgctgagaagagcgtcatgtgtttccttaagaaaatatgacctcagctgggactgagcaaaactatgaagtggactcaggtggtcctcagagtccacgtttctttcttttcctcaattcagttctttccccaacttccacttttcctttacttggtaattccttattttattttatttatttatttttttgcttgtttttcttttctccagccaaagctgctattctcacactttttcttcttttgagggtctcgtcctgtagcccaggctagagtgcagtggcgcaatctcagctcactgcaggcttgaactcctgagctcaagcgatcctcccacctcagcctccagagtagctgggactacaggcatgcaccaccacacccagttcatttttacatttttttgtagggatggggtctcactatgttacccaggctggtgacgaactgattctcctgcctcagccccccaaagagctgggattacaggtgtgagccactgcaacctgactttttaaaaatttggagtaatgataaattgcatgtatttattctttttatattatgaatattttatttttatttattttttctttctttttaaattcatttttctttttatttttttcctttttaaatttctttttctttttttattgtcccttgagtcaaaaaagctgacatataaacattgcatagatttatggtgtacaacttgatgttttgaaatacgcctgcattttggaatagctcaattatgctaatgcatgttacctcatccacttacctatttgtgatgagaacactttgagtagattttatcagtaattttcaactctaaaatacattcttattaactacagtcagcacaagtacaatagattctttgaacttatttctcctgtcaaattgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacatgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaaattcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtgtatgaatatgaaaatttgatatggatagatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctgattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctctgtatctctctctgtgtctctttctctcttttcatctctccctgtttgtctctctctgtttttctttctgtctccctccatctgtctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtgttagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcgcttgaacccgggaggcagaggttgcagtgagccaagattgtgccactgcattccagcctgggtgacagagcgagactctgtctcaaaacaaacaaacagcaacaacaaccaaaaacccacaaagtcataaaccaagaaatagctatcagatttttggacaactttcatcacagcattttacccatggagacagtagtattatccccttgctcaatttatatcaattttattttatttattattattattattattattattatttttgaaatggagtctcgctctgttacccaggctggagttcagtggtgcaatctcggctcattgcaacctctgcctcctgggttcaagtgattctactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaagccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaatcatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggaggcagaggttgcagtgagctgagatcatgccactgcactctagcctgggcagcagagtgagatttcatgtcaacaacaacaacaaaaaaaaaaaaaaaaaaaaaagagagagagagaaaaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaggtccggagatgcagaccatcctggccaacatgatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcactgctgcactccagcctggtgacaaagcgagacttcatctcaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacgctgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaagttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatgaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaatgtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctatctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatagatacatacatacatacatacatacatacatacatagatacatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcctggtagagatatcaccttcctgccttttataattatcataggtggccgggcgcggtggctcacgcctgtaatcccagcactttgggaggccaaggcgggtggataacgagttcaggcaatcaaaaccatcctggttaacactgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgtgtctatttggtagaatgatttatttccctttgggtagacacccagtaatggcattgctgggtcagagggtagttctgttttaagttatctgagaaatctccaaagtgctttccacagtggctgagccaatttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccattagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatatatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaataatttatactacttaaaaataaagtatcataaattgtttaggccaggtgtggtggctcacgcctgtaatcccagcactttgggatgccgaggcaggcagatcacctgaggtcgggagttcgagaccagcctgaccaacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatttatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaatttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttcc

SEQ ID NO: 4203 - DNA, 38073 bp, human
ccgagctgcctcacccccggccccgggaagggcatggccccggcaaactcccggccgtgactcgcgcgccccggctcggtggatgctcccggcgcaccgctcccgtgtgcggcggcttcccaaggacaggtgaggacccagggtggccagggcgccccagggctgccgtgtctgcctgcagggggtgaagggatttgagacacccaagggaaacactgggggtaaagggcctgcatgcaggcagattgcaccgttccccagcactgtttgaagttgctaagaaatcaggatacctgaattcctgcaattttaagtagctaaggatcagatagggaggagagccggatcttgaaggaggatgcactgaataggtctaattaagcccagacatcccatgcctcctttcctccctctccccaaagcgctccccatccctggctctctctggagaccttcaaccccgccatcccgcgtttctaggaagctgccaacggaattcctaagtgaagcccactctgctcttgcaatcggtgggggaaaggacgcttgaggagcctctttccaagttgctcaggctgtggctacttcaagtctcctctccctcctctcttccccctctccttccccgcctctttcctcctactcttacccaggctttccctggaaaggggacagcccaacgcctagagtgatccgagccatgcaaaaaaaccgggacagtcatcacgcagacaaaaggggtttggtgtccgagtcccgggcggcggggactcgcagggccaccccagccgcgttccgggaaagctcgtaattcatcccgcagccagctcgacgcgacccagcggactctggaagccggccaggggctcagggctgcccgcccggccactccaggttgtctgcccagggccaagacgaaagcagacggcctcacgcccccacccctgcttcccggcggggttcgcagaccgtctctggcggcctagctggcgccaggccgctttctccgcggcggagagacccgaccccgagtccccgggattagggttgtctgggggcgagtttcctgggtctcccgggaggttggtgccggggtgggaggccggacagggagttggggctgaagagtcctatggaacgcccgggccaagtccgcccgcaggcacaggacgctggggactggcgcggctgcccttggaaccagcccagcgccgaggtcaggcgcgcaggcaggggcggggaaagcccgggctctggcgagagagaaaactccgaggacttttgcagagctgcaggagccggtttgttccagcgcccagaggcggagcccggacttgcttttttgcaaaactacctgtgcgccatcagttctttatgggcagctgaagggagacgcgcccccgggcttaagagaataaccttttctaggtcacttaaaggcaggaaaagctacaggtttgggatgttcctctcttataggaaggattttagaattttatttttattttttgagacggagtttcgctcttgttgcccaggctggggtgcaatggctcgatctcggttcaccggaacctctgcctcccggattcaagcgaatctcctgcctcagcctcccgagcagctgagattataggcatgcgccaccacgcccagctaattttgttttgtttgtttgtttgtttgtatttttagtagagacggggtttttccatgttggtcaggctggtctcgaactcctgacctcaggtgatccgcccgcctcggcctcccaaagtgttggatgacagacgtgagccaccgagtccggcctgggttttagaattttaatcagcagttcgcgctcgttcagaacccgggcgaatgggcaggcgcgtgtttgttgtgtatccctatttactttccatgtgtgtcactatttttaagtgaacgccattcaagagatgacaaaaatgttagatgacataggcattgccaggacaagaagaaaatgatcaccgccattctaaatgaagtagctgatgcaatctagctttacccgagcttttccattttttagtgactccatttttttctgtttgcctgaatatatttcataagcagtcccttcctgtttattgaatgatcagaggttcccccaaacttcctccccgattaacagcaactctatatcatcaaaaaaactctctggcttttccaagacaaaaacataaggatagtaaataaacccagaaataacaggatgaatatccttctagcaaatacctctttaagctcttcaagaagctagaattaaaggtttgaaaaatatcattaaaggaaagaatacgaataaacacttcttgggaagttttaaattcaaatatatgcaatatataatggctcagtcttgttggaggcagaaacacaatattttattattttttaattatggatacataaatataaacctctttcttctctctctctctctctctctctctctcgtctctctctgtttcatagccgcaattacagagtgcaagatagatttccaaatcatagtatcgaagccaagaatcaagactatattctatagtcatgattaaagtgaatggtgaaaagtttagaaaaaaaaccatgtttcatctttctcaattcccatggtttaagcgtcactacaacacatcgtgtgaagtcctgggaagcttgaaaccctgatgcacaattcaaatttaaaaattgcccacagttcgtcggtgctacctgtgaataagctcatctcttcgttgttctacctcaggtatccgagaatcaggcaccccgacaagatgcccaagcgcgcgcactggggggccctctccgtggtgctgatcctgctttggggccatccgcgagtggcgctggcctgcccgcatccttgtgcctgctacgtccccagcgaggtccactgcacgttccgatccctggcttccgtgcccgctggcattgctaaacacgtggaaagaatcaatttggggtttgtaccactttcttcccgaaccttcccactgtcagtgcgtgcgtcttgatctggttttgcgtgtgtgtatgtgcatttacttaacttcatatgtgcatttcctctgtgtagctctgtcgagaattatggagctgcagatgggcagaatagagagaaaaagttttagttatgctaaacgcagctttttcgatgattatctcaatatatccatcagctgccactgctgtaaggtctattaacgagcagcatgaacaactttagagtttgttgagaaattcccttgatagcatttctttaatacattgttgaggtgaatgcatgagacacacacttaaacatatgaagatgatttaagtagacttcagcaacgatttaagaataataaaaataagcagaacatctgtgccattttataagtcatgtagatgatagaattgcgactttgaggcaataaaagagttcctgcagattttgcctgttaaaaatatcaacgtctttttaaaaacctattttgatgtggcttgccagacagacttttaatatactggtttcattttatacacacgagggttgtgtggaccgaagtgttagttgctatgaactacaggtgctcaactgcaattttaatagtcaacaatcatttggagttcgtcaacaaaatataatagctactttttagcatccatccccagaacaactgattaaattagtgtttgtgaaatatccaccatggagatgttttagtaaaaataaaatggccagatttgagccaatgcaaaataactgtaaatgtacctggacatcttatagaacaaagttaaaagaaaaaactctcctccattgacagtggtagaagaagagaatgaaacattgagataataagatggaaatttctctatcgacagtggtagagtcagggaatgaagtgttgagggagtaagatggaaacttccctgttgacagtggtagaataagagaatgaaacgttgagggaataagatgataatttccctaacccatggcaacagaccattaaataggtttctcaatgaaatgctgttagactttatgagttgaccatctgaacatccaaccacaacaatgatagctcattggggaaaacagcttggcgttggcagaggagggaatagtaacacataagccagcttccctttttacaatcttgtaatttatcggacacatttcttgtgtaatggaagtaagaaaaagggaagaggtgctaaagcccattagttttgtttatttatttatttacttaactttaagttccaagatacatgtgcagagtgtacaagtttgttacataggtatatgtgtgccctggtggtttgctgcacctattgacctatcctctatgttccctcccctcaacccccaccccccagcaggccctggtgtgcgttgttcccctccctgtgcccatgtgttctcaatgttcaactcccatttatgagtgagaacatgcagcgtttggttttctctttcccttgttagttcgctgaggatgatggcttccagcttcatctatatctctggaaaggacacgatttccttcctttttatggctgcatagtattccatggtgtatatgtaccacattttcttgggcatatgggttggttccatgtctgctaaagcccatttgaatcctgggggaaggtgcgtgtgatatttgcagaacagaaagtggggctttaactgtaacttctttttcctccacccttggtgtgcaaaatggctctgtctaggaattgttttttatacatgaaccattttaacacatggtctaacttgctgggattagccacctcatctctcaaacccagcaccttggcaggtcccatgctgggggtaccatcagccaggccttggtggagccctctaaaaagcttggggttgatgcagaatgtatatattttatatatattatctttataatatatataatatataatgtaaatatacatattatataatatataatatatgtatactatattatatattatatatattatatataataataatatatattatatatattatatataataataatatatattatatatattatatataataataatatatattatatatattatatataataataatatatattacatatattatatataataataatatatattacatatattatatataataataatatatattacatatattatatataataataatatatattatatatattatatataataataatatatattatatatacataatatatagtaataatatatataatgtaaatatacatgttatatataatataatatgtatattatatatattaattatatattatatataattctattatatattatatatataattatataattatatacattatatatattattatatattatatataataattatatattatatatattatgtatataatatataatatataatatatgtataatatataatatattatgtataatatattatattatattatgtataacatattatgtataatataatatattatataatatataatatatattatacacaatatatattatacattatatatatcatgtataatatatattatacatgatatataatatatatctattatacataatatatatctatttgcggtgcttcttgcacagcaggtttgtgtgtttgtgttgtgtgttgggaagggggatatcaggctggaaatgagggtggagacagtccctgcatgcaccctccccaaagaggtgatttgtttaatggcttgagacttacagcaccaacaagactattacttctgaagttgtttgcatctcatttacagtttctgggatgcttttcttcccgttcatttttaaactgaagtactttgtaagtgcaaaacataactaacctctaaattacaacaccatttctgatggtttcattttaaacaactcacgataaagattgactttaacgtaggaataaaacagacataccaacatgttaaagtttctttttcctattgctgccagtaatatctagagatagttttctgtaatattaaaaagaaaagaaaaagtttaaaaccctagagaatcacttcactgcatcaacatctattacttccatctggtttaatttgtaacaggaactaatatactacttgaaaaaaatcactaataatatcataatagcattgtttcagaaaaatcaatctcaaattaggtaatgagtctggcatcttgcattttgttggggaaaaaactgaaacaagagcaatgtctaacagataaaactcagagattgatttgtgttttaacagtctggagaaaatataagactctcaaggaatgaggaattgttggccaagtgctaatgaaaccttctattcccacacagctgtttttagggttctttgtcagcattgctgtttcctgcttggacaaactaaaagcgtttctgaaaattgctttccaaatattttttttcaggaaccaacaacatagcatccacctagagatggatttacagactcttaagtatttttttccctctattaaaagactggttttgatgatgcctttctgcaacttcaacaatgcccatacttgcctattttattttaagttctgccttgtgatattaaccggaaccgaagacataattttgcaaatattgtctgccataaacatttcacagagttggttatacattcagtgattgccaatcaataggcgatgaagatagtctggaatgtaagccaaggggctaataagccatagaactgcactttatgcagggtcatcccagtctccagttagattctgttccctgagtgtcgtgctaatttcccagactctgctgatttttagaaggatgcaagaaggggacatgtatacccttgggttctgagagggggtactcaagtgattccctgggcttctgtatgttccagaatatccgccccattctcacatctggcacccttggcatctgcatctgcaagctctctaatgccccttaaaaacaagcaggggggtccgggcacggtggctcatgcctgtaatcccagcactttgggaggctgaggcgggtggatcacgaggtcaggagatcgagaccatcctggctaacacggtgaaagcccgtctctactaaaaaattcaaaaacattaactgggcgtggtggtgggctcctgtagtcccatctacttgggaggctgaggcaggagaatggcgtgaacctgggaggcagagcttgcagtgagccaagatcgcgccactgcactccagcttgggtgacagagcgagacgccatctcaaaaaacaaaaaaataaaacaacaacaacaacaacaaaacaagcaggggcaagatgacagggtcaggcaggtttctgagctgatgtggagcccgtcccagactttgggtgccttcctgaaaggggaatttattcagatgtgaagggaaatcaaccagtattatcctttgttcctattttcccttcttctccaccttgatagttgtgatcaaaattctcaggttaaatttgacattcagctatccatggctttagtatgagccattctgtttttctcaatatctatctatctatctatctatctatctatctatctatctatctaactatctatctattatctatagtctgcctattacttgtctacctacctatcatctatctctatcatcaatcaacaaatctatctctctacctgtctatatctatctacctacctatctatgtatctatctatcatctatctgtcatgcatctgcctatcacctatctacctacctatcatcatcaatcagccaatctatctctctacctacctatcatctatctatcaatctatctatgtatcatctgtctgcctatcacctacctatcattgatctctatcattatctattgatgtatctattctatctatctatctgtctatcatctattaatctacctatctattctctatcatctatttatcaataatctatctacctacctatcatctctatcaatcaatctatctctatcatgtattctatctatctacctatcatctatcatctatctatcacctatgtacctgtcatctatctttatcatctgtctagctatatattatctatctatctatgtacctatctatcatctgtctggctgtctatctatctatctatctatctgtctatctatctatctatttatcatctgtctgcctatctatctatctatcatctatctatgacaatagttatcaacaatggatgagtttgcccctggaaaacatttggcaacatctggagacctttttggtgaccacaactatggaaggagaacatatcacacccttgaagtaaaatgtgctgaggaacatccagctgtttctgacccatttcagagacagagcctcagagccctatctcctctgtctgaagatctgcctccttcttctgggctccgttcaggtgatattatttactcccagggctctattccattggtcggttggccagtctcccctgaacgtgcatcatgggtctccatcttggtcttgagccctattctccccttagattcttacaaaattctcaaacatcccatggcaaatacagctttgaattctttccccaacacctgtctctcccagcctttgctgtccagcaaatgatagaatccacccacttactcccctccaagtagaagtccttcccccaagtttgtcctcattcccactcccaccactcagcaatgcctgctggctcttcctctaaatacattcggaaatgttctgtgtgccttcatgcttactgccacacctggtcatggatccaacatccctcaatatctctgcaggattcacctcatttctgcctccctcccttgcccagctctgacacgttctccaggaagtggccaacattgctgttttaacacatacttcagttcatggatgaatagatatataattgatatatagattataacagatagatgcttgatagatgataggatgatagatggattgatagagaggattatagatagattgatggatgataggtaggtatagggtaggtagatagatagatagatagatacagacagagggacagatagacaaatttgcacgtgctaaggcaaagttaccaaatttctgcaatcttgatgtttaggactgaatcaatgtgggttgtaggggccatcgtgtgcattacaggatgttgagcatcatctctatagagaacaaatcaatggccgtgccataaagtgggcaagcttggtgagtctaaggaacagaaagatggccaataactctgaactttatggccaacagcaaaataccagagagctaactagttgtccaccacggaatattcttctaaaatgatgaggccatgcccaaacgtccctttgtttcttaagccctacttcaaatctcagctccccagagagccctgccgtagacatcggccaaccaaaccccttctactctccttcctgtgctttaattatttccttatgaaatttacaactatctgaaatgatctttttcattatttttacctttctagtcatgcttcttgctaagagagctgagcccttgcctatttggttgacccacccagaatagtaacttgcagacacacaaagctcaaattatagctgtgactgcgttgcagaatgaatccatgcatgtagaatctgtagcagacatcgtttcatattgagcgaagttcaaacagcacctgccttattttccttttgatttctccatctctaaaagcattagaacttgttttcagagcccactacatcctgaaggcacatacgaagctgatctgtacaaagtttttgcaattttttaaagtaaaattcaaatgacatggcattcacccttgtagcctctacaattcagtgccatttagtacattcaaactattgtgtatccatcatctctatcttgttccaaacattttcaccaccccaaaaggagacctcatatccatgaagcagtcattctctactccctctcctcctccagcctttgggaaccactgctttgttttctgtccctatgaatttgactattctgaacatttcatatacatagaatcatacaatagatcagcggtccccagcctttttggcaccagggaccagttttcatggaagacaatttttccacagacaggattgtggagggagtagttttgggatgactcaagcatatcacatttttgtgcactttatttctattattattacattgtaataatataatgaaataattctacaactcaccataatgtagaatcagtgggagccctgagcttattttccttcaactagacagttccatctgggggtgacaggagacagtgacagatcatcaggcattagattctcataaggagtgcgcaacctagatcccttgcacacacagttcagaataggatttgtgctccaatgagaatctaatgccgtcactcatctgacaggaagtggagctcaggcagtaatgccagcaatggggaatggctgtaaatacagatgaaactttgctggctcacccaccactcacctcctgctgtgcagcttggttcctaactggtccggtactgctctgtggcctggggtttgaggaccactgcagtacgtgacctgtagggcttcttgcagtgaacaacatggttcaagggtcacccacatggtagcctgtgtcagagcttcattcctttttgtagtgtgcatcttgagcaatgattactgccactgcatagtgattttgcagaaaatcaatttaaagagtgaatgagaatatgtgccatgtagacttctactctgtcgtcggcatttctgaaatgtacatttagactctctttgcttctcactcacgtgcattgcatttttcctcatggctgttatttcagtcaaacaaaaacctctgaacaattctgaggatgccatccgcaaacataccctgtaagaccttcttggccctctcttgtgtgctaaatcatctgtgcttgtgtttaaataagaagaaataaggtattcttttaaaaataaaaatggcggccaggcgcagtgactcacgcccgtaatcccagcactttgggaggccgaggcgggcagatcacctgaggtcaggagtttgagaccagcctggccaacatggtgaaaccctgtctctactaaaaatacaaaaattagccaggcggggtagcacacgcctgtagtcccagctactcgggaggctgaggccagagaattgcttgaatccgggaggcagaggttgcagtgagccgagatggcgccactgcacttcagcctgggcgacagagggagactctatctcaaatgaataaataagtaaaataaaaataaaaaaataaaaaataaaaaatggcaacttagtatggtcattatccatgattgacacttcatttacccacaagatgggaacttaaaaaccctgcaaacacagcaacaacaacaataatgtccccattatagaggagaggagactctgaacgacgctgaatgcatccaagaatacacagtcactatggtaaaacacaaggatcttgagaccaaagctttaccttgcattcagggacgattaactgaggcgggagaggctatcaatatctacttgacactttattttatttagtgagttgaaacatatggaatcagggtgcaaagttcctggaaagataacgtagcaaagaatgaattagaaatgtatcaggtagatttctactctggagtcagctgaaatcaggtctgaaattggtcatttgagtgtctctgagaagaatcattgaatggacatgtttacgaatattatgattcctgtatgatttttacattattcatattatgtataaatttttgaacatctgaatatgttttcattgaatgtctttattcatataacatattgctcattattcccctgcctaactacattttagttgccatttttaactcacgaattcttagcatgtctctttttgtgtcttgcttggctgtgactttccctttgatctccctggtatcagccttggtgtacctattccctccagaaactctgtagcagtccttgacacagagcaatgtctgagtggctacagacattatgtcctttaacccacacagggctctctgaaaaaagaatcctcagtagcattactaatgaagagtttgagcttccaaaaagcttggtaacttctctgggatagccagcgggcaacgtgaagtgtgcctgacctcaaaacatgaggcctagagggtgtggtggctgacatctgtaatcccagccctttgggaggccgaggcgggtagatcacttgagctcagaaggtcaagaccagctcgggcaacatggtgaaaccccatctctactaaaaatacaaaaattagccaggtgtggtggtgtgtgcttgtagtcacagctacttagaaggctgaagtaggaggatggcttgagcccaggacacagaggttgcagtgagccaagattgtgccaccacactctggcctggacaacagagccagaccctgtcttgagagagagagagagagacctttctatgcttctatctcacctctaaggatctcacgtctacacactgggacctcctttccccacccagcttgcagtagtcaacaccttccttcccctttattatactctgcaggaaactgctgagctcatgattggaaaaaatgcacctctttcttctcttacttggaattttacccactgaggaggttcatggtccttaacatgaaataaagcttcatgcccttgaatttcacttatctttgcagcattatatttcggggagttttgcaccatgattccatgaatttgaactcactaaataaaataatgtcaagtagatattgacagcttctcccacctcagttaacagtgtctgaatgcaggttgaagctttggtctcaagatacctggattttactctcactgactgtattcttgaatgcattcaatgtcttctgtgagtctcctcttctttgtaaaggggacattattgttgttgtcactgtgtttgcttgtggaatatttaagttcccatcttgttttaataagaccaaagtaccactaggtaataggaaaaaaactttggaatggaacattgcatggtttatcctcttttttcctattccttgaaaattttggaaagtttctttttttctttctttcttacttttttttttttttttttttttttttttttgatatggggtattgctctgttgcccaggctggagtacagtggcacaatcacagctctctgcagcctcaacctcctgggttcaagtggtcttccctgcttagcctcctgagtagctgggaccacaggcatgcaccatcacacccaactaatttttgtattttttgtagagattaggtctcactatgttgcccaggctggtcttgaactcctgggctcaagtgatcctctcgcctcaccctcccaaagtgctgggattataggcatgagctgccatgcccagcctggaaactttcttgaaactcagtttctgctgtggaaagttggcctgcttcatggggtttaggtgataaagggcaaaaagtaatacaaagaggacaaggctcaattccagctaagtttcccaccttctatggaatccaaagcatgttcataaggtacacacatagctatgagcccaattcttttaatattttacctctcaccagtgttaaataaagcagagcttagctgacaagacactggagtaatgcactaaaaagaagagtgaaaaatatcatgtaatcaagaagagagaaccactatatatgattgttcattgactacatgagtcaaaatgatgaacaggaaataggatcatcttctactatattttccccatacaccatattgaatctatacaacattatttcaataaggtgggatgcatttaattccatctgatgttttctttgcataaatttatcttaaaaagaagaatgtggccgggcgcggtggctcacgcctgtaatcccagcactttgggaggccgagtggggcggatcaggaggtcaggagatcgagaccatcctggctaacacgatgaaaccccatctctactaaaaatacaaaaaattagccgggcgcggtggcgggcgcctgtggtcccagctactcgggaggctgaggcaggagaatggcgtgaacctgggaggcggagcttacagtgagccgagatgggccactgcactccagactgggcgacagagcgagactccgtctcaaaaaaaaaaaaagaagaagaatgcaattatgaaaggaggtctttgaaaagtttgatgcaatcaaggtgaatggtttttgagggtagagcttataaatttcctgcactcaaaaatttgtagctgaaaggtgcttcctaaggctgggtcttaggggagtcacacctaacctggtgtttctgttgactttggaattgtagtccaggtttgagcacatatgagtatgagaaaattggaccatgctagtatctgctgcatttagctatgagctgttcacttatgttccctgctaattgatttccttttatgtaagtgataagaagaagcaatcagtgatatcaggctagatgtgttatgtctcagcagaaacagtgatttatggtaacagcgtgcaggcttctctattcctttttcaaattgcttatccagggatcaagtttaagcattgttgtatgctattaccaatatggcaatgagaaatttctaaattggtcaagaaagcatcttgacaattatatacacaacaacaaaaaaccaaaaatttaaaacaaaaagaacttatcttgaggacaggttacaggaagaaacaaaacaaacaagaaacctagcatgtctacgagtaactttgatcatccgtcagacatggcagcctgtccatgggaaataagagtgttggtgtctgtggtcaacatttctatttggcctttagcatggagctgtctcctttcttaccatatgcaaagcaaattccaatgccgtggattttcccggccctgctagccacgtgtccctctttattactgtcacttcagcacagagtttccaagaaagagacacgtggaacagcctcatgttgaattctaaatcctactgatggacacaccaaatagcctcctgaccacaacagcatattccaagtcaaagttctccatgaatgttccttagcagactgaagacaaataaatacatgtcactttcttcttgaccccagagatagggacacgaagggataaacgtctttgggaatggcacccctgtaacctcagaatcactacttcatgaccaggtgcagtgactcttgcttgtaatcccagcactttgggagcccaggcaggagggtcatatgaggccaggagttccagatcagcctgggcacatatgaagaccctgtctctacaaaaatgaaaaataaaaaattagccagggatagtggcctgtgcctgtagttccagctacttgggaggctgatgtgggaggattgctggagcctgggaggtggaggctgcactgagctacgattgcaccgctgcactccagcctgggtgacggagtaagattgtctctaataaataaataaatagacaaaaagactcaccattttactaatttgctcttgggcaggctagggaatgtttcccatatgggagttaagtattcgctatttattttcttaattattattattgttattattattattaccattctttaggtttaatagcatacaggccctgtcagaaacctcatttgcaggactgaccaagttggagctacttatgattcacggcaatgagatcccaagcatccccgatggagctttaagagacctcagctctcttcaggtaaacccacggcatttataagcgtcactaaattgcatcctctaagaccagtaataaagaatagaaattatgtcattctccttaatgatcaataaaacggctattgtttgacatgaaagacaagcttcatgtcattactctccagccctttgtactggtttctgtttgtggttgtggctttttaaactataaacaggatccttttgttttgttttgttttcccctgtccttgcaggttttcaagttcagctacaacaagctgagagtgatcacaggacagaccctccagggtctctctaacttaatgaggctgcacattgaccacaacaagatcgagtttatccaccctcaagctttcaacggcttaacgtctctgaggctactccatttggaaggaaatctcctccaccagctgcaccccagcaccttctccacgttcacatttttggattatttcagactctccaccataaggcacctctacttagcagagaacatggttagaactcttcctgccagcatgcttcggaacatgccgcttctggagaatctttacttgcagggaaatccgtggacctgcgattgtgagatgagatggtttttggaatgggatgcaaaatccagaggtaagaagagaggagagcagaccactcctagctgcacattcttttatctttttggagacgttccattctccaaggttcttatattgacttattcaatgaaatctgagcttcgatgaaatctgagcacccaatcagctagacaggaactcagactttaaacgttaccacttaaatgttaagacatctccattccccaacgcaaaggcagttatcccttagtgaaatgtagtgctcatgtaatcagttacatacaggtgatgtgggttgccatggaatgggtatctggaggatcatgccagccttggactgcagcttaatgtgggaaactgggactgggaaggggctgtgaatccatgttccatgagaaattcacaaaggatgcttggaaaagagcaggctggtgagaggagtggctacaaggtcattattttacggacacggaagcgattctcactattgatctagagagctatgacaacaaccaggacttatgtgttgcagttgcaacaaagtagattgtgattcctttctgccttccttccttctctccccttccttcatcttccttccttccctccttccttccttccctccttccttccttttctctccttccttccttccttcttctctccttccttccctccttctttccttccctccttctttcctttcttccttctctccttccttccttcttttttccttccttccttccttcttttttccttgcttccttccttctctccttccttccctgcttcccaccttccctcctttactccttcctgctctccttccttccctccttctcaccttccttctttcattttttccttccttccttccttccttccttccttctctccttccttctctggttcccaccttccctcctttactccttccttgtctccttccttcattccctcctcctctccttccttccttccttcgttctctccttccttccttctttccttccttccttcattccctccttccctccctgcttcccaccttccctccctcgctccttctttccttccttcgttccttccttccttccctccctcgctccttccttcgtttccttccttccctccctcccttccttcattccttccttcttccttccttcctcctgccttctctcctgccttcctttcttccttctgtccttcctttcatccctctcttccttcctccattcctccccccttcactctccctccctccctatcttcccttccttccttcctttctcccccttctctaagccctaccttgcaacctatccccatccttagattgcattgtgtttaccatatcctggatctatttcctcaactccatcctcacagctgctggcctggatcaagctcctttcctctctctggtagaaagggggagcattctaaacaagtgtccccatgtccttgtcagccctgttttccattcactctctacaaagcagtgagaacatttttacaggatgtgcacccattcaggccacacctctgcgtaactgatttccattgcttttaggataagatacacatttgcacattccctccaagaagtctccacacaatggtcgctccacctgtccccactatcctctagcatggtggtcccattgctcttcttattcgtttatttctagccacacagtcttcccgtctgttccttgcagcttctaaacttatttccaactcaacatcattggatttgctcagttgcctacttgggagtctttactgctagacattcaagaggcttgctttttcttagcttttagagcttcattccaagaggccatcaagcaatggatgtgggaaagacagaggtacacccacttgtgaatggtcttaaccagaaaagacacacgcctcctccactcatatttcattggtgggaaccagtcctcacaccccagtggatgtaagggggcctgaaaatgcatttggatggctattttgtagcagcaacactatattatggatgtggacccacaaaactttgctgggcaaagaaccatctctgctactgtctggagatacgcatgcatgtctttgtgtgtgcatgtctatgcatgtatttgtgcacatgtgtgtacatctgtgtatgtgtagatttgcatgtatgtgaaagaaactcaagattgtaaagtattaaggttagttttatatagtgagcatttctgaagattgcaatcccaggatctttcagagagtttctgttagactgctgcatagcaaggtttcagcccacagcttatacacagatggtggagtttctgcaggtgctcagaagtcacaccaaatgtggtcagaattcacatcagttgtgctcagaagttatattagagctgattctcatcaaagtttgggtgccaggggacatctggttatagattacagaggcatagtccttaatcctgccagacattatcttatgtgtagaaagaggcaggggctaggagcattgaactcatcttttctaaaagtgcagtgattcaggcaagagacatgtggacctgtgctccatcctgctcatcatcttcagggcattcatgtagaggctgcgctcattcgctgagccatgaaattcagctggccaagggattttgtgaaatgctcctgcttgtgcttgctgccttgtctcacagcatgtatgtgtgtgggtatgagtgtgagtgtgagtatgtgtatgtgtgttggggggagatgtgcaaaacaatcctattcgcatgttgaggtgtttgctttgaaagtcacacagaaaaccatggtcaggagggcaaaaggaaagatggcaaagccagttaggagctttataattctccaagtcatagatgaagcagtatgactggcttcttcccaatgggaacgggcagaagtaggcagaggactgccatgaaaaactcctagtcttccagtttccccaggcagagagagtatggcatcacttactgagatagaacaggcacgagattctacatttaggtcagggagagaatataaatttgtttcatagatgtcagtttgaggactcttcttgctatctaaatagacatgtcaaagaggcaatggggtgtggaactcacggaatgtgtttggactagagaagcacatatggtagtcatcactggcgggtggatggtaattggaaccacacatatgcgagaggccattgacgctgaagccgaccagaaaggaaaggggcttaggctcaagtcaaggaggacccagtcagcaaagattcaggcagaggaggaggaggaagcagtgactgagacccagttgtggccagaaaggacggagaaaattccagaggatttcatatccaggagaccaagaggacaacgtgaactcaaaagcaaacactctgtgaagtgtttactacaaatatagagagagttataaatatagatatagttacctagatacatacgtattgattatatatacattatatattataaatgtataaatatagttataaatatagatatagttacctagatacatacatattgattatatataaattatatattacaaatttataaatatgcagagagttataaatatatagtccctagatacatattgattatatataaattatatattacaaattataaatatacagagttataaatatatagttcctagatagatacatattgattatatacaaattatatattataaatgtataaatatatagagagttataaatatagatatagttacccagatacatacatattgactatatatatttatatataaatatataaattatatattataacttataattataaattatatattataaattataattataaattatatattacatataatttatatatataaatatatataaatgtatttatgtataaatatatataaatatatataaatgtatttatgtataaatatatataaatatatttatatataaatttatatataaaatacatataaatatatataatatataatatataaattatatattataaatttataattataaattatatattataaattacaattataaattatatattataaatttatgatttaaaattatacattataaattataattataaattatatattataaattataattataaattatttatgaataaatatattattatatatttatttataaatatatgtacatctataaatttatatattgttatatcatgacttaaaaaagtaaatatgatgtgatacatgccaaagattcttccttttacctgaaaatactttcaaggggtttatatatttatatccatatttaatttacatattatttatatatacttagatataaatatacattgattatatgtcaatatatctacatattaatatatatttattaatatatcaatatatgtttatatatcatgatagatatatattatataaatatatatgtattatatatctatatgttatctatctatatatctattaagatagatacatatttgtatatattgagatagatatctatcaagattttttaatatatattggtatatatatcaagatgaaaaacaacaaaaattagatatgatgtgatacgtgcaaagattcatccttttaccaagaaatgcttccccagtttgcagtatatttatatagattctcctaaactttcacagaagttacattgtaaaatgtatgtgaatgaagttgttttctttaacttagaaatgttttttaaatacccgttagtaagtattttaagacatttttaagtaaaaattattattaatggttaagcagttataaagcacccgttagttaccacacagtgtgctaaaactgtggtttaacatgaagcctcaaaggcaactcatgtataggattccttgtttatgggattacagctgggtgataaagatgcaaacataggctttatcctctggccatgtgcaaggcatgccattctttggctccttaccctattgtctatttgcttatttgttttaggaattctgaagtgtaaaaaggacaaagcttatgaaggcggtcagttgtgtgcaatgtgcttcagtccaaagaagttgtacaaacatgagatacacaagctgaaggacatgacttgtctgaagccttcaatagagtcccctctgagacagaacaggagcaggagtattgaggaggagcaagaacaggaagaggatggtggcagccagctcatcctggagaaattccaactgccccagtggagcatctctttgaatatgaccgacgagcacgggaacatggtgaacttggtctgtgacatcaagaaaccaatggatgtgtacaagattcacttgaaccaaacggatcctccagatattgacataaatgcaacagttgccttggactttgagtgtccaatgacccgagaaaactatgaaaagctatggaaattgatagcatactacagtgaagttcccgtgaagctacacagagagctcatgctcagcaaagaccccagagtcagctaccagtacaggcaggatgctgatgaggaagctctttactacacaggtgtgagagcccagattcttgcagaaccagaatgggtcatgcagccatccatagatatccagctgaaccgacgtcagagtacggccaagaaggtgctactttcctactacacccagtattctcaaacaatatccaccaaagatacaaggcaggctcggggcagaagctgggtaatgattgagcctagtggagctgtgcaaagagatcagactgtcctggaagggggtccatgccagttgagctgcaacgtgaaagcttctgagagtccatctatcttctgggtgcttccagatggctccatcctgaaagcgcccatggatgacccagacagcaagttctccattctcagcagtggctggctgaggatcaagtccatggagccatctgactcaggcttgtaccagtgcattgctcaagtgagggatgaaatggaccgcatggtatatagggtacttgtgcagtctccctccactcagccagccgagaaagacacagtgacaattggcaagaacccaggggagtcggtgacattgccttgcaatgctttagcaatacccgaagcccaccttagctggattcttccaaacagaaggataattaatgatttggctaacacatcacatgtatacatgttgccaaatggaactctttccatcccaaaggtccaagtcagtgacagtggttactacagatgtgtggctgtcaaccagcaaggggcagaccattttacggtgggaatcacagtgaccaagaaagggtctggcttgccatccaaaagaggcagacgcccaggtgcaaaggctctttccagagtcagagaagacatcgtggaggatgaagggggctcgggcatgggagatgaagagaacacttcaaggagacttctgcatccaaaggaccaagaggtgttcctcaaaacaaaggatgatgccatcaatggagacaagaaagccaagaaagggagaagaaagctgaaactctggaagcattcggaaaaagaaccagagaccaatgttgcagaaggtcgcagagtgtttgaatctagacgaaggataaacatggcaaacaaacagattaatccggagcgctgggctgatattttagccaaagtccgtgggaaaaatctccctaagggcacagaagtacccccattgattaaaaccacaagtcctccatccttgagtctagaagtcacaccaccttttcctgctatttctcccccctcagcatctcctgtgcagacagtaaccagtgctgaagaatcctcagcagatgtacctctacttggtgaagaagagcacgttttgggtaccatttcctcagccagcatggggctagaacacaaccacaatggagttattcttgttgaacctgaagtaacaagcacacctctggaggaagttgttgatgacctttccgagaagactgaggagataacttccactgaaggagacctgaaggggacagcagcccctacacttatatctgagccttatgaaccatctcctactctgcacacattagacacagtctatgaaaagcccacccatgaagagacggcaacagagggttggtctgcagcagatgttggatcgtcaccagagcccacatccagtgagtatgagcctccattggatgctgtctccttggctgagtctgagcccatgcaatactttgacccagatttggagactaagtcacaaccagatgaggataagatgaaagaagacacctttgcacaccttactccaacccccaccatctgggttaatgactccagtacatcacagttatttgaggattctactataggggaaccaggtgtcccaggccaatcacatctacaaggactgacagacaacatccaccttgtgaaaagtagtctaagcactcaagacaccttactgattaaaaagggtatgaaagagatgtctcagacactacagggaggaaatatgctagagggagaccccacacactccagaagttctgagagtgagggccaagagagcaaatccatcactttgcctgactccacactgggtataatgagcagtatgtctccagttaagaagcctgcggaaaccacagttggtaccctcctagacaaagacaccacaacagcaacaacaacaccaaggcaaaaagttgctccgtcatccaccatgagcactcacccttctcgaaggagacccaacgggagaaggagattacgccccaacaaattccgccaccggcacaagcaaaccccacccacaacttttgccccatcagagactttttctactcaaccaactcaagcacctgacattaagatttcaagtcaagtggagagttctctggttcctacagcttgggtggataacacagttaatacccccaaacagttggaaatggagaagaatgcagaacccacatccaagggaacaccacggagaaaacacgggaagaggccaaacaaacatcgatataccccttctacagtgagctcaagagcgtccggatccaagcccagcccttctccagaaaataaacatagaaacattgttactcccagttcagaaactatacttttgcctagaactgtttctctgaaaactgagggcccttatgattccttagattacatgacaaccaccagaaaaatatattcatcttaccctaaagtccaagagacacttccagtcacatataaacccacatcagatggaaaagaaattaaggatgatgttgccacaaatgttgacaaacataaaagtgacattttagtcactggtgaatcaattactaatgccataccaacttctcgctccttggtctccactatgggagaatttaaggaagaatcctctcctgtaggctttccaggaactccaacctggaatccctcaaggacggcccagcctgggaggctacagacaggcatacctgttaccacttctggggaaaatcttacagaccctccccttcttaaagagcttgaggatgtggatttcacttccgagtttttgtcctctttgacagtctccacaccatttcaccaggaagaagctggttcttccacaactctctcaagcataaaagtggaggtggcttcaagtcaggcagaaaccaccacccttgatcaagatcatcttgaaaccactgtggctattctcctttctgaaactagaccacagaatcacacccctactgctgcccggatgaaggagccagcatcctcgtccccatccacaattctcatgtctttgggacaaaccaccaccactaagccagcacttcccagtccaagaatatctcaagcatctagagattccaaggaaaatgttttcttgaattatgtggggaatccagaaacagaagcaaccccagtgaacaatgaaggaacacagcatatgtcagggccaaatgaattatcaacaccctcttccgaccaggatgcatttaacttgtctacaaagctggaattggaaaagcaagtatttggtagtaggagtctaccacgtggcccagatagccaacgccaggatggaagagttcatgcttctcatcaactaaccagagtccctgccaaacccatcctaccaacagcaacagtgaggctgcctgaaatgtccacacaaagcgcttccagatactttgtaacttcccagtcacctcgtcactggaccaacaaaccggaaataactacatatccttctggggctttgccagagaacaaacagtttacaactccaagattatcaagtacaacaattcctctcccattgcacatgtccaaacccagcattcctagtaagtttactgaccgaagaactgaccaattcaatggctactccaaagtgtttggaaataacaacatccctgaggcaagaaacccagttggaaagcctcccagtccaagaattcctcattattccaatggaagactccctttctttaccaacaagactctttcttttccacagttgggagtcacccggagaccccagatacccacttctcctgccccagtaatgagagagagaaaagttattccaggttcctacaacaggatacattcccatagcaccttccatctggactttggccctccggcacctccgttgttgcacactccgcagaccacgggatcaccctcaactaacttacagaatatccctatggtctcttccacccagagttctatctcctttataacatcttctgtccagtcctcaggaagcttccaccagagcagctcaaagttctttgcaggaggacctcctgcatccaaattctggtctcttggggaaaagccacaaatcctcaccaagtccccacagactgtgtccgtcaccgctgagacagacactgtgttcccctgtgaggcaacaggaaaaccaaagcctttcgttacttggacaaaggtttccacaggtaagatgtttaagcatctactttttttttttttggtcaatttttattttattggctagcaatataatacattaaaacagtatatggtgaacaacataaacacattaggagaaatttttataacacatttggggaaattttttactcgaataagtgtttatttttatttttataacttcagcttttattttagacacagggggaacatgtgcaggcttgtcacacgggtatattgtgtgatgctgaggtctggggcacaaatgatcccattacccaggtagccagcgtagcatccaataggtacatttttcaacccttgccacccctccctctctcctctactagtcccaagtgtctatttgtcctatctttatgtccatatgtacccaatctacacttcaaccagagtttgtgtaggagaaagttactggagtcttactttaggattaatttacctttcttatggactcaagggcctctctgggcaggggtggctggccactgcaagcctgggatgcccatgcagccagctagcccgaggagttcaggagaacagcatgagcataaataaataagggagaggctgtgtctctagtaattgagcttgtggcatcttagctcaccttggaagtggctgggactcatgcctgcttccagaattctctattaaacccacatttgctgtcctttgcctgaagatggccctgtttctgggattagtgtaaagatgaaaaagagaaacaaaacattctttttctctatcctttttttacagcatacttatttcgtatgtgtgtgatgacaacacaaaatctactctcaacaattttcaagtataagctaaattgttattaactatagttgccatgagtataatatcacttaagcatattcctcctaactgaacttcatactctttaattaatatcttccctttactcccatccccagcccctggtaaccaccattccactatctgcttcagcttctatgagttcaactttcttacgctgcacatataagtgagatcatgcagtgtttgtctgtctgtgcctggtttatttcacttaatctaatgtcctccaggttcatttatgttgtggcaaatgacagaatttcgttttttgtttgttttttttttaaagaaaaagaaaagacagaatggcatttcattgtgcatatataccacattccctttatccattcattcattgatggacacttagctgaattccatatcttggctattgtgaatagcactgtggtaaacatgggagtgcagatgtcttgtcaacatactgacgtcatttcctttggataaatacccagtagtgggattgctagaccataggcagctctattgttagttttatgaggaatctccatactgttttccacagtggttgtaccaaattacattcccaccaacagtgtacgagggtgcccttttctccacatcttcaccagtgtctgtgtttttggtctttttgataataaccattccagcaggcatgagatgatatctcagttttacatttctttcatggttaggaccaaaacaggctgggtgtggtggctcacacttgtaatcctagcactgtgggtagccaagacaagagaatcacttgaggtcaggagttcaagaccagcctgggcaacacagcaagaccatgtctctacaaaaaacaaaaatttaaattatccaggagtggtggcctgcacctgtagccccagctacttagaaggctgagtccaggaggttgagactgcagtgagctatgattgtaccactgcactctcgcctgggagacagcaagaccctatctctaacgaataaaataaatataaaaaaaacttttaaaaacactaaaacattctacctactacatttgcttttgctgcctgggtgttaaagtggagaattagattaactaatactgctcgtttgagcattatcaaaagggcacagtttatgccaaagctgactgtgttaattttctccaggagctcttatgactccgaataccaggatacaacggtttgaggttctcaagaacggtaccttagtgatacggaaggttcaagtacaagatcgaggccagtatatgtgcaccgccagcaacctgcacggcctggacaggatggtggtcttgctttcggtcaccgtgcagcaacctcaaatcctagcctcccactaccaggacgtcactgtctacctgggagacaccattgcaatggagtgtctggccaaagggaccccagccccccaaatttcctggatcttccctgacaggagggtgtggcaaactgtgtcccccgtggagggccgcatcaccctgcacgaaaaccggaccctttccatcaaggaggcgtccttctcagacagaggcgtctataagtgcgtggccagcaatgcagccggggcggacagcctggccatccgcctgcacgtggcggcactgccccccgttatccaccaggagaagctggagaacatctcgctgcccccggggctcagcattcacattcactgcactgccaaggctgcgcccctgcccagcgtgcgctgggtgctcggggacggtacccagatccgcccctcgcagttcctccacgggaacttgtttgttttccccaacgggacgctctacatccgcaacctcgcgcccaaggacagcgggcgctatgagtgcgtggccgccaacctggtaggctccgcgcgcaggacggtgcagctgaacgtgcagcgtgcagcagccaacgcgcgcatcacgggcacctccccgcggaggacggacgtcaggtacggaggaaccctcaagctggactgcagcgcctcgggggacccctggccgcgcatcctctggaggctgccgtccaagaggatgatcgacgcgctcttcaggtaggcagctctgcgtggcttcctgtaaatcgctgggctggtggccccaacgaatatgagtcctttttcaggatgaatatgcacacacgttgctccctgcgtccgataaaattaaatgaaattaattagcagggcacggtggctcacgcctgtaatcccagcactttgggaggacgaggcgggcggatcacttgaggtcaggagttcgagaccagcctggccgacatggtgaaacactgtctctaataaacatacaaaaatttgcgggcattgtggcgagcgtctgtagtcccagctactctggaggctgaggcaggagaattgcttgaacccgggaggtggaggttgcagtgagccaagatcatgccacttcactccaccctggacgacagagtgacattccatctcaaataataataataataaattcattagagacagggtgtcactctgttgcccaggctggagtgcagtggtgcgatcatagctcactgcagcctcaaacttctgggttcaagcgatcgtccagcctcagcctcctgaagtagctgggactacaggtgtgcaccatgaggcacggcttgttattattattattattattaactttttgtagagatgggttctgctgtgttcccaaggatgatctcgaacacttcacctcaagcaatcttcccgccctgacctcccaaagtgctgggatgacaggcttgagctcctgtgcctggcccggtgtgtgatttatttatttatttatttatttatttatttatttatttatttatttttgagacggaatctcgctctgtggcccaggctggagtgcagtggcactatcttggctcactgcaagctccgcctcccgggttcacgccattctcctgcctcagcctcccgtgtagctgggactacaggcgcccgccaccacgcctggctaattttttgtatttttagtagagacggggtttcaccgtgttagccaggatggtctcgatctcctgacctcctgatccgccgcgcccggccccagtgtgtgctttttctgcaatgaaattttgtccctctaaactcggatccagaacaaatactcaacttcttaacaaatacttaacttcctcctctcttgccccataaaaaaaaaaaggaaaaaaggataaatgaaccaagaaattcttgttttaatgattatatgtttaactataatgttaggacaaacaattcagcttgcctctatttccattattgatttcaacaaaatacatagacgtgttaggctttattttaatatgacattattgatagagtcaaagtgtatacattgttttaaaagcatcattaccacaccaacatagtgcacttgaaatgataaaaatgtacttgggctatgaagaaagccaagccaccttctaatcaagtgccatctgttcccagatatacaggtttatggcagtgcttttcaaccaagggtgattttgccccaagacaacacttggcaatatctgaagacacctttgattatcacaaatggggcagtgggtgcttctggtatctggtgggtggaggccagggacggtgctcaacaccctgcagtgcacaggatggcccatcacagattgtcatccatcctaccttcaatgtccatagtgccaaggtcaggtaactctgtcttagcatgaaaggttctatctatctatctatctatctatctatcatctatctatctatctattctatctatctatctatctatctatcatctatctatctatatctatctatctatcatctgtctgtctttctgtctatccatccatcatctatggcagtggtttgcaaccaggcatcaggtgttccttagtccccaagggacagttggtgatgtatggagacattttaggtcatgatgactctggggtggagggtgtgcttctggtatatggtggctgcagccccgggatgctgctcaacaccctacagtgcacaggacaccccaccccagattagcattcatcttgccttaaatgttactacggctgaggtcaagtaaccctgtcttagcatgtaagattttgcctatccatttacctatctatttatccattcattcattcctgtatacttaacctatccatccatctttatctcttatgtatctattcattcatgcatccacccatatctatctatctatctatctatctatctatctatctatctatctgcctacctacctgtctatggcagttgtttacaaccaaggagattttattccaaggagatatttggctatgtctggcaacatttttttggttgtcacaaatgggatgaatgttactggcatctggtgggtggagcccggagatgctgctcaacaccctacagtgcacaggacagacccaccacagagaatcctccatccagccttaaatgtccctagtactgaagccaagaaaccctatcttagtatgaaaatgttggtctatctatatacctgcttatccatccatccatgtctatctacctaacctatccatccattcattcttatctcttacgtatccatctattcatccatccatccatctatccatccatttatccatccgtatctatctgtctatctgtctactcatctatctagctagctagctatggcagttgtttgcaaccaaggagattttactcccaggagacatttggctgtgtctggcaacattttgtggttatcacagatgggatggatgctactggcacctggtgggtggagtccggggacactgctcaacaccctacagttcacaggatggccccatcacagagaatcttctagccccaaatgtccctagtgccaagattgagaaaccctgagctagatacaaaaaaagagctaatatctctttaataagcgtttcaaaaaatagaggacccagatagtagaggaaaggtaaaatggagtccaactaaattcacagtgcaatggtggagaacccctggattgtgctgtcttcagcactcagtagctcgagcaggaaagcctcttaccgtgggtccctccccagggtaggagcaaaatcagcgtccaaggttttcttctgcacagttgtgtctggcctcccaggactcttttcaattcaggaaaagggctgagatgccttttccctgcctgtattttatactttagatggctgggtggtgccctgaagagcttgcacaatcaatccagaagagccatgtacccaatttacccaggaatgccttccagcttagcagatgtgctgccacatagagaactgctttccattgaatttggcatggtggaggcaattttgaatggataacagtataagaatgcagttccagtaagatttttgggtcattccattaatgtctccatataaatcctaaataaattataaaccattatttctgtcacttcattcttagtaaattctgactatattcttagtaaagtgtaattgaacaaaccatgtgcattttgtcaaagagcaggctctgccctgctatttaaaaatacaaatattgagccaggcgcagtggctcacacctgtaatcccagcactttgggaggccgaggtgggtggattgcttgaggtcaggagttcaagaccagcctgaccaatatggtgaaaccccgtctctactcaaaatacaaaaattagcagggcgtggtggcctatgcctgtagacccagctactcggaaggctgaggcaggagaatcatttgaacctgggaggcggaggttgcagtgagcggagatcaggccgctgcactccagcctgggtgacagagcgagactccatctcaaaaaacaaaaacaaaaacaaatatcagagcttcgtttcttgaagctgaatctctcacgatgcacaggcatctgtggctttgagatttgctcagttgattctgatgacaactgggctaggggtcactgttaatggaagcctcagaatgtttacagacacatgctaccatactcatttttggattcaaattccaaggcacatttaaatgtccttgcctgtcccacacctgttaaattccttaccaagttacattgacttgattctcactcatggcccacaaaacagtgtatatggtcattgttaatcattgcttttattacaatgattaggttgaatgtaatcacaactgggcttattttaaaagatctatgacagtgtcttagacatgccattagaaaaatggagtcttgccaggtatggtggctcatgcctgtaatcccagcactttgggagaccaaggcagaaggatcacttaagtccaggagttcaaactcagtctggacaacatagcaagatcccttctctacaaaataaaaaataaaaaaaactccatccaggcatattggtgtattgttgtagtccaagctactcaggaggctgagatggaagtgtcccttgagtccaagagatcgagactacagttagctatgattgcaccactgcactccagcctgggtgacaaacaagatctcagttcttaaaaaaaaaaaaaaaaaagaaagtgtggtatttaggaaatattaaggctcccattataatgtatgtgtaattgagaattcaatagggacaactttaaaagtgagaactttctcaatcttttcactggattattcaacatattagttccgaataactaaaggatacttcagtatttataaaactcttacatacataatgaagattttcctatcatcctttctagtttgcctctgttaaacctttttgtaattattaactcggcagtgcttggacttcatggggaagaatgacacaccagccttgaggttttagctagtgagtgttattcagctttaattacaaattctagaaaacctgttacaccaatagggccagcttctgaagatcccaattttagccttaaaactcaccttgaaactctgggcataaccataattacatgaccttattagagttgcttttctgactcttgcccaaaactgggatacaacagctttaaaaaaagaaattgccaagagtagaaaccgtgtctaaagcattttctccaggaagaatttaacatctttataaggttgacccagattcttcaccatctccatgactgtagcattttatctgattttgttgttacaatgacctctgtaatgaccaccatgcaaatacttgatccacacacacttgcaggaatgggattgacgtctttgactacatttcatgtccttgaacccatggtcaggccagcctaacatcagattcaacagggagttcttatttgcagtcaatcactttccacaaccttctccaggctgtaaaaaccactgggcattctgcaatagcagccacctgagctgatgcatcacagaaacacctatttttgtgttattccagcgacctaatgccacactagagcatttgggaaactgacatcttactcctttttctttttttctgtagttttgatagcagaatcaaggtgtttgccaatgggaccctggtggtgaaatcagtgacggacaaagatgccggagattacctgtgcgtagctcgaaataaggttggtgatgactacgtggtgctcaaagtggatgtggtgatgaaaccggccaagattgaacacaaggaggagaacgaccacaaagtcttctacgggggtgacctgaaagtggactgtgtggccaccgggcttcccaatcccgagatctcctggagcctcccagacgggagtctggtgaactccttcatgcagtcggatgacagcggtggacgcaccaagcgctatgtcgtcttcaacaatgggacactctactttaacgaagtggggatgagggaggaaggagactacacctgctttgctgaaaatcaggtcgggaaggacgagatgagagtcagagtcaaggtggtgacagcgcccgccaccatccggaacaagacttacttggcggttcaggtgccctatggagacgtggtcactgtagcctgtgaggccaaaggagaacccatgcccaaggtgacttggttgtccccaaccaacaaggtgatccccacctcctctgagaagtatcagatataccaagatggcactctccttattcagaaagcccagcgttctgacagcggcaactacacctgcttggtcaggaacagcgcgggagaggataggaagacggtgtggattcacgtcaacgtccagccacccaagatcaacggtaaccccaaccccatcaccactgtgcgggagatagcagccgggggcagtcggaaactgattgactgcaaagctgaaggcatccccaccccgagggtgttatgggcttttcccgagggtgtggttctgccagctccatactatggaaaccggatcactgtccatggcaacggttccctggacatcaggagtttgaggaagagcgactccgtccagctggtatgcatggcacgcaacgagggaggggaggccaggttgatcctgcagctcactgtcctggagcccatggagaaacccatcttccacgacccgatcagcgagaagatcacggccatggcgggccacaccatcagcctcaactgctctgccgcggggaccccgacacccagcctggtgtgggtccttcccaatggcaccgatctgcagagtggacagcagctgcagcgcttctaccacaaggctgacggcatgctacacattagcggtctctcctcggtggacgccggggcctaccgctgcgtggcccgcaatgccgctggccacacggagaggctggtctccctgaaggtgggactgaagccagaagcaaacaagcagtatcataacctggtcagcatcatcaatggtgagaccctgaagctcccctgcacccctcccggggctgggcagggacgtttctcctggacgctccccaatggcatgcatctggagggcccccaaaccctgggacgcgtttctcttctggacaatggcaccctcacggttcgtgaggcctcggtgtttgacaggggtacctatgtatgcaggatggagacggagtacggcccttcggtcaccagcatccccgtgattgtgatcgcctatcctccccggatcaccagcgagcccaccccggtcatctacacccggcccgggaacaccgtgaaactgaactgcatggctatggggattcccaaagctgacatcacgtgggagttaccggataagtcgcatctgaaggcaggggttcaggctcgtctgtatggaaacagatttcttcacccccagggatcactgaccatccagcatgccacacagagagatgccggcttctacaagtgcatggcaaaaaacattctcggcagtgactccaaaacaacttacatccacgtcttctgaaatgtggattccagaatgattgcttaggaactgacaacaaagcggggtttgtaagggaagccaggttggggaataggagctcttaaataatgtgtcacagtgcatggtggcctctggtgggtttcaagttgaggttgatcttgatctacaattgttgggaaaaggaagcaatgcagacacgagaaggagggctcagccttgctgagacactttcttttgtgtttacatcatgccaggggcttcattcagggtgtctgtgctctgactgcaatttttctttttttgcaaatgccactcgactgccttcataagcgtccataggatatctgaggaacattcatcaaaaataagccatagacatgaacaacacctcactaccccattgaagacgcatcacctagttaacctgctgcagtttttacatgatagactttgttccagattgacaagtcatctttcagttatttcctctgtcacttcaaaactccagcttgcccaataaggatttagaaccagagtgactgatatatatatatattttaattcagagttacatacatacagctaccattttatatgaaaaaagaaaaacatttcttcctggaactcactttttatataatgttttatatatatattttttcctttcaaatcagacgatgagactagaaggagaaatactttctgtcttattaaaattaataaattattggtctttacaagacttggatacattacagcagacatggaaatataattttaaaaaatttctctccaacctccttcaaattcagtcaccactgttatattaccttctccaggaaccctccagtggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcagtatctggcttgtccatctggtctaaggtggctgcttcttccccagccatgagtcagtttgtgcccatgaataatacacgacctgttatttccatgactgctttactgtatttttaaggtcaatatactgtacatttgataataaaataatattctcc

SEQ ID NO: 4204 - DNA, 38076 bp, human
gagctgcctcacccccggccccgggaagggcatggccccggcaaactcccggccgtgactcgcgcgccccggctcggtggatgctcccggcgcaccgctcccgtgtgcggcggcttcccaaggacaggtgaggacccagggtggccagggcgccccagggctgccgtgtctgcctgcagggggtgaagggatttgagacacccaagggaaacactgggggtaaagggcctgcatgcaggcagattgcaccgttccccagcactgtttgaagttgctaagaaatcaggatacctgaattcctgcaattttaagtagctaaggatcagatagggaggagagccggatcttgaaggaggatgcactgaataggtctaattaagcccagacatcccatgcctcctttcctccctctccccaaagcgctccccatccctggctctctctggagaccttcaaccccgccatcccgcgtttctaggaagctgccaacggaattcctaagtgaagcccactctgctcttgcaatcggtgggggaaaggacgcttgaggagcctctttccaagttgctcaggctgtggctacttcaagtctcctctccctcctctcttccccctctccttccccgcctctttcctcctactcttacccaggctttccctggaaaggggacagcccaacgcctagagtgatccgagccatgcaaaaaaaccgggacagtcatcacgcagacaaaaggggtttggtgtccgagtcccgggcggcggggactcgcagggccaccccagccgcgttccgggaaagctcgtaattcatcccgcagccagctcgacgcgacccagcggactctggaagccggccaggggctcagggctgcccgcccggccactccaggttgtctgcccagggccaagacgaaagcagacggcctcacgcccccacccctgcttcccggcggggttcgcagaccgtctctggcggcctagctggcgccaggccgctttctccgcggcggagagacccgaccccgagtccccgggattagggttgtctgggggcgagtttcctgggtctcccgggaggttggtgccggggtgggaggccggacagggagttggggctgaagagtcctatggaacgcccgggccaagtccgcccgcaggcacaggacgctggggactggcgcggctgcccttggaaccagcccagcgccgaggtcaggcgcgcaggcaggggcggggaaagcccgggctctggcgagagagaaaactccgaggacttttgcagagctgcaggagccggtttgttccagcgcccagaggcggagcccggacttgcttttttgcaaaactacctgtgcgccatcagttctttatgggcagctgaagggagacgcgcccccgggcttaagagaataaccttttctaggtcacttaaaggcaggaaaagctacaggtttgggatgttcctctcttataggaaggattttagaattttatttttattttttgagacggagtttcgctcttgttgcccaggctggggtgcaatggctcgatctcggttcaccggaacctctgcctcccggattcaagcgaatctcctgcctcagcctcccgagcagctgagattataggcatgcgccaccacgcccagctaattttgttttgtttgtttgtttgtttgtatttttagtagagacggggtttttccatgttggtcaggctggtctcgaactcctgacctcaggtgatccgcccgcctcggcctcccaaagtgttggatgacagacgtgagccaccgagtccggcctgggttttagaattttaatcagcagttcgcgctcgttcagaacccgggcgaatgggcaggcgcgtgtttgttgtgtatccctatttactttccatgtgtgtcactatttttaagtgaacgccattcaagagatgacaaaaatgttagatgacataggcattgccaggacaagaagaaaatgatcaccgccattctaaatgaagtagctgatgcaatctagctttacccgagcttttccattttttagtgactccatttttttctgtttgcctgaatatatttcataagcagtcccttcctgtttattgaatgatcagaggttcccccaaacttcctccccgattaacagcaactctatatcatcaaaaaaactctctggcttttccaagacaaaaacataaggatagtaaataaacccagaaataacaggatgaatatccttctagcaaatacctctttaagctcttcaagaagctagaattaaaggtttgaaaaatatcattaaaggaaagaatacgaataaacacttcttgggaagttttaaattcaaatatatgcaatatataatggctcagtcttgttggaggcagaaacacaatattttattattttttaattatggatacataaatataaacctctttcttctctctctctctctctctctctctctcgtctctctctgtttcatagccgcaattacagagtgcaagatagatttccaaatcatagtatcgaagccaagaatcaagactatattctatagtcatgattaaagtgaatggtgaaaagtttagaaaaaaaaccatgtttcatctttctcaattcccatggtttaagcgtcactacaacacatcgtgtgaagtcctgggaagcttgaaaccctgatgcacaattcaaatttaaaaattgcccacagttcgtcggtgctacctgtgaataagctcatctcttcgttgttctacctcaggtatccgagaatcaggcaccccgacaagatgcccaagcgcgcgcactggggggccctctccgtggtgctgatcctgctttggggccatccgcgagtggcgctggcctgcccgcatccttgtgcctgctacgtccccagcgaggtccactgcacgttccgatccctggcttccgtgcccgctggcattgctaaacacgtggaaagaatcaatttggggtttgtaccactttcttcccgaaccttcccactgtcagtgcgtgcgtcttgatctggttttgcgtgtgtgtatgtgcatttacttaacttcatatgtgcatttcctctgtgtagctctgtcgagaattatggagctgcagatgggcagaatagagagaaaaagttttagttatgctaaacgcagctttttcgatgattatctcaatatatccatcagctgccactgctgtaaggtctattaacgagcagcatgaacaactttagagtttgttgagaaattcccttgatagcatttctttaatacattgttgaggtgaatgcatgagacacacacttaaacatatgaagatgatttaagtagacttcagcaacgatttaagaataataaaaataagcagaacatctgtgccattttataagtcatgtagatgatagaattgcgactttgaggcaataaaagagttcctgcagattttgcctgttaaaaatatcaacgtctttttaaaaacctattttgatgtggcttgccagacagacttttaatatactggtttcattttatacacacgagggttgtgtggaccgaagtgttagttgctatgaactacaggtgctcaactgcaattttaatagtcaacaatcatttggagttcgtcaacaaaatataatagctactttttagcatccatccccagaacaactgattaaattagtgtttgtgaaatatccaccatggagatgttttagtaaaaataaaatggccagatttgagccaatgcaaaataactgtaaatgtacctggacatcttatagaacaaagttaaaagaaaaaactctcctccattgacagtggtagaagaagagaatgaaacattgagataataagatggaaatttctctatcgacagtggtagagtcagggaatgaagtgttgagggagtaagatggaaacttccctgttgacagtggtagaataagagaatgaaacgttgagggaataagatgataatttccctaacccatggcaacagaccattaaataggtttctcaatgaaatgctgttagactttatgagttgaccatctgaacatccaaccacaacaatgatagctcattggggaaaacagcttggcgttggcagaggagggaatagtaacacataagccagcttccctttttacaatcttgtaatttatcggacacatttcttgtgtaatggaagtaagaaaaagggaagaggtgctaaagcccattagttttgtttatttatttatttacttaactttaagttccaagatacatgtgcagagtgtacaagtttgttacataggtatatgtgtgccctggtggtttgctgcacctattgacctatcctctatgttccctcccctcaacccccaccccccagcaggccctggtgtgcgttgttcccctccctgtgcccatgtgttctcaatgttcaactcccatttatgagtgagaacatgcagcgtttggttttctctttcccttgttagttcgctgaggatgatggcttccagcttcatctatatctctggaaaggacacgatttccttcctttttatggctgcatagtattccatggtgtatatgtaccacattttcttgggcatatgggttggttccatgtctgctaaagcccatttgaatcctgggggaaggtgcgtgtgatatttgcagaacagaaagtggggctttaactgtaacttctttttcctccacccttggtgtgcaaaatggctctgtctaggaattgttttttatacatgaaccattttaacacatggtctaacttgctgggattagccacctcatctctcaaacccagcaccttggcaggtcccatgctgggggtaccatcagccaggccttggtggagccctctaaaaagcttggggttgatgcagaatgtatatattttatatatattatctttataatatatataatatataatgtaaatatacatattatataatatataatatatgtatactatattatatattatatatattatatataataataatatatattatatatattatatataataataatatatattatatatattatatataataataatatatattatatatattatatataataataatatatattacatatattatatataataataatatatattacatatattatatataataataatatatattacatatattatatataataataatatatattatatatattatatataataataatatatattatatatacataatatatagtaataatatatataatgtaaatatacatgttatatataatataatatgtatattatatatattaattatatattatatataattctattatatattatatatataattatataattatatacattatatatattattatatattatatataataattatatattatatatattatgtatataatatataatatataatatatgtataatatataatatattatgtataatatattatattatattatgtataacatattatgtataatataatatattatataatatataatatatattatacacaatatatattatacattatatatatcatgtataatatatattatacatgatatataatatatatctattatacataatatatatctatttgcggtgcttcttgcacagcaggtttgtgtgtttgtgttgtgtgttgggaagggggatatcaggctggaaatgagggtggagacagtccctgcatgcaccctccccaaagaggtgatttgtttaatggcttgagacttacagcaccaacaagactattacttctgaagttgtttgcatctcatttacagtttctgggatgcttttcttcccgttcatttttaaactgaagtactttgtaagtgcaaaacataactaacctctaaattacaacaccatttctgatggtttcattttaaacaactcacgataaagattgactttaacgtaggaataaaacagacataccaacatgttaaagtttctttttcctattgctgccagtaatatctagagatagttttctgtaatattaaaaagaaaagaaaaagtttaaaaccctagagaatcacttcactgcatcaacatctattacttccatctggtttaatttgtaacaggaactaatatactacttgaaaaaaatcactaataatatcataatagcattgtttcagaaaaatcaatctcaaattaggtaatgagtctggcatcttgcattttgttggggaaaaaactgaaacaagagcaatgtctaacagataaaactcagagattgatttgtgttttaacagtctggagaaaatataagactctcaaggaatgaggaattgttggccaagtgctaatgaaaccttctattcccacacagctgtttttagggttctttgtcagcattgctgtttcctgcttggacaaactaaaagcgtttctgaaaattgctttccaaatattttttttcaggaaccaacaacatagcatccacctagagatggatttacagactcttaagtatttttttccctctattaaaagactggttttgatgatgcctttctgcaacttcaacaatgcccatacttgcctattttattttaagttctgccttgtgatattaaccggaaccgaagacataattttgcaaatattgtctgccataaacatttcacagagttggttatacattcagtgattgccaatcaataggcgatgaagatagtctggaatgtaagccaaggggctaataagccatagaactgcactttatgcagggtcatcccagtctccagttagattctgttccctgagtgtcgtgctaatttcccagactctgctgatttttagaaggatgcaagaaggggacatgtatacccttgggttctgagagggggtactcaagtgattccctgggcttctgtatgttccagaatatccgccccattctcacatctggcacccttggcatctgcatctgcaagctctctaatgccccttaaaaacaagcaggggggtccgggcacggtggctcatgcctgtaatcccagcactttgggaggctgaggcgggtggatcacgaggtcaggagatcgagaccatcctggctaacacggtgaaagcccgtctctactaaaaaattcaaaaacattaactgggcgtggtggtgggctcctgtagtcccatctacttgggaggctgaggcaggagaatggcgtgaacctgggaggcagagcttgcagtgagccaagatcgcgccactgcactccagcttgggtgacagagcgagacgccatctcaaaaaacaaaaaaataaaacaacaacaacaacaacaaaacaagcaggggcaagatgacagggtcaggcaggtttctgagctgatgtggagcccgtcccagactttgggtgccttcctgaaaggggaatttattcagatgtgaagggaaatcaaccagtattatcctttgttcctattttcccttcttctccaccttgatagttgtgatcaaaattctcaggttaaatttgacattcagctatccatggctttagtatgagccattctgtttttctcaatatctatctatctatctatctatctatctatctatctatctatctaactatctatctattatctatagtctgcctattacttgtctacctacctatcatctatctctatcatcaatcaacaaatctatctctctacctgtctatatctatctacctacctatctatgtatctatctatcatctatctgtcatgcatctgcctatcacctatctacctacctatcatcatcaatcagccaatctatctctctacctacctatcatctatctatcaatctatctatgtatcatctgtctgcctatcacctacctatcattgatctctatcattatctattgatgtatctattctatctatctatctgtctatcatctattaatctacctatctattctctatcatctatttatcaataatctatctacctacctatcatctctatcaatcaatctatctctatcatgtattctatctatctacctatcatctatcatctatctatcacctatgtacctgtcatctatctttatcatctgtctagctatatattatctatctatctatgtacctatctatcatctgtctggctgtctatctatctatctatctatctgtctatctatctatctatttatcatctgtctgcctatctatctatctatcatctatctatgacaatagttatcaacaatggatgagtttgcccctggaaaacatttggcaacatctggagacctttttggtgaccacaactatggaaggagaacatatcacacccttgaagtaaaatgtgctgaggaacatccagctgtttctgacccatttcagagacagagcctcagagccctatctcctctgtctgaagatctgcctccttcttctgggctccgttcaggtgatattatttactcccagggctctattccattggtcggttggccagtctcccctgaacgtgcatcatgggtctccatcttggtcttgagccctattctccccttagattcttacaaaattctcaaacatcccatggcaaatacagctttgaattctttccccaacacctgtctctcccagcctttgctgtccagcaaatgatagaatccacccacttactcccctccaagtagaagtccttcccccaagtttgtcctcattcccactcccaccactcagcaatgcctgctggctcttcctctaaatacattcggaaatgttctgtgtgccttcatgcttactgccacacctggtcatggatccaacatccctcaatatctctgcaggattcacctcatttctgcctccctcccttgcccagctctgacacgttctccaggaagtggccaacattgctgttttaacacatacttcagttcatggatgaatagatatataattgatatatagattataacagatagatgcttgatagatgataggatgatagatggattgatagagaggattatagatagattgatggatgataggtaggtatagggtaggtagatagatagatagatagatacagacagagggacagatagacaaatttgcacgtgctaaggcaaagttaccaaatttctgcaatcttgatgtttaggactgaatcaatgtgggttgtaggggccatcgtgtgcattacaggatgttgagcatcatctctatagagaacaaatcaatggccgtgccataaagtgggcaagcttggtgagtctaaggaacagaaagatggccaataactctgaactttatggccaacagcaaaataccagagagctaactagttgtccaccacggaatattcttctaaaatgatgaggccatgcccaaacgtccctttgtttcttaagccctacttcaaatctcagctccccagagagccctgccgtagacatcggccaaccaaaccccttctactctccttcctgtgctttaattatttccttatgaaatttacaactatctgaaatgatctttttcattatttttacctttctagtcatgcttcttgctaagagagctgagcccttgcctatttggttgacccacccagaatagtaacttgcagacacacaaagctcaaattatagctgtgactgcgttgcagaatgaatccatgcatgtagaatctgtagcagacatcgtttcatattgagcgaagttcaaacagcacctgccttattttccttttgatttctccatctctaaaagcattagaacttgttttcagagcccactacatcctgaaggcacatacgaagctgatctgtacaaagtttttgcaattttttaaagtaaaattcaaatgacatggcattcacccttgtagcctctacaattcagtgccatttagtacattcaaactattgtgtatccatcatctctatcttgttccaaacattttcaccaccccaaaaggagacctcatatccatgaagcagtcattctctactccctctcctcctccagcctttgggaaccactgctttgttttctgtccctatgaatttgactattctgaacatttcatatacatagaatcatacaatagatcagcggtccccagcctttttggcaccagggaccagttttcatggaagacaatttttccacagacaggattgtggagggagtagttttgggatgactcaagcatatcacatttttgtgcactttatttctattattattacattgtaataatataatgaaataattctacaactcaccataatgtagaatcagtgggagccctgagcttattttccttcaactagacagttccatctgggggtgacaggagacagtgacagatcatcaggcattagattctcataaggagtgcgcaacctagatcccttgcacacacagttcagaataggatttgtgctccaatgagaatctaatgccgtcactcatctgacaggaagtggagctcaggcagtaatgccagcaatggggaatggctgtaaatacagatgaaactttgctggctcacccaccactcacctcctgctgtgcagcttggttcctaactggtccggtactgctctgtggcctggggtttgaggaccactgcagtacgtgacctgtagggcttcttgcagtgaacaacatggttcaagggtcacccacatggtagcctgtgtcagagcttcattcctttttgtagtgtgcatcttgagcaatgattactgccactgcatagtgattttgcagaaaatcaatttaaagagtgaatgagaatatgtgccatgtagacttctactctgtcgtcggcatttctgaaatgtacatttagactctctttgcttctcactcacgtgcattgcatttttcctcatggctgttatttcagtcaaacaaaaacctctgaacaattctgaggatgccatccgcaaacataccctgtaagaccttcttggccctctcttgtgtgctaaatcatctgtgcttgtgtttaaataagaagaaataaggtattcttttaaaaataaaaatggcggccaggcgcagtgactcacgcccgtaatcccagcactttgggaggccgaggcgggcagatcacctgaggtcaggagtttgagaccagcctggccaacatggtgaaaccctgtctctactaaaaatacaaaaattagccaggcggggtagcacacgcctgtagtcccagctactcgggaggctgaggccagagaattgcttgaatccgggaggcagaggttgcagtgagccgagatggcgccactgcacttcagcctgggcgacagagggagactctatctcaaatgaataaataagtaaaataaaaataaaaaaataaaaaataaaaaatggcaacttagtatggtcattatccatgattgacacttcatttacccacaagatgggaacttaaaaaccctgcaaacacagcaacaacaacaataatgtccccattatagaggagaggagactctgaacgacgctgaatgcatccaagaatacacagtcactatggtaaaacacaaggatcttgagaccaaagctttaccttgcattcagggacgattaactgaggcgggagaggctatcaatatctacttgacactttattttatttagtgagttgaaacatatggaatcagggtgcaaagttcctggaaagataacgtagcaaagaatgaattagaaatgtatcaggtagatttctactctggagtcagctgaaatcaggtctgaaattggtcatttgagtgtctctgagaagaatcattgaatggacatgtttacgaatattatgattcctgtatgatttttacattattcatattatgtataaatttttgaacatctgaatatgttttcattgaatgtctttattcatataacatattgctcattattcccctgcctaactacattttagttgccatttttaactcacgaattcttagcatgtctctttttgtgtcttgcttggctgtgactttccctttgatctccctggtatcagccttggtgtacctattccctccagaaactctgtagcagtccttgacacagagcaatgtctgagtggctacagacattatgtcctttaacccacacagggctctctgaaaaaagaatcctcagtagcattactaatgaagagtttgagcttccaaaaagcttggtaacttctctgggatagccagcgggcaacgtgaagtgtgcctgacctcaaaacatgaggcctagagggtgtggtggctgacatctgtaatcccagccctttgggaggccgaggcgggtagatcacttgagctcagaaggtcaagaccagctcgggcaacatggtgaaaccccatctctactaaaaatacaaaaattagccaggtgtggtggtgtgtgcttgtagtcacagctacttagaaggctgaagtaggaggatggcttgagcccaggacacagaggttgcagtgagccaagattgtgccaccacactctggcctggacaacagagccagaccctgtcttgagagagagagagagagacctttctatgcttctatctcacctctaaggatctcacgtctacacactgggacctcctttccccacccagcttgcagtagtcaacaccttccttcccctttattatactctgcaggaaactgctgagctcatgattggaaaaaatgcacctctttcttctcttacttggaattttacccactgaggaggttcatggtccttaacatgaaataaagcttcatgcccttgaatttcacttatctttgcagcattatatttcggggagttttgcaccatgattccatgaatttgaactcactaaataaaataatgtcaagtagatattgacagcttctcccacctcagttaacagtgtctgaatgcaggttgaagctttggtctcaagatacctggattttactctcactgactgtattcttgaatgcattcaatgtcttctgtgagtctcctcttctttgtaaaggggacattattgttgttgtcactgtgtttgcttgtggaatatttaagttcccatcttgttttaataagaccaaagtaccactaggtaataggaaaaaaactttggaatggaacattgcatggtttatcctcttttttcctattccttgaaaattttggaaagtttctttttttctttctttcttacttttttttttttttttttttttttttttttgatatggggtattgctctgttgcccaggctggagtacagtggcacaatcacagctctctgcagcctcaacctcctgggttcaagtggtcttccctgcttagcctcctgagtagctgggaccacaggcatgcaccatcacacccaactaatttttgtattttttgtagagattaggtctcactatgttgcccaggctggtcttgaactcctgggctcaagtgatcctctcgcctcaccctcccaaagtgctgggattataggcatgagctgccatgcccagcctggaaactttcttgaaactcagtttctgctgtggaaagttggcctgcttcatggggtttaggtgataaagggcaaaaagtaatacaaagaggacaaggctcaattccagctaagtttcccaccttctatggaatccaaagcatgttcataaggtacacacatagctatgagcccaattcttttaatattttacctctcaccagtgttaaataaagcagagcttagctgacaagacactggagtaatgcactaaaaagaagagtgaaaaatatcatgtaatcaagaagagagaaccactatatatgattgttcattgactacatgagtcaaaatgatgaacaggaaataggatcatcttctactatattttccccatacaccatattgaatctatacaacattatttcaataaggtgggatgcatttaattccatctgatgttttctttgcataaatttatcttaaaaagaagaatgtggccgggcgcggtggctcacgcctgtaatcccagcactttgggaggccgagtggggcggatcaggaggtcaggagatcgagaccatcctggctaacacgatgaaaccccatctctactaaaaatacaaaaaattagccgggcgcggtggcgggcgcctgtggtcccagctactcgggaggctgaggcaggagaatggcgtgaacctgggaggcggagcttacagtgagccgagatgggccactgcactccagactgggcgacagagcgagactccgtctcaaaaaaaaaaaaagaagaagaatgcaattatgaaaggaggtctttgaaaagtttgatgcaatcaaggtgaatggtttttgagggtagagcttataaatttcctgcactcaaaaatttgtagctgaaaggtgcttcctaaggctgggtcttaggggagtcacacctaacctggtgtttctgttgactttggaattgtagtccaggtttgagcacatatgagtatgagaaaattggaccatgctagtatctgctgcatttagctatgagctgttcacttatgttccctgctaattgatttccttttatgtaagtgataagaagaagcaatcagtgatatcaggctagatgtgttatgtctcagcagaaacagtgatttatggtaacagcgtgcaggcttctctattcctttttcaaattgcttatccagggatcaagtttaagcattgttgtatgctattaccaatatggcaatgagaaatttctaaattggtcaagaaagcatcttgacaattatatacacaacaacaaaaaaccaaaaatttaaaacaaaaagaacttatcttgaggacaggttacaggaagaaacaaaacaaacaagaaacctagcatgtctacgagtaactttgatcatccgtcagacatggcagcctgtccatgggaaataagagtgttggtgtctgtggtcaacatttctatttggcctttagcatggagctgtctcctttcttaccatatgcaaagcaaattccaatgccgtggattttcccggccctgctagccacgtgtccctctttattactgtcacttcagcacagagtttccaagaaagagacacgtggaacagcctcatgttgaattctaaatcctactgatggacacaccaaatagcctcctgaccacaacagcatattccaagtcaaagttctccatgaatgttccttagcagactgaagacaaataaatacatgtcactttcttcttgaccccagagatagggacacgaagggataaacgtctttgggaatggcacccctgtaacctcagaatcactacttcatgaccaggtgcagtgactcttgcttgtaatcccagcactttgggagcccaggcaggagggtcatatgaggccaggagttccagatcagcctgggcacatatgaagaccctgtctctacaaaaatgaaaaataaaaaattagccagggatagtggcctgtgcctgtagttccagctacttgggaggctgatgtgggaggattgctggagcctgggaggtggaggctgcactgagctacgattgcaccgctgcactccagcctgggtgacggagtaagattgtctctaataaataaataaatagacaaaaagactcaccattttactaatttgctcttgggcaggctagggaatgtttcccatatgggagttaagtattcgctatttattttcttaattattattattgttattattattattaccattctttaggtttaatagcatacaggccctgtcagaaacctcatttgcaggactgaccaagttggagctacttatgattcacggcaatgagatcccaagcatccccgatggagctttaagagacctcagctctcttcaggtaaacccacggcatttataagcgtcactaaattgcatcctctaagaccagtaataaagaatagaaattatgtcattctccttaatgatcaataaaacggctattgtttgacatgaaagacaagcttcatgtcattactctccagccctttgtactggtttctgtttgtggttgtggctttttaaactataaacaggatccttttgttttgttttgttttcccctgtccttgcaggttttcaagttcagctacaacaagctgagagtgatcacaggacagaccctccagggtctctctaacttaatgaggctgcacattgaccacaacaagatcgagtttatccaccctcaagctttcaacggcttaacgtctctgaggctactccatttggaaggaaatctcctccaccagctgcaccccagcaccttctccacgttcacatttttggattatttcagactctccaccataaggcacctctacttagcagagaacatggttagaactcttcctgccagcatgcttcggaacatgccgcttctggagaatctttacttgcagggaaatccgtggacctgcgattgtgagatgagatggtttttggaatgggatgcaaaatccagaggtaagaagagaggagagcagaccactcctagctgcacattcttttatctttttggagacgttccattctccaaggttcttatattgacttattcaatgaaatctgagcttcgatgaaatctgagcacccaatcagctagacaggaactcagactttaaacgttaccacttaaatgttaagacatctccattccccaacgcaaaggcagttatcccttagtgaaatgtagtgctcatgtaatcagttacatacaggtgatgtgggttgccatggaatgggtatctggaggatcatgccagccttggactgcagcttaatgtgggaaactgggactgggaaggggctgtgaatccatgttccatgagaaattcacaaaggatgcttggaaaagagcaggctggtgagaggagtggctacaaggtcattattttacggacacggaagcgattctcactattgatctagagagctatgacaacaaccaggacttatgtgttgcagttgcaacaaagtagattgtgattcctttctgccttccttccttctctccccttccttcatcttccttccttccctccttccttccttccctccttccttccttttctctccttccttccttccttcttctctccttccttccctccttctttccttccctccttctttcctttcttccttctctccttccttccttcttttttccttccttccttccttcttttttccttgcttccttccttctctccttccttccctgcttcccaccttccctcctttactccttcctgctctccttccttccctccttctcaccttccttctttcattttttccttccttccttccttccttccttccttctctccttccttctctggttcccaccttccctcctttactccttccttgtctccttccttcattccctcctcctctccttccttccttccttcgttctctccttccttccttctttccttccttccttcattccctccttccctccctgcttcccaccttccctccctcgctccttctttccttccttcgttccttccttccttccctccctcgctccttccttcgtttccttccttccctccctcccttccttcattccttccttcttccttccttcctcctgccttctctcctgccttcctttcttccttctgtccttcctttcatccctctcttccttcctccattcctccccccttcactctccctccctccctatcttcccttccttccttcctttctcccccttctctaagccctaccttgcaacctatccccatccttagattgcattgtgtttaccatatcctggatctatttcctcaactccatcctcacagctgctggcctggatcaagctcctttcctctctctggtagaaagggggagcattctaaacaagtgtccccatgtccttgtcagccctgttttccattcactctctacaaagcagtgagaacatttttacaggatgtgcacccattcaggccacacctctgcgtaactgatttccattgcttttaggataagatacacatttgcacattccctccaagaagtctccacacaatggtcgctccacctgtccccactatcctctagcatggtggtcccattgctcttcttattcgtttatttctagccacacagtcttcccgtctgttccttgcagcttctaaacttatttccaactcaacatcattggatttgctcagttgcctacttgggagtctttactgctagacattcaagaggcttgctttttcttagcttttagagcttcattccaagaggccatcaagcaatggatgtgggaaagacagaggtacacccacttgtgaatggtcttaaccagaaaagacacacgcctcctccactcatatttcattggtgggaaccagtcctcacaccccagtggatgtaagggggcctgaaaatgcatttggatggctattttgtagcagcaacactatattatggatgtggacccacaaaactttgctgggcaaagaaccatctctgctactgtctggagatacgcatgcatgtctttgtgtgtgcatgtctatgcatgtatttgtgcacatgtgtgtacatctgtgtatgtgtagatttgcatgtatgtgaaagaaactcaagattgtaaagtattaaggttagttttatatagtgagcatttctgaagattgcaatcccaggatctttcagagagtttctgttagactgctgcatagcaaggtttcagcccacagcttatacacagatggtggagtttctgcaggtgctcagaagtcacaccaaatgtggtcagaattcacatcagttgtgctcagaagttatattagagctgattctcatcaaagtttgggtgccaggggacatctggttatagattacagaggcatagtccttaatcctgccagacattatcttatgtgtagaaagaggcaggggctaggagcattgaactcatcttttctaaaagtgcagtgattcaggcaagagacatgtggacctgtgctccatcctgctcatcatcttcagggcattcatgtagaggctgcgctcattcgctgagccatgaaattcagctggccaagggattttgtgaaatgctcctgcttgtgcttgctgccttgtctcacagcatgtatgtgtgtgggtatgagtgtgagtgtgagtatgtgtatgtgtgttggggggagatgtgcaaaacaatcctattcgcatgttgaggtgtttgctttgaaagtcacacagaaaaccatggtcaggagggcaaaaggaaagatggcaaagccagttaggagctttataattctccaagtcatagatgaagcagtatgactggcttcttcccaatgggaacgggcagaagtaggcagaggactgccatgaaaaactcctagtcttccagtttccccaggcagagagagtatggcatcacttactgagatagaacaggcacgagattctacatttaggtcagggagagaatataaatttgtttcatagatgtcagtttgaggactcttcttgctatctaaatagacatgtcaaagaggcaatggggtgtggaactcacggaatgtgtttggactagagaagcacatatggtagtcatcactggcgggtggatggtaattggaaccacacatatgcgagaggccattgacgctgaagccgaccagaaaggaaaggggcttaggctcaagtcaaggaggacccagtcagcaaagattcaggcagaggaggaggaggaagcagtgactgagacccagttgtggccagaaaggacggagaaaattccagaggatttcatatccaggagaccaagaggacaacgtgaactcaaaagcaaacactctgtgaagtgtttactacaaatatagagagagttataaatatagatatagttacctagatacatacgtattgattatatatacattatatattataaatgtataaatatagttataaatatagatatagttacctagatacatacatattgattatatataaattatatattacaaatttataaatatgcagagagttataaatatatagtccctagatacatattgattatatataaattatatattacaaattataaatatacagagttataaatatatagttcctagatagatacatattgattatatacaaattatatattataaatgtataaatatatagagagttataaatatagatatagttacccagatacatacatattgactatatatatttatatataaatatataaattatatattataacttataattataaattatatattataaattataattataaattatatattacatataatttatatatataaatatatataaatgtatttatgtataaatatatataaatatatataaatgtatttatgtataaatatatataaatatatttatatataaatttatatataaaatacatataaatatatataatatataatatataaattatatattataaatttataattataaattatatattataaattacaattataaattatatattataaatttatgatttaaaattatacattataaattataattataaattatatattataaattataattataaattatttatgaataaatatattattatatatttatttataaatatatgtacatctataaatttatatattgttatatcatgacttaaaaaagtaaatatgatgtgatacatgccaaagattcttccttttacctgaaaatactttcaaggggtttatatatttatatccatatttaatttacatattatttatatatacttagatataaatatacattgattatatgtcaatatatctacatattaatatatatttattaatatatcaatatatgtttatatatcatgatagatatatattatataaatatatatgtattatatatctatatgttatctatctatatatctattaagatagatacatatttgtatatattgagatagatatctatcaagattttttaatatatattggtatatatatcaagatgaaaaacaacaaaaattagatatgatgtgatacgtgcaaagattcatccttttaccaagaaatgcttccccagtttgcagtatatttatatagattctcctaaactttcacagaagttacattgtaaaatgtatgtgaatgaagttgttttctttaacttagaaatgttttttaaatacccgttagtaagtattttaagacatttttaagtaaaaattattattaatggttaagcagttataaagcacccgttagttaccacacagtgtgctaaaactgtggtttaacatgaagcctcaaaggcaactcatgtataggattccttgtttatgggattacagctgggtgataaagatgcaaacataggctttatcctctggccatgtgcaaggcatgccattctttggctccttaccctattgtctatttgcttatttgttttaggaattctgaagtgtaaaaaggacaaagcttatgaaggcggtcagttgtgtgcaatgtgcttcagtccaaagaagttgtacaaacatgagatacacaagctgaaggacatgacttgtctgaagccttcaatagagtcccctctgagacagaacaggagcaggagtattgaggaggagcaagaacaggaagaggatggtggcagccagctcatcctggagaaattccaactgccccagtggagcatctctttgaatatgaccgacgagcacgggaacatggtgaacttggtctgtgacatcaagaaaccaatggatgtgtacaagattcacttgaaccaaacggatcctccagatattgacataaatgcaacagttgccttggactttgagtgtccaatgacccgagaaaactatgaaaagctatggaaattgatagcatactacagtgaagttcccgtgaagctacacagagagctcatgctcagcaaagaccccagagtcagctaccagtacaggcaggatgctgatgaggaagctctttactacacaggtgtgagagcccagattcttgcagaaccagaatgggtcatgcagccatccatagatatccagctgaaccgacgtcagagtacggccaagaaggtgctactttcctactacacccagtattctcaaacaatatccaccaaagatacaaggcaggctcggggcagaagctgggtaatgattgagcctagtggagctgtgcaaagagatcagactgtcctggaagggggtccatgccagttgagctgcaacgtgaaagcttctgagagtccatctatcttctgggtgcttccagatggctccatcctgaaagcgcccatggatgacccagacagcaagttctccattctcagcagtggctggctgaggatcaagtccatggagccatctgactcaggcttgtaccagtgcattgctcaagtgagggatgaaatggaccgcatggtatatagggtacttgtgcagtctccctccactcagccagccgagaaagacacagtgacaattggcaagaacccaggggagtcggtgacattgccttgcaatgctttagcaatacccgaagcccaccttagctggattcttccaaacagaaggataattaatgatttggctaacacatcacatgtatacatgttgccaaatggaactctttccatcccaaaggtccaagtcagtgacagtggttactacagatgtgtggctgtcaaccagcaaggggcagaccattttacggtgggaatcacagtgaccaagaaagggtctggcttgccatccaaaagaggcagacgcccaggtgcaaaggctctttccagagtcagagaagacatcgtggaggatgaagggggctcgggcatgggagatgaagagaacacttcaaggagacttctgcatccaaaggaccaagaggtgttcctcaaaacaaaggatgatgccatcaatggagacaagaaagccaagaaagggagaagaaagctgaaactctggaagcattcggaaaaagaaccagagaccaatgttgcagaaggtcgcagagtgtttgaatctagacgaaggataaacatggcaaacaaacagattaatccggagcgctgggctgatattttagccaaagtccgtgggaaaaatctccctaagggcacagaagtacccccattgattaaaaccacaagtcctccatccttgagtctagaagtcacaccaccttttcctgctatttctcccccctcagcatctcctgtgcagacagtaaccagtgctgaagaatcctcagcagatgtacctctacttggtgaagaagagcacgttttgggtaccatttcctcagccagcatggggctagaacacaaccacaatggagttattcttgttgaacctgaagtaacaagcacacctctggaggaagttgttgatgacctttccgagaagactgaggagataacttccactgaaggagacctgaaggggacagcagcccctacacttatatctgagccttatgaaccatctcctactctgcacacattagacacagtctatgaaaagcccacccatgaagagacggcaacagagggttggtctgcagcagatgttggatcgtcaccagagcccacatccagtgagtatgagcctccattggatgctgtctccttggctgagtctgagcccatgcaatactttgacccagatttggagactaagtcacaaccagatgaggataagatgaaagaagacacctttgcacaccttactccaacccccaccatctgggttaatgactccagtacatcacagttatttgaggattctactataggggaaccaggtgtcccaggccaatcacatctacaaggactgacagacaacatccaccttgtgaaaagtagtctaagcactcaagacaccttactgattaaaaagggtatgaaagagatgtctcagacactacagggaggaaatatgctagagggagaccccacacactccagaagttctgagagtgagggccaagagagcaaatccatcactttgcctgactccacactgggtataatgagcagtatgtctccagttaagaagcctgcggaaaccacagttggtaccctcctagacaaagacaccacaacagcaacaacaacaccaaggcaaaaagttgctccgtcatccaccatgagcactcacccttctcgaaggagacccaacgggagaaggagattacgccccaacaaattccgccaccggcacaagcaaaccccacccacaacttttgccccatcagagactttttctactcaaccaactcaagcacctgacattaagatttcaagtcaagtggagagttctctggttcctacagcttgggtggataacacagttaatacccccaaacagttggaaatggagaagaatgcagaacccacatccaagggaacaccacggagaaaacacgggaagaggccaaacaaacatcgatataccccttctacagtgagctcaagagcgtccggatccaagcccagcccttctccagaaaataaacatagaaacattgttactcccagttcagaaactatacttttgcctagaactgtttctctgaaaactgagggcccttatgattccttagattacatgacaaccaccagaaaaatatattcatcttaccctaaagtccaagagacacttccagtcacatataaacccacatcagatggaaaagaaattaaggatgatgttgccacaaatgttgacaaacataaaagtgacattttagtcactggtgaatcaattactaatgccataccaacttctcgctccttggtctccactatgggagaatttaaggaagaatcctctcctgtaggctttccaggaactccaacctggaatccctcaaggacggcccagcctgggaggctacagacaggcatacctgttaccacttctggggaaaatcttacagaccctccccttcttaaagagcttgaggatgtggatttcacttccgagtttttgtcctctttgacagtctccacaccatttcaccaggaagaagctggttcttccacaactctctcaagcataaaagtggaggtggcttcaagtcaggcagaaaccaccacccttgatcaagatcatcttgaaaccactgtggctattctcctttctgaaactagaccacagaatcacacccctactgctgcccggatgaaggagccagcatcctcgtccccatccacaattctcatgtctttgggacaaaccaccaccactaagccagcacttcccagtccaagaatatctcaagcatctagagattccaaggaaaatgttttcttgaattatgtggggaatccagaaacagaagcaaccccagtgaacaatgaaggaacacagcatatgtcagggccaaatgaattatcaacaccctcttccgaccaggatgcatttaacttgtctacaaagctggaattggaaaagcaagtatttggtagtaggagtctaccacgtggcccagatagccaacgccaggatggaagagttcatgcttctcatcaactaaccagagtccctgccaaacccatcctaccaacagcaacagtgaggctgcctgaaatgtccacacaaagcgcttccagatactttgtaacttcccagtcacctcgtcactggaccaacaaaccggaaataactacatatccttctggggctttgccagagaacaaacagtttacaactccaagattatcaagtacaacaattcctctcccattgcacatgtccaaacccagcattcctagtaagtttactgaccgaagaactgaccaattcaatggctactccaaagtgtttggaaataacaacatccctgaggcaagaaacccagttggaaagcctcccagtccaagaattcctcattattccaatggaagactccctttctttaccaacaagactctttcttttccacagttgggagtcacccggagaccccagatacccacttctcctgccccagtaatgagagagagaaaagttattccaggttcctacaacaggatacattcccatagcaccttccatctggactttggccctccggcacctccgttgttgcacactccgcagaccacgggatcaccctcaactaacttacagaatatccctatggtctcttccacccagagttctatctcctttataacatcttctgtccagtcctcaggaagcttccaccagagcagctcaaagttctttgcaggaggacctcctgcatccaaattctggtctcttggggaaaagccacaaatcctcaccaagtccccacagactgtgtccgtcaccgctgagacagacactgtgttcccctgtgaggcaacaggaaaaccaaagcctttcgttacttggacaaaggtttccacaggtaagatgtttaagcatctactttttttttttttggtcaatttttattttattggctagcaatataatacattaaaacagtatatggtgaacaacataaacacattaggagaaatttttataacacatttggggaaattttttactcgaataagtgtttatttttatttttataacttcagcttttattttagacacagggggaacatgtgcaggcttgtcacacgggtatattgtgtgatgctgaggtctggggcacaaatgatcccattacccaggtagccagcgtagcatccaataggtacatttttcaacccttgccacccctccctctctcctctactagtcccaagtgtctatttgtcctatctttatgtccatatgtacccaatctacacttcaaccagagtttgtgtaggagaaagttactggagtcttactttaggattaatttacctttcttatggactcaagggcctctctgggcaggggtggctggccactgcaagcctgggatgcccatgcagccagctagcccgaggagttcaggagaacagcatgagcataaataaataagggagaggctgtgtctctagtaattgagcttgtggcatcttagctcaccttggaagtggctgggactcatgcctgcttccagaattctctattaaacccacatttgctgtcctttgcctgaagatggccctgtttctgggattagtgtaaagatgaaaaagagaaacaaaacattctttttctctatcctttttttacagcatacttatttcgtatgtgtgtgatgacaacacaaaatctactctcaacaattttcaagtataagctaaattgttattaactatagttgccatgagtataatatcacttaagcatattcctcctaactgaacttcatactctttaattaatatcttccctttactcccatccccagcccctggtaaccaccattccactatctgcttcagcttctatgagttcaactttcttacgctgcacatataagtgagatcatgcagtgtttgtctgtctgtgcctggtttatttcacttaatctaatgtcctccaggttcatttatgttgtggcaaatgacagaatttcgttttttgtttgttttttttttaaagaaaaagaaaagacagaatggcatttcattgtgcatatataccacattccctttatccattcattcattgatggacacttagctgaattccatatcttggctattgtgaatagcactgtggtaaacatgggagtgcagatgtcttgtcaacatactgacgtcatttcctttggataaatacccagtagtgggattgctagaccataggcagctctattgttagttttatgaggaatctccatactgttttccacagtggttgtaccaaattacattcccaccaacagtgtacgagggtgcccttttctccacatcttcaccagtgtctgtgtttttggtctttttgataataaccattccagcaggcatgagatgatatctcagttttacatttctttcatggttaggaccaaaacaggctgggtgtggtggctcacacttgtaatcctagcactgtgggtagccaagacaagagaatcacttgaggtcaggagttcaagaccagcctgggcaacacagcaagaccatgtctctacaaaaaacaaaaatttaaattatccaggagtggtggcctgcacctgtagccccagctacttagaaggctgagtccaggaggttgagactgcagtgagctatgattgtaccactgcactctcgcctgggagacagcaagaccctatctctaacgaataaaataaatataaaaaaaacttttaaaaacactaaaacattctacctactacatttgcttttgctgcctgggtgttaaagtggagaattagattaactaatactgctcgtttgagcattatcaaaagggcacagtttatgccaaagctgactgtgttaattttctccaggagctcttatgactccgaataccaggatacaacggtttgaggttctcaagaacggtaccttagtgatacggaaggttcaagtacaagatcgaggccagtatatgtgcaccgccagcaacctgcacggcctggacaggatggtggtcttgctttcggtcaccgtgcagcaacctcaaatcctagcctcccactaccaggacgtcactgtctacctgggagacaccattgcaatggagtgtctggccaaagggaccccagccccccaaatttcctggatcttccctgacaggagggtgtggcaaactgtgtcccccgtggagggccgcatcaccctgcacgaaaaccggaccctttccatcaaggaggcgtccttctcagacagaggcgtctataagtgcgtggccagcaatgcagccggggcggacagcctggccatccgcctgcacgtggcggcactgccccccgttatccaccaggagaagctggagaacatctcgctgcccccggggctcagcattcacattcactgcactgccaaggctgcgcccctgcccagcgtgcgctgggtgctcggggacggtacccagatccgcccctcgcagttcctccacgggaacttgtttgttttccccaacgggacgctctacatccgcaacctcgcgcccaaggacagcgggcgctatgagtgcgtggccgccaacctggtaggctccgcgcgcaggacggtgcagctgaacgtgcagcgtgcagcagccaacgcgcgcatcacgggcacctccccgcggaggacggacgtcaggtacggaggaaccctcaagctggactgcagcgcctcgggggacccctggccgcgcatcctctggaggctgccgtccaagaggatgatcgacgcgctcttcaggtaggcagctctgcgtggcttcctgtaaatcgctgggctggtggccccaacgaatatgagtcctttttcaggatgaatatgcacacacgttgctccctgcgtccgataaaattaaatgaaattaattagcagggcacggtggctcacgcctgtaatcccagcactttgggaggacgaggcgggcggatcacttgaggtcaggagttcgagaccagcctggccgacatggtgaaacactgtctctaataaacatacaaaaatttgcgggcattgtggcgagcgtctgtagtcccagctactctggaggctgaggcaggagaattgcttgaacccgggaggtggaggttgcagtgagccaagatcatgccacttcactccaccctggacgacagagtgacattccatctcaaataataataataataaattcattagagacagggtgtcactctgttgcccaggctggagtgcagtggtgcgatcatagctcactgcagcctcaaacttctgggttcaagcgatcgtccagcctcagcctcctgaagtagctgggactacaggtgtgcaccatgaggcacggcttgttattattattattattattaactttttgtagagatgggttctgctgtgttcccaaggatgatctcgaacacttcacctcaagcaatcttcccgccctgacctcccaaagtgctgggatgacaggcttgagctcctgtgcctggcccggtgtgtgatttatttatttatttatttatttatttatttatttatttatttatttttgagacggaatctcgctctgtggcccaggctggagtgcagtggcactatcttggctcactgcaagctccgcctcccgggttcacgccattctcctgcctcagcctcccgtgtagctgggactacaggcgcccgccaccacgcctggctaattttttgtatttttagtagagacggggtttcaccgtgttagccaggatggtctcgatctcctgacctcctgatccgccgcgcccggccccagtgtgtgctttttctgcaatgaaattttgtccctctaaactcggatccagaacaaatactcaacttcttaacaaatacttaacttcctcctctcttgccccataaaaaaaaaaaggaaaaaaggataaatgaaccaagaaattcttgttttaatgattatatgtttaactataatgttaggacaaacaattcagcttgcctctatttccattattgatttcaacaaaatacatagacgtgttaggctttattttaatatgacattattgatagagtcaaagtgtatacattgttttaaaagcatcattaccacaccaacatagtgcacttgaaatgataaaaatgtacttgggctatgaagaaagccaagccaccttctaatcaagtgccatctgttcccagatatacaggtttatggcagtgcttttcaaccaagggtgattttgccccaagacaacacttggcaatatctgaagacacctttgattatcacaaatggggcagtgggtgcttctggtatctggtgggtggaggccagggacggtgctcaacaccctgcagtgcacaggatggcccatcacagattgtcatccatcctaccttcaatgtccatagtgccaaggtcaggtaactctgtcttagcatgaaaggttctatctatctatctatctatctatctatcatctatctatctatctattctatctatctatctatctatctatcatctatctatctatatctatctatctatcatctgtctgtctttctgtctatccatccatcatctatggcagtggtttgcaaccaggcatcaggtgttccttagtccccaagggacagttggtgatgtatggagacattttaggtcatgatgactctggggtggagggtgtgcttctggtatatggtggctgcagccccgggatgctgctcaacaccctacagtgcacaggacaccccaccccagattagcattcatcttgccttaaatgttactacggctgaggtcaagtaaccctgtcttagcatgtaagattttgcctatccatttacctatctatttatccattcattcattcctgtatacttaacctatccatccatctttatctcttatgtatctattcattcatgcatccacccatatctatctatctatctatctatctatctatctatctatctatctgcctacctacctgtctatggcagttgtttacaaccaaggagattttattccaaggagatatttggctatgtctggcaacatttttttggttgtcacaaatgggatgaatgttactggcatctggtgggtggagcccggagatgctgctcaacaccctacagtgcacaggacagacccaccacagagaatcctccatccagccttaaatgtccctagtactgaagccaagaaaccctatcttagtatgaaaatgttggtctatctatatacctgcttatccatccatccatgtctatctacctaacctatccatccattcattcttatctcttacgtatccatctattcatccatccatccatctatccatccatttatccatccgtatctatctgtctatctgtctactcatctatctagctagctagctatggcagttgtttgcaaccaaggagattttactcccaggagacatttggctgtgtctggcaacattttgtggttatcacagatgggatggatgctactggcacctggtgggtggagtccggggacactgctcaacaccctacagttcacaggatggccccatcacagagaatcttctagccccaaatgtccctagtgccaagattgagaaaccctgagctagatacaaaaaaagagctaatatctctttaataagcgtttcaaaaaatagaggacccagatagtagaggaaaggtaaaatggagtccaactaaattcacagtgcaatggtggagaacccctggattgtgctgtcttcagcactcagtagctcgagcaggaaagcctcttaccgtgggtccctccccagggtaggagcaaaatcagcgtccaaggttttcttctgcacagttgtgtctggcctcccaggactcttttcaattcaggaaaagggctgagatgccttttccctgcctgtattttatactttagatggctgggtggtgccctgaagagcttgcacaatcaatccagaagagccatgtacccaatttacccaggaatgccttccagcttagcagatgtgctgccacatagagaactgctttccattgaatttggcatggtggaggcaattttgaatggataacagtataagaatgcagttccagtaagatttttgggtcattccattaatgtctccatataaatcctaaataaattataaaccattatttctgtcacttcattcttagtaaattctgactatattcttagtaaagtgtaattgaacaaaccatgtgcattttgtcaaagagcaggctctgccctgctatttaaaaatacaaatattgagccaggcgcagtggctcacacctgtaatcccagcactttgggaggccgaggtgggtggattgcttgaggtcaggagttcaagaccagcctgaccaatatggtgaaaccccgtctctactcaaaatacaaaaattagcagggcgtggtggcctatgcctgtagacccagctactcggaaggctgaggcaggagaatcatttgaacctgggaggcggaggttgcagtgagcggagatcaggccgctgcactccagcctgggtgacagagcgagactccatctcaaaaaacaaaaacaaaaacaaatatcagagcttcgtttcttgaagctgaatctctcacgatgcacaggcatctgtggctttgagatttgctcagttgattctgatgacaactgggctaggggtcactgttaatggaagcctcagaatgtttacagacacatgctaccatactcatttttggattcaaattccaaggcacatttaaatgtccttgcctgtcccacacctgttaaattccttaccaagttacattgacttgattctcactcatggcccacaaaacagtgtatatggtcattgttaatcattgcttttattacaatgattaggttgaatgtaatcacaactgggcttattttaaaagatctatgacagtgtcttagacatgccattagaaaaatggagtcttgccaggtatggtggctcatgcctgtaatcccagcactttgggagaccaaggcagaaggatcacttaagtccaggagttcaaactcagtctggacaacatagcaagatcccttctctacaaaataaaaaataaaaaaaactccatccaggcatattggtgtattgttgtagtccaagctactcaggaggctgagatggaagtgtcccttgagtccaagagatcgagactacagttagctatgattgcaccactgcactccagcctgggtgacaaacaagatctcagttcttaaaaaaaaaaaaaaaaaagaaagtgtggtatttaggaaatattaaggctcccattataatgtatgtgtaattgagaattcaatagggacaactttaaaagtgagaactttctcaatcttttcactggattattcaacatattagttccgaataactaaaggatacttcagtatttataaaactcttacatacataatgaagattttcctatcatcctttctagtttgcctctgttaaacctttttgtaattattaactcggcagtgcttggacttcatggggaagaatgacacaccagccttgaggttttagctagtgagtgttattcagctttaattacaaattctagaaaacctgttacaccaatagggccagcttctgaagatcccaattttagccttaaaactcaccttgaaactctgggcataaccataattacatgaccttattagagttgcttttctgactcttgcccaaaactgggatacaacagctttaaaaaaagaaattgccaagagtagaaaccgtgtctaaagcattttctccaggaagaatttaacatctttataaggttgacccagattcttcaccatctccatgactgtagcattttatctgattttgttgttacaatgacctctgtaatgaccaccatgcaaatacttgatccacacacacttgcaggaatgggattgacgtctttgactacatttcatgtccttgaacccatggtcaggccagcctaacatcagattcaacagggagttcttatttgcagtcaatcactttccacaaccttctccaggctgtaaaaaccactgggcattctgcaatagcagccacctgagctgatgcatcacagaaacacctatttttgtgttattccagcgacctaatgccacactagagcatttgggaaactgacatcttactcctttttctttttttctgtagttttgatagcagaatcaaggtgtttgccaatgggaccctggtggtgaaatcagtgacggacaaagatgccggagattacctgtgcgtagctcgaaataaggttggtgatgactacgtggtgctcaaagtggatgtggtgatgaaaccggccaagattgaacacaaggaggagaacgaccacaaagtcttctacgggggtgacctgaaagtggactgtgtggccaccgggcttcccaatcccgagatctcctggagcctcccagacgggagtctggtgaactccttcatgcagtcggatgacagcggtggacgcaccaagcgctatgtcgtcttcaacaatgggacactctactttaacgaagtggggatgagggaggaaggagactacacctgctttgctgaaaatcaggtcgggaaggacgagatgagagtcagagtcaaggtggtgacagcgcccgccaccatccggaacaagacttacttggcggttcaggtgccctatggagacgtggtcactgtagcctgtgaggccaaaggagaacccatgcccaaggtgacttggttgtccccaaccaacaaggtgatccccacctcctctgagaagtatcagatataccaagatggcactctccttattcagaaagcccagcgttctgacagcggcaactacacctgcttggtcaggaacagcgcgggagaggataggaagacggtgtggattcacgtcaacgtccagccacccaagatcaacggtaaccccaaccccatcaccactgtgcgggagatagcagccgggggcagtcggaaactgattgactgcaaagctgaaggcatccccaccccgagggtgttatgggcttttcccgagggtgtggttctgccagctccatactatggaaaccggatcactgtccatggcaacggttccctggacatcaggagtttgaggaagagcgactccgtccagctggtatgcatggcacgcaacgagggaggggaggccaggttgatcctgcagctcactgtcctggagcccatggagaaacccatcttccacgacccgatcagcgagaagatcacggccatggcgggccacaccatcagcctcaactgctctgccgcggggaccccgacacccagcctggtgtgggtccttcccaatggcaccgatctgcagagtggacagcagctgcagcgcttctaccacaaggctgacggcatgctacacattagcggtctctcctcggtggacgccggggcctaccgctgcgtggcccgcaatgccgctggccacacggagaggctggtctccctgaaggtgggactgaagccagaagcaaacaagcagtatcataacctggtcagcatcatcaatggtgagaccctgaagctcccctgcacccctcccggggctgggcagggacgtttctcctggacgctccccaatggcatgcatctggagggcccccaaaccctgggacgcgtttctcttctggacaatggcaccctcacggttcgtgaggcctcggtgtttgacaggggtacctatgtatgcaggatggagacggagtacggcccttcggtcaccagcatccccgtgattgtgatcgcctatcctccccggatcaccagcgagcccaccccggtcatctacacccggcccgggaacaccgtgaaactgaactgcatggctatggggattcccaaagctgacatcacgtgggagttaccggataagtcgcatctgaaggcaggggttcaggctcgtctgtatggaaacagatttcttcacccccagggatcactgaccatccagcatgccacacagagagatgccggcttctacaagtgcatggcaaaaaacattctcggcagtgactccaaaacaacttacatccacgtcttctgaaatgtggattccagaatgattgcttaggaactgacaacaaagcggggtttgtaagggaagccaggttggggaataggagctcttaaataatgtgtcacagtgcatggtggcctctggtgggtttcaagttgaggttgatcttgatctacaattgttgggaaaaggaagcaatgcagacacgagaaggagggctcagccttgctgagacactttcttttgtgtttacatcatgccaggggcttcattcagggtgtctgtgctctgactgcaatttttctttttttgcaaatgccactcgactgccttcataagcgtccataggatatctgaggaacattcatcaaaaataagccatagacatgaacaacacctcactaccccattgaagacgcatcacctagttaacctgctgcagtttttacatgatagactttgttccagattgacaagtcatctttcagttatttcctctgtcacttcaaaactccagcttgcccaataaggatttagaaccagagtgactgatatatatatatattttaattcagagttacatacatacagctaccattttatatgaaaaaagaaaaacatttcttcctggaactcactttttatataatgttttatatatatattttttcctttcaaatcagacgatgagactagaaggagaaatactttctgtcttattaaaattaataaattattggtctttacaagacttggatacattacagcagacatggaaatataattttaaaaaatttctctccaacctccttcaaattcagtcaccactgttatattaccttctccaggaaccctccagtggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcagtatctggcttgtccatctggtctaaggtggctgcttcttccccagccatgagtcagtttgtgcccatgaataatacacgacctgttatttccatgactgctttactgtatttttaaggtcaatatactgtacatttgataataaaataatattctcccaaaa

SEQ ID NO: 4205 - DNA, 17921 bp, human
cgagctgcaggaggccgcgggcgcgagactgggaatgcgcagggcccccgcctggctctacaagcccgggccgcggcccccgccttccccgccgcctcccggcgctccgtgcccgccccacgaggccggcggctgctgctacctggggccgttgctgcttgtgccgtgagcgacggccagccattgtccccgccgctccgtcagccgcgcccggccgcgcgcgcaccggaaggcgcattggcgtcttgcgggctccgggccgggtgggcaggatggcctccacaagccgcatggcgcgcatggggagcctccgttgatgccgccgcgccgccctccgaggctgcatccgcggaagcccggctccccgagcgctccggcccggcccggcgccccggacctgagtgcgtccccatgaaggcgcccgggctggcccaggcggccgtggcagaggagaccccggactgggcgcccgagctctgccccagccccgagtcgcggtcgccggagccgcctgccaaccgccttcaagacttcgacacgctggtcaccgtgggtgagtgagtgcgcgcggggactcggcccacaggggcgcgcggcgcggccgggacgctgtcgtaggacaaagggccccgggtgcccgcctcctggggagggccctgccccgccgctgcggctcgggatcccagcgcggggctgcccctgcgccctgggtctccctggggggcgctcggagaagtagagcgcaccccccagccccggcgagtcccccgaccgaccgggtgccttccctggaacgccgacggctcctgtcggggaccaccctccacccccagcacacacagcactctggggcctgggccatccgacgtcaccaaacttcctgtgggtcacctcgcctggggtaaatcgtgcgctctcccaggcagcggccccagggacacgggcgcggggtccctcaggccagcctcccagtgtgcccagcggcagggtcctcggcggggaatgtacagatttctccaggggctgcaggagcagctgggctccggggtacaggtgttccgtggctttgtggggatgaagacggcggagttggggacggatcctaacatgtcctgacaccgcctgtgctcttcgtcttgtgcgtctgaaatgggtaattcttgtattggacgctttatctcgtttcctttgtcctctttgaacttaactcccaatgggcagcttgacagagaggtttcgagttctcggtgcgcttggatccggaccacgcgctggtttatggggcagccctgagtgggtcagaatatcccagccgaacgtgggcgctggatttaaacagttgtcagtggtcagcctgtgccttcttaggggggtgtgttgctgggacaggtcttctcaggctctctaactcctgtttgtcctctcattttggacaggaggaagctaggctgggaagcccaatggctcagggttatagcttctggcttaggaagaccagcagccatagcccaggagccttcaggcctgctgaggaagaggggactgtgcttccttcagtgacctttttggcacctaggccttgaggaaggggtcatgaggaaaccctgattttggaaggatagtgggaagagggccctctctttttctcctgtccctccctttctcctattacattctctctctctctctctctctttctctttttgtctctctccctctttctgtgtctttatgcattactctctgtattagtcgtttttacgctgctgataaagacataccctagacttagaagaaaaggaggttgaatttcttttttttctgagacggagtcttgctcctgtcgcccaggctgaagtgcagtggcgcgatctaggctcactgcaacctctgcctcccgggttgaagtaattctcctgcctcagcctcctgagtagctgggattacaggtgcgtgccccaactcctggctaatttttgtactgttagtagagacggggcttcaccatgttggccaggctggtctggaactcctgacctcaggtgatccacccacctcaccctcccaaagtgttgagattacaggtgtaagccaccatgcctggccaggaggtttaatttgacttacagttccacatggctgggtaagtcccataatcatggcagagggcaaaaggtacttcttacatgacggcagcaagagagaatgaggaggaagcaacagcagaaacccctgaaaacccatcagatctcgtgagacttattcactatcatgagaatagcacgggaaagacccgcccctatgattgcagttacctccccctgagtccctcccacaacacgtgggtattctgggagatacaattcaagttgacatttcagtggggacacagtcaaaccgtataattccaccccggcccctccaaatctcatgtcctcacatttcaaaactaactgtaccttcccaacagtccccccaaagtcttaactcatttcagcattaacccaaatgtccacagtcagacaaggcaagtcccttccacctatgagcctgtaaaatcaaaagcaagctagttacttcttagatacaatggggatacaggtattgggtaaatacagccattccaaatgggagaaataggccaaaacaaaggggttatagggcccgtgcaagtccaaaatccagtggggcagtcagatcttaaagctccaaaatgatctcctttgactacaggtctcacatcaggtgcaagaggtggattcctatggtcttgggcagctctgtgcctgtggctttgcagggtacaacatccctccctgctgctttcacaggctgacgttgagtgtctgttgtgtttccaggcctatggtgcatgctgttggtggatctacctttctggggtttggacgacagtagctctcttctcacagctctactaggcagtgccccagtagggactctgtgtgggggctccaaccccacatttcccttctgcactgccctagcagaggttctccatgagggcctcacccctgccacagacttttgcctggacatccaggcatttccatacatcttctgaaatctaggcggaggtgctcaaacctcaattcttgacttctgtgcatctgcaggctcaacaccacatggaagctgcccaggcttggggcttccatcctctgaagccacagcctgagctctacgttggctcctttcagtcacagatggagcagctggaacccagggtaccaagtccctaggctgcacacagcacagagaccctgggcccagcccacaaaaccacttttttctcctgggcctgtgatgggaggggctgctgtgaaggtctgtgacatggcctggagacattagactccttcctacttatgcaaatttctgcagctggcttgaatttctccccccaaaaatggatttttcttttctactggatcatcaggctgcagattttcaaacttttatgctctgtatcccttttaaaacagaatgctttcaacagcacccaagtcacattttgaatgatttgctgcttagaaatttcttccgctagatattctaagtcatctctctcaagttcaaagttccacaaatctctcgggcagaggcaaaatgccaccagtctctttgctaaaacataataagagtcacctttgctccagttcccaagaagttgctcatgtctatctgagaccacctcagcctggaccttattgtcataatcgctatcagcgttttggctaaagccattcaacaagtctctaggaagttgcaaacattcccacattttcctgccttattctaagccctccaaactgttccaacctctgcctattacccaattccaaagtcgctgtgacattgttgggtatcttttcagcaataccccactcccggtaccaatttactatattagtctgtttttatgccactgatacagacatacccaagactgggaagaaaaggagctttaatttgactgacagttccacaggctgaggaagtctcgtaattatggcggagggcgaaaggcacttcttccatggtggcagcaagagaaaatgaggaggaagcaaaagcagaaaccctgataaacccattagatctcatgagacttattcactatcaccagaatagcacaggaaagaccggccaccatgattcaggtacttcccctgggtccctctcacaccacgagggaattctgggagataaaattcaagttgagatttcagtggggacatggccaaacaatatcattttctgtttctctatttctgtctttccccgtctcattttttttcttttcttttttttgaatgaatcattgaaaatgacatttgcaattatttcgggatatacttaatgacagactattaaatgcaaaaaggaagacagaatacactttttcaagcaaggctttccattccattcatttatttattcatcccggagtgctgggattaaaggcaagagccaccactcctggcgcaaggattccgtgtatatatatagaaatacatgtgtacagtgaaaggaaataaaaatggacaagaaggaagtcgagacccctgcagccgttattttttgggcaatagggaattcggtggttcttttggcctttggttttctgggttttctgagctagatttaaccatgctgaaaggctcttgatacacgaagttgccaggcctcaggattctcagagttaaaaccagcattgaatgggaatgtttgaaaacctcactgcagagccaagcctcccatgtgcaatttgcattttccctgtggaagcctgcggttccctgtaggaagccgcctcccttctccttgaagtctcctaggtctcagtttctgcatccacccaatggggatgacagtgaggcggtcagaagtcgcagctggggccaagcggggaggcagccagtggcgcgggctctgcaaggaaatcagtcgcgggccggcgcgaacacggagccctttcagacgctcgggcagcactagatggtcgggcggtcggttatctcagttggtgagcgcgtggtgctgataccgccatggtcgcgggcttgatccccgcaccggccctagtcccagttttttgttggtttgtttctttgttttctccccatgaactgtttctgcaactctttttcaaaatgcgcctttcaggttctgtaagccccatgcgggcaggagcgacttgcgggatctcttggactcggcccagaggttgtcgaggacagcctggcagggaggagcgggagaaacccggccagcgctggggcggtggctcctccccggagtccccgcggctggggcaaagcggaaggcagccagaggcgcgcgggcttggcgaggaatcgctcgtggacgggcgcgaacgtggagcccttttatacgctccaggggcactgtgccgtcgggcggccggttagctcagttggtaagagcgtggtgctgataacaccaaggtcgcgggctcgactcccgcaccggccacggcgttagcttttttttttttttttccccgccgccaccccgccatgaactctttctacaacagtttgtgaaaaatgcgcctttcgggtactgtgagcggcgtgcgggtaggagcgaactgcaggatctcttggtctccccgcccagaggttgtcgagggcagcctgctggggagagcgggaggtaccaggcatgcgctggggcggtggctccgcacccgagtccctgcaccctccgccacctgcaggccactcaggatatccaaagcgatccacatctccggccctcagcccccacccctgccgcccccgcgcttcctgaggctgtggctcccctggaggaatcgcccagtgaagacgggtgctcccagatgtcaccgcctcgtgttcccttggccgccttgcggggaagtcttagggttgaaaatccaggtctgcaatgaatgcattccacagatggtgtgtagggctactgcatgcccagcaccgttctaggcggggagcaaaacggtaagtgagacacaaatcccaagccacgtggagaaagtgaccagccagtagatgcctgccatgtttttagagaggcgttctggttgtggaagcctctggaaaccttctcttgctcttcccccccaccccccgtttcttttcagagacatcttaggcttcacatttcttcctcttggttctgcattttgcagccagagcaagtggatgagtttctcgctggtggttcaagtttctggggtggtcaggtgtgctccgttgaacgaagccagttgtgtagggtcagtgccattttctgtcacgatccagcaggggctccacctgcttttgaaaactctccagtggaaacatctactaactctgacctaaatcagtagctgctcaaaatctacagactactggcttaaaaccttggtaagtgcccagggtgtagtgaaagttctcaataaacgccggctggtggcgctgctgctactataagcaacgttaggagagcctgggtcggctgacacctgcaatagaaacctgtacgcaacaagttggatgtcacatcttgcagtagtcgtgccgggttagatgcagggacagagcacggaggagtcggtggaggctgctgccctcaagtttcctgaacttgaaggggtttagaatgtgccacggtggcgtgaaaattattttgagcagaaggcatttgaattcctgaaatttcttgtctgctgaaaagcagagcttcccaaaagatctcaaaagaactcagttgtcataaatcccttcttgggaaggaactaggaaagattgacttgggccaggcgcagtggttcacgcctgtaattccagcactttgggaggcctaggcaagtggatcatctgagcccaggagttggagaccagcccgggcaacatggtgagatcctctctctattaaaaaaaaaaaaaaaaaaaagaaacgaaaattagctgggcatggtagcgcatgcctgtagtccgagctactccagaggctgaggtggaaggatcacctgagcccgggaagtcgaggttgtagcgagctgagatggcgccactgcactccagcctgggcaacagagtgagaccctgtctaaaaacaaacaaacaaaaaaaaatgtggtaagatacccatcatatgaaattcaccattaaaaaatagcagggagcatcgtgaatgcgaagtattgatgaggatgatggtgatgttccagaaccttctctgacaccagcctggcgcccccccccccccccagccttacctttcctggcttcatggtgctcatcatactgtactgcaaatgctggtttcctccttctcgccagctagacccgtggtaccccacagggagggaatggcgactcacctaccaggcgcttaataagtgtttgttggccagtggacctcctacgctccctggggagagggactgggactgggactgggactgggacgtgtgtacacacctgcagctacaagactcggtggggagggtgcacagagcctcgaccctgtaagagaggcgatcgggctgaggaagacggggcactggggctggatggatgggacggacatgtggagagggtgggttcgtggatttgttcacccgttcatttattggtttctatgcatccatccatctttcacgccttgagcgtgcgttctgggcagggcctgtaatgggcaccgaatgagtaacatatcgtctctcccttcaaggtacacgcagcctgggtgggtgaggggagagacggtagggtgacatgggaacagtttgggggttgggaagcgctcttgttaaaaattcaaactttgggtcccctctcagatttataaacctaaacgtttgctggtggacctaggactccgcgtatccaggcaggatcctccgctgattggggtgcacgatgacgtcagaacacgtggataacgtgataacttgtgggccaggggctttggaacctcaaagaatgtgataacttttgggtcaggggctttggaacctcaaagacctccgcctgggagatcggggacagctcccggaggaggtgacatctgagtgttaaacacatccgtgacaggcaatgagaaaataaggtgggtccgctgtgctgatcggccctaggggccgcggcggctgtcccggccgggcagcgtcgccttccgaggtgtcttggcctgcggggcactcgtagcccgccgctttcccaggtgaggcacgtcgtcgcccagcgacccaggttggagtccccgcttcagccgccgcggcggatgcggcggccaggcttctccgggccagggcagcgttgcacgtgtggccccgctgggccccgagcagctgcggcaggtcctgaagcgggtgacgaaggcgcagctgctgccgccgcggcccatcaggccgccctccagcgggaccctggcgccgagcccccgtgcccgccacgcctgctgccgccccaggtgaggctccgggagcgacgtggggaaactgaggcccggagggggccgaggccccgcggcggggttagctgcttggccggggtggccagtatccggccccagtcaagactcagggtgtcccgaagctgagccccttagggacggcgttcggcccccacctgccaccaccctggcgttttcaccccaggagcctcacttgaggagccgatgctcacgctgggccctctgcctgggacgccgtcgtgccctctctgcctccacagccctgcccggggctcccctgtgctgcctagctcgtctgacacgcctttgaccactcgttcagcctctgtggggcactcagagacggggttgcccgcactcccacctaagtgcaggaggtgcggccttcaacacactcgaagaacgaacatcaggcaggttctgggagggacagggggccgctttagagtgggtgggcccgtaggccagacgctgcccctgagacctgaatgaattaaaaggaaccaactgagcttttcaggtctcaggcacagcaagtgccacggcccagcattttcttctcttcattgctgcttctcagcattttctttctctctctctctctgtctctgtcactgtttttgcatacagatactatgcttttggggtgggtactctcattgtccttccaggggtcctacacggcgtctgtaaaattccatctcatttcattgctggcgctgtaaataaaattagtcttaacccaaaattgccaaaagaagagggctttttccactagaagagatgcgttagagaatagaatcagcgatcttcactcctgagttttttcgacttcactcgtgattttagctgcctggggttgttgtatccagttcatcatcaagagtggagagttgtcttgctaaggtttaggaaggcaagtatgattctgcccaaatgccacactatctagaggtgtgaccttgggcaactcgacctttttggactgtggtctgggtccgaaggctgcaagacgccatcccgggacagccatctgctgagcctctgctctgtgccgggcagtgttctgggttgcttagctcgcagtagtgtttttgtaccagcattttgcagggaggttgagtggctttgtccaagatccctcaggtgtggctgctctccagagcccttgttctccccagcacaccctgctgtatgtggccacagctttttgggtttggaatggagtaaaaaatgacatacttttcataaagtaaaagcaaacttagtcaagatcaggcagcatgatgggacttattctgtagctaatctgatggagacgtataaattctacctccaataatgtacctttgtagcacattctgctaatactttttcagccccagctgtgtcgtggaagccacgaagtcaaaccggatgtgtactttgcccctcagtagctgatgaactaacaggagataaaacatgacccagatacctgctaatcaaggcctgaaagctagtgatgaagaactaaatgtagttagagaaagggagattgtttctggccgaggaaatcacaagcagctttgttgaagaagtggtatctgaactagatttgaaagggtgagtctgagttgaaaatgcagaagaggagaggcaggttctggagcaggtggcggggtgcatttcaacaaccacagcagactgcccagtggttcgctgtgggggatggtgtggatcagaagcacagaccagtggacacacttgggtcagatggaggcccctgtctctccgcatcttccctcttcccaccccccagaaatgtccagttccatccaacatgccaaccccttttcatgcatccatgcatgtacacatttttctttgtactcagaatgccctacctggcaaaaattcccagccttcaaaacgcccctcagagatcactgcttctggtctgttctgcctctttattgcacctgttgtaccatgatgacatttttcccgtctgcctcacctgtctgcattccttagggaaacttgtctgccttcgaaatcgtcagcggagcttttgaaagggcagatcgggtctccgacccaggagatcgattcagcaggtctgcggggactgaggcatggcagggaaactgcccaccatctcaagggtgaggctaggagttggctagtgtgtatgtattccatccagaaatatttagtaaatgttcaccaaacaaaataaaaacacacaagaaagcatgaggcgtaatacccacggggtaagccagtcaggatagaggatgaatacattattaggccggctttgctgctgtggttatcctaaaacaatagggtttaggttgtgtgtctgtgtgtatatgtattttgttgttgttttggggttttgttgagacaaggtgttgcattctcacccaggctggactgatcacggctcactacagcctcaaactcccagactcaaacgatccttccccctcagcctcccgagtatctggggctacaggcatgtaccatcaagcctaattttaaaatgttttgtaggcggggctcggtggctcacccctggaatcccagcactttgggaggcggcggcgggtggatcacctgagatcaggagtttgaggccagtctggccaatgtgatgaaaccccgtctctactaaaaatacaaaaattagccagtcacggtggcgcatgcctgcaatcctagctactagcgaggccaagtcaggaaaatcgcttgaactcgggaggcagaggtttcagggagccaagaatgcaccactgcagtccagcctaggcaacagtgagactctttgttttgggtttttgtgtttttttttaacattttgtagggacagggtcttgctctgttgcccaggctggccctgaactcctggcctcaagcaatcctcccacctcagcatcccaaagcactgctactgcaggtgtgatttgtgtttggcccttagagagagattctgtgtgattggtagtaaaatgaaacagacatcgttcttgaaggatatgcacagccaatctagttgtcatttgatttgcacgtagcccaggaatggggactcccagggttgtggtgccacctcggtacacttgacctctgttatttgtactagtgtataacaagagccagacgagagacacactccagcctgatctcagtgagggtctttattctgtcctgtttgacatttttattgactttctactgtttgagggtcacaccagaaggttgagtccaaagagggccagttggtggtcccaaataagtggttctcaaccgaggacagttttgccccacaaggggcacttggcaatatcttgtcaggactcgggatcactactagcatctagtgggtagaggcagagatgctgctgggcatcctccagccacccatgtcaaaggattatgttctgaaatgttggttgtgaaatcatgctctggatgacgaggtttgcctctttttctccctggaggaaaatgctcattatttctgctctgtgagggcaggagccttgtttcttttgcttcctgaccttctcccctaagctgtatgagaactgtttctctgacacctgtagcagtgtctcatgcacatggtcagtactcaataaatatttgtgggatgttgtcgaaggtagctctcccctttggtaggtgttttgctattacagacagtgctgccttgaacctcatagaacataacatctttatggccatctaagtttttttaattttggaatccaggaagtagaattactgggtcaaaaagcacatgtatttgaaattttgttagatatatttgtaaaaagttgttgaggatattcagcccggccgggcacggtggctcacgcctgtaattccagcacttcgagaggctgagtggggcagatcacttgaggtcaggagtttgagaccagcctggacaacatggtgaaaccctatctctactaaaaatacaaaaattaaccaggcgtagtagcacgtgtctgtaatcccagctacccgggaggctgaggcaggagaatcacttgtacctgggaagcgcaggttgcagtgagctgagatcatgccattgcactccagcctggacaacagagcaagaccttctctcaaaaaaaaaaaaaaaaaagaaaaagatattcagccctactcctagatacatgcccctggagaaactcacacatgtacacacatacatccgtggagattcagagcagaccttagagcagaaggttggaaagtacccatccatcaataggagattggtaaactcatactgcagagaaaatcaacccctgagagctacacatgtcaatgagggtaaaattcacaaagcaaaatggagtaaagaaacctgaaaaaagccctatcaagttgcaggagatgatatcatttctataaagttttaaagcatttcagaactgaactgtatgtttttagaaatatctgcatatgccatgtaaatatttaaaaagcataagaatgctgaacagcacattcaggacagggtgaagaaacgggcatgcaggttgggcaggaggatcctgggtaacattgtcctttatggcttttttgtggcttctagaatttcattagaaacttttttaaaaacatggtcccacattatgaattacatctgattttagagtactaaaaactccaagcaaaaacacatgggtgaaactgttgagaaggctcttattatctcttaattcatcatgaaatcaacttagtggattatgactagtattttttttaaagtgatgtagattagggtcagtgcggtagctcacacctgtaatcccagcactttgggaggtcgaggcgggcgggtcacttgagttcaggagtttgacaccagcctgtccaacatggtgaaaccccgtctctacagaaaatacaaaaattagccaggcatggtggcgtgtgcctgtaatcccagctatacaggaggcagaagcaggagaatcactcgaacctgggaggcggaggttgccatgagctaagatcgcgccactgcactccagcctgggcaacagagtgagaccgtctccaaaaaaaaaaaaaaaaaaaaaaaaaaaggtgatgtagaaatgaagaatagatacaatcagcaggcatttacataggaatgctaagtagttccatcagcttttcatttatgtatgcaaatatttatatacgtgcatactaggtcataatgtaaaatgtgtcactgtggtctgtttttgttttttgtttgtttttgagactgagtctagctctgtcacccaggctggagtgcagtggcaggatctcggctcactgcagcctctccgcctcccaggctcaaacaattctcctgcctcagcctcccaagtagctgggagtacaggaatgtgccaccacacccggctaacttttgtatttttagtatagatggggtttcaccatgttgaccaagctggtctggaactcctggcctcaagtgattcagcctcccacagtgctgggattacaggcgtgagccaccgtgcccggccattttgtttgttttttgagatggagtctcgctctgtcacccaggctggagtgcagtggcgcgatcttggctcactgcaacctcgtcctcccaggttcaagcgattctcatgcctcagcctccaaagtagctgggattacaggtgtgcaccaccacaccctgctaatttttgtatccttagtagagaaggggtttcaccatgttggcctggctggtcttgaactcctgacctcaagtgatctgcccaccttggcctcccgaagtgctgggattacaggtgtgagccactgcgcccggcctgtatcactgtggtttctggtcagaaaggtctgaaaaacagttaatacaaacacgttacataaattgtatatgtaagacgtaatttagaaaaaatgtcagtagtggatttactatgagagcagaattgcagacatgttgataagcacaatgcttcttttccctttcttgtctttctgtaggaaagcaactagaagccatttgtgtcaaggtaacgtctggagaaacaaaaggtcaggaacggccaacgtccctactggccacagtccagccccaatctgcaagacagagccagccgccccgggggaattcccgcctggtgggactccacgtcaccagcccccagctgctcagggtacagcccctcgtgagaaccgagccacagtcatgtttcctacatcagcctcctgctcaggggtttgtacagagaccactgccagccctctaggtggtccctgcaaagagagtcccagctcccaaggctccaaatggacagggcaccatgttgaccccttcgttggcctccagttcgccgactgtaacatgtttcatccagttcaggacgtttatttatttccaacttgcatacaaaacatactgagaaactaaaaccatcgttaaaagtgaagacacgttgagacaggtatctcgacctgccaagtatacagctaaagctgagttcataaaaagggatgatttggccgacggtcatctgccagattctgatgatgattcagaactcagtgtggaagaacatcagagggagaggcaggcgctctttgacttatcaagctgctccctgaggcccaaaagcttcaagtgtcagacttgtaaaaagtcatatatagggaagtggggactggcccagcattttaaacttaatccaggccatggccagctggaccctgagatggtgctatctgagaaagccaatgggagcaccctccgtgggtgcacagaggaaaggacgctcagcctgaccttcccggggctgtccgtgccagcggctccgcgtgagggaggggcccgctcctgcttggtgagagagtcagcacgcggtggcctgggtaatgtttgcatctgggtgtcgttttcggccattctcacactgttataaagaaatacttgagaccaggtattttataaagaaaagaggtttagttggctcacagttccacaggctgtacgggaagcatggtgctggcatctgctcagcttctggggatgcttcagaatcagtcacggtgaaggcagagtgggagcaggcatgtcacgtggccacagcagggacaaggggccggggtaggtgctgcacacttttttttttcctttttttttttggagacggagtctcgctctgtagcctaggctggagtacagtggcgcgatctcggctcactgcaagctccgcctcctggtttcacgccattctcctgcctcagcctcccgagtagctgggactacaggcgcccgccaccgcgcctggcaattttttctatttttagtagagacggggtttcatcgtgttagccaggatggtctcgatctcctgacctcatgatccacccacctcaaccttccaaagtgctgggatgacaggcgtgagccaccgcgcccggcaggtgccacacacttttaaacaaccagctatcatgagagcagcaccaagcggatggtgctaaagcaatgagagattcaaccatatcagtccttattcctgcctctgcctgcccatcatccttaagttgacctttacaatgcctgatggggactcaggcgaaggctcaggcagaaccagaatcattcttgtggaagatctgagacccctcatgttgtctgcactgctgccgaacaggctggaagatgcatgtctgtgtgtcggcatgatttagtgagcaaatctgatgggaacgcagccgtttctttaggtttggtcagtaaaaccaatggcagtgcactcttggctgacgctgccattacagagggtgatgttgagaaaggcagtccctggggatgcttccggtgtgtcaatagcctctggctgcttagcgtgtcctctccctcctgccccttctgaaactcccgataaagcaggtgtgagtcgctgtaagtttgcattatcacatcaaaattttttttccaacatattttattgtagtaaaatatacatagcataacatttaccatcttagccatatgtaggtgtgtggttcaggggcactaaatacattcacgatgttgtacggccatcacccccacacatctccagaactcttttcatcttgtacaactaaaactctgagcttcaagttggggtaagcggggcagtggggggactaaaactgtccccataaacaccaactctccattccctttttccccaaccctggcagccactattccactttctgtctctatgattttgactacgctgctttcttcacagaagtggaatcacagaatatttgtctttctgtgactggcttatttcacctagcacagtattctcaaggttcatgttgtagaaagtgtctcagtgtcctttaaggcggagtaaaatttcactgtgcataccacattttgctcattcattcatctgtcaatggacacttgggttgcttccaccttttagctattatgaataatgctgctgtgaacacgggtgttcaattacctccttgaggccctcctttcaattttttggggtatatatccagaagtaggattgctagattttaagtggaattttcattttctttagttccttttcagactgttcattgtttgttagtatttagaaatgcagctgatttttgtctattgacttttttttttttttttccagtctcactctgtcgcccaggctggagtacagtggagcagtctgagttcactacaacctccacctcccaggttcaagtgattctcctgcctcaacctcccgagtagctgggactacagtcacgtaccaccagtaatttttttatatttttagcagaaacggggtttcaccacgttggccaggctggtcttgaactcttgacctcaagtgatccattcaccttggcctcccaaagtgctgggattacaggtgtgagccaccgcacctggcctgtgtatttaccttgtatgctactacattgctgatttcatttattaggttttttttttaattcttttttaaaaaagaaaaaagagacagagtctcgctctcttgctctgtcgcccaggctggagtgcagtggcacaatcttggctcactgcaacctctgcctccagggttcaagtgattcttgtgcctcagcctcccaagtagctgggaccacaggtgcccaccaccatgcctggctaatttttgtatttttttgtagagatggggttttgccaggttttgccatgttggtgaggctggtctcgaactcctgacctcaagtgatctgcacacgtctgactcccaaagtgctgggattataggcacaagccaccatgcctggcctcatttattagttctaacgtgtgtgtgtgcacacacgccctttaggcatttctacttataagatcctatctgcaaatagagataattttactt

SEQ ID NO: 4206 - DNA, 1679 bp, human
tgtggatgctgggagaagtatgtgagatggaaaagttgtttcatggcatccaagaagtgaatgatcctcaaggtgtagcagaggaatttgtaggagagagggatgattgacatcttcgtgtagccctccatccatcccagttagcatggagggattttaggtaggtcatacagaaaccgggtaatgatggcaggtgtggaggaacagaatgtaccactgaatgggaggtccgggggaaacatgtggcggaaatatcctcccgtgccacgtgatctgccaaaattgaacatggggagtttaggaggggtgacatgtcagtttgggaactatctttaggggtgctaacccaaatctccctttctccaattagagcaccctgccttcctcattagatgtcacccccccccgcccccgacttcatccgccatgtcctgatggtgctttgtgacgtataaggccttccttcccgcccagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccaaggaggcaggaaagaggaagtcctcctctcagccgagccccagtgacccgaagaagaaggtgagtgaccctcccaagctcctcctcgtcttcccctcgcctccttcctcacaagaagcctctcctgtcgtcacttggcacaaccccccaacccggcccccaccgcttctgaggacacgtccctgttcccagcctcctccatcctcgtccctaaaccggagcccttctgtgatctccctgttgtccttccagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgagatggaagaaccactgagtcaggagagccaggtggaggaaccactgagtcaggagagcgagatggaagaaccactgagtcaggagagcgagatggaagaactaccgagtgtgtagacggccaagtactcccctatctccgagagcagcgactaagttcaggcccagccgccagacctcagagatctcaccagcggggtgcttgccattctgatgataataaaatgaatgtgttgcaaattg

SEQ ID NO: 4207 - DNA, 1043 bp, human
ttgcgagacgttgagctgcggaagatgagtccaaagccgagagcctcgggacctccggccaaggccaaggaggcaggaaagaggaagtcctcctctcagccgagccccagtgacccgaagaagaaggtgagtgaccctcccaagctcctcctcgtcttcccctcgcctccttcctcacaagaagcctctcctgtcgtcacttggcacaaccccccaacccggcccccaccgcttctgaggacacgtccctgttcccagcctcctccatcctcgtccctaaaccggagcccttctgtgatctccctgttgtccttccagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgagatggaagaaccactgagtcaggagagccaggtggaggaaccactgagtcaggagagcgagatggaagaaccactgagtcaggagagcgagatggaagaactaccgagtgtgtagacggccaagtactcccctatctccgagagcagcgactaagttcaggcccagccgccagacctcagagatctcaccagcggggtgct

SEQ ID NO: 4208 - DNA, 1146 bp, human
ccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccaaggaggcaggaaagaggaagtcctcctctcagccgagccccagtgacccgaagaagaaggtgagtgaccctcccaagctcctcctcgtcttcccctcgcctccttcctcacaagaagcctctcctgtcgtcacttggcacaaccccccaacccggcccccaccgcttctgaggacacgtccctgttcccagcctcctccatcctcgtccctaaaccggagcccttctgtgatctccctgttgtccttccagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgagatggaagaaccactgagtcaggagagccaggtggaggaaccactgagtcaggagagcgagatggaagaaccactgagtcaggagagcgagatggaagaactaccgagtgtgtagacggccaagtactcccctatctccgagagcagcgactaagttcaggcccagccgccagacctcagagatctcaccagcggggtgcttgccattctgat

SEQ ID NO: 4209 - DNA, 1676 bp, human
tgtggatgctgggagaagtatgtgagatggaaaagttgtttcatggcatccaagaagtgaatgatcctcaaggtgtagcagaggaatttgtaggagagagggatgattgacatcttcgtgtagccctccatccatcccagttagcatggagggattttaggtaggtcatacagaaaccgggtaatgatggcaggtgtggaggaacagaatgtaccactgaatgggaggtccgggggaaacatgtggcggaaatatcctcccgtgccacgtgatctgccaaaattgaacatggggagtttaggaggggtgacatgtcagtttgggaactatctttaggggtgctaacccaaatctccctttctccaattagagcaccctgccttcctcattagatgtcacccccccccgcccccgacttcatccgccatgtcctgatggtgctttgtgacgtataaggccttccttcccgcccagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccaaggaggcaggaaagaggaagtcctcctctcagccgagccccagtgacccgaagaagaaggtgagtgaccctcccaagctcctcctcgtcttcccctcgcctccttcctcacaagaagcctctcctgtcgtcacttggcacaaccccccaacccggcccccaccgcttctgaggacacgtccctgttcccagcctcctccatcctcgtccctaaaccggagcccttctgtgatctccctgttgtccttccagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgagatggaagaaccactgagtcaggagagccaggtggaggaaccactgagtcaggagagcgagatggaagaaccactgagtcaggagagcgagatggaagaactaccgagtgtgtagacggccaagtactcccctatctccgagagcagcgactaagttcaggcccagccgccagacctcagagatctcaccagcggggtgcttgccattctgatgataataaaatgaatgtgttgcaaa

SEQ ID NO: 4210 - DNA, 1553 bp, human
tgtggatgctgggagaagtatgtgagatggaaaagttgtttcatggcatccaagaagtgaatgatcctcaaggtgtagcagaggaatttgtaggagagagggatgattgacatcttcgtgtagccctccatccatcccagttagcatggagggattttaggtaggtcatacagaaaccgggtaatgatggcaggtgtggaggaacagaatgtaccactgaatgggaggtccgggggaaacatgtggcggaaatatcctcccgtgccacgtgatctgccaaaattgaacatggggagtttaggaggggtgacatgtcagtttgggaactatctttaggggtgctaacccaaatctccctttctccaattagagcaccctgccttcctcattagatgtcacccccccccgcccccgacttcatccgccatgtcctgatggtgctttgtgacgtataaggccttccttcccgcccagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccaaggaggcaggaaagaggaagtcctcctctcagccgagccccagtgacccgaagaagaaggtgagtgaccctcccaagctcctcctcgtcttcccctcgcctccttcctcacaagaagcctctcctgtcgtcacttggcacaaccccccaacccggcccccaccgcttctgaggacacgtccctgttcccagcctcctccatcctcgtccctaaaccggagcccttctgtgatctccctgttgtccttccagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgagatggaagaaccactgagtcaggagagccaggtggaggaaccactgagtcaggagagcgagatggaagaaccactgagtcaggagagcgagatggaagaactaccgagtgtgtag

SEQ ID NO: 4211 - DNA, 25286 bp, human; identical to SEQ ID NO: 2949

SEQ ID NO: 4212 - DNA, 11815 bp, human; identical to SEQ ID NO: 2951

SEQ ID NO: 4213 - DNA, 190968 bp, human; identical to SEQ ID NO: 2952

SEQ ID NO: 4214 - DNA, 254730 bp, human; identical to SEQ ID NO: 2953

SEQ ID NO: 4215 - DNA, 255533 bp, human; identical to SEQ ID NO: 2954

SEQ ID NO: 4216 - DNA, 256445 bp, human; identical to SEQ ID NO: 2955

SEQ ID NO: 4217 - DNA, 256445 bp, human; identical to SEQ ID NO: 2955

SEQ ID NO: 4218 - DNA, 224706 bp, human; identical to SEQ ID NO: 2957

SEQ ID NO: 4219 - DNA, 252950 bp, human; identical to SEQ ID NO: 2958

SEQ ID NO: 4220 - DNA, 218824 bp, human; identical to SEQ ID NO: 2959

SEQ ID NO: 4221 - DNA, 190968 bp, human; identical to SEQ ID NO: 2952

SEQ ID NO: 4222 - DNA, 254730 bp, human; identical to SEQ ID NO: 2953

SEQ ID NO: 4223 - DNA, 255533 bp, human; identical to SEQ ID NO: 2954

SEQ ID NO: 4224 - DNA, 256445 bp, human; identical to SEQ ID NO: 2955

SEQ ID NO: 4225 - DNA, 256445 bp, human; identical to SEQ ID NO: 2955

SEQ ID NO: 4226 - DNA, 224706 bp, human; identical to SEQ ID NO: 2957

SEQ ID NO: 4227 - DNA, 252950 bp, human; identical to SEQ ID NO: 2958

SEQ ID NO: 4228 - DNA, 218824 bp, human; identical to SEQ ID NO: 2959

SEQ ID NO: 4229 - DNA, 46745 bp, human
taccgcggggccggtcacggggagcgcgtccagaggtccagcccgcggcccgaagggtgagggacggggtcaggtgcgcgctcaggggcccacgcggccgctcgtaccggggagagctggagaggggcgcgccccggttctctcgcccggtggaggggagcgggccgggaggggcgctcaggcgcgcgcgccgttcagcgggttcggggtcggggtcgaggagcgcgcgccccggggctggcggagccagcgcgggcgaggacgggggcggaggccccggcgccaggtcgggcctttcctcccgcgccagagctctgcagtgcttcgaagctctgggcgcccccgcccgccggttggaggccaggaccgggcaggtgaggcggcaggtgagatgggcgcggggtggcgtggcgggagtctccggcctcctccgtctcggggcgcgcggcccgccggcgcccacactttgttctcgcgcaccgcgggctgccgcgcaggtgagagcggaagcgccgcgggaggccctggtgcccgcgctgtggccgctgccccggggcagagggaccgcccgtcccgcgcggccctgcgcgcactcacactctggacttagagagccgggaagggcgccccccagcagcctgagccgggcgcgggtccggcctctggaggggcttggaaggcgggcgcagaaggaccgtgccccgtttccacgagggccttcccaccttcccgcagaggcctcccacagccaccgcgcagaaagccgttgcgtctagatgctgtccccactcgcctaggattggaccacaaggtcttcaagtttcccaggtttacatccccgaaaaggggaggtggaggtctgggattggtgaaagtttgcggacaacatgtgtgccacctcttcctgctcggtttcagtttccatgaaactctggtctaaagtacctgcatggataggtatttacatgctttgcaaaaaagctgttttcgttgctgtttctatacgtagctgaaggctggtgaacacctcttttctctaagcagctccatccaggcccttttcagaggtgacgatgctggagtacgcatccaggacaggccgggagagcactggacagagagtcaagggtccccgggtctgggttctgccactgtcaagctgggacaagaaatctcagctctggtctgtttcttcagaggtcaagtgagaggggtgcattctgtggaggtgtctcatgcagccgattaaattcagagtcgcagctccactgggcacctgtcatggcgctgggcacgtggtgactgccccataattaacttctaactacagtctctgaatgcctttagttagaagaatgaggcgattttttctttttcaaagattaaacgaaggcttaaggaatgtgcctctcagaatcaagtcgagtgtatcttcactgtggtgatggtcacaggagctgccaagttgattaagctaaattgcacagaactaaatgcacgtgaaacgggaaatctgaaaaggcttggtggattgtatcaatgtccatattccaggttgtgacattgtgctgtagttttgtaacgtgttgccattggaacaggcaggtgaagagtgaagggtgcacaggacttccctgtattattccttaccaagaggcgaagccagttgggtggggactccgagaatttttctgtcttacaagaggattgtaaaatgcaccaatcagcgctctgtggctagctagaggtttgtaaaatggaccaattagcactctgtaaatggaccaatcagcgggatgtgggtggggtcaaataagggaataaaagctggccactgcagctagcagtggcaacccggtccagtccccttccatgctgtggaagctttgttctttcgctcttcacagtaaatcttgctgctgcgcactctttgagtctgtgccacctttaagagctgtaacactcacagcaaaggtctgcagcttcattcttgaagtcagcaagaccaagaacccaccggaaggaaccaactctggacacattacaactacatgtaaatccagttatctcacaaagtttaagaaatggatggatatgataaaccaaaagataaagagctgtataaatatacccagtgtgcttattagagtttgcagacatgtccgtctcccaaaacagcccactccctacctccccaccccaagctggtatagacttcagtctaagctcttacctggggctaaaattcagaccactagactcattataaagcagagacagtgatttcattgtctccataaatccagcattattctatatagccccaaagtcatctttaacattttatgttcaccgtacgtaatcattgtcagattacccatctgccacttgaaaggtttatactttttaaaaggactcccttgttcttaaacttagctagaaatttacatccatccttactaaacagtgtttagctggggtgttttgtttttttaatcttcacattaagcatccatctcaggatggttggaatatttataaggctgctgtctataatgatgttatgctgtaagggactgaaccaagatttgtgtggcctgctatgagacaggtgcctgctcagtcataaatccttttgtgatattcttggggttactatggtctaggtgcgatgacagcacttctatattgtgtttgttttgtcatcacaagacactgtcaataatcttgtgaaaatatatcttgtggctgaaaggcatcaccccagttgatcagtcttgcacccccattgggagagttttagtatgacgttgaaccagtgtatggactcctagtagatggctttcttttctgagaactcacaactcaggtggaattttcagaagcagaatccatttgtccatgttagtcttttgtccttttggaaagctgaggggcatgtttgttctgtgtaatttctcactgtggttgttcattgctcagagaatagggtgagcatatactctcttctggacctgcaaggagtgtgaccctatgagcgcctgccccggggattcagtagccttaggtgtttgtttcactttttctttttcttttcttttcttttctttttttttctcttttttttttgagacagagtctcactgtgtcacccaggctggagtgcagtggcacgattatggctcactgaagcttgactgccccaggcttaggtgatcctcccacctcagcctcctaagtagctgggactataggcatatgccaccatgcctgcctaattttttattttttgtagaaacaggatctcactaagttgtccaggctggtctcaaactcctgggctcaagtgatccacccacctcagcctcccaaagtgctgggattacaggcatgagccattgtacctggccactgtttctttttctttttttcttttttttttttggagacggagttttgctcttgtcgcccaggctgaagtgcaatggtgagatcttggctcactgcaatctctgcctcccaggttcaagtgattctcctgcctcagcctcccaagtagctgggattacaggcatgcgccaccttgtccagctaatttttgtatttttagtagagatgggatttcaccatgttggtcaggctggtctcaaactcttgacttcaggtgatccacccgcctcggcctcccaaagtgctgggatcaggcgtgagccaccgcacccagtccccggccacttttgctaatctgaggtttatttcctatgagagaagagatagatgaaactgaggatggttctgctttcacttcgtcaacagtgaatgaattaattaatgtaaggcaaattaaccaacgttcagagacttcattaatagctaatcttctttatgaaatacagctcaaattattttagctttttgttctaaaaagaaaagagatttatactcattacaaaatgtggtagaagatggagttccaaaattttactttcacatttcaaatagtggctccgtagggtcaagccttccagaaaaccttttagtgtggcattttaaaaatggcaatattagccacttcctactaaacccgctgtgttcctattaattcagactggcacaggatcagtcaagatcagagagcacgagtgatgcagttgaaggaaatctgtgggaagggcacactgactcatactgctaaccccagcactttgggaggcccaggtgggaggatcgcttgagcccaggagctcgaccagcctggccaacatagcagagccttgtctccactaaaattcaaaaaaattagctgggcgtggaagcatgtacctgtgatcccagctacttggggcgctgaagtggaaggattgctgcagggaatgaagatcatgtcactgcattccagcctgggtgagatattatctcccccaccccccaaaaaaaggaaaactatgacacggaacgtttaccctttgtcaccaaggtttggcatcttcttgatttctatgagctattattataaacattgggatgaccaggtgcggtggcttacccctgtaaccccagcactttgggaggcccaggtgggaggattgcttgagcccaggagttcaggaccagcctggcaacataaggagaccccttctctaaagaaaaattttaaaattagtccgacatggtggtgtatgcctgtagtaccagctactcaggaggctgaggtgggaggatcgcttgagcctgggaggcggaggctgcagtgaatcgggattatgctgctgtacttcatcctgggcaacagagcaagacccataaacagagcaaagaaacataaaaaaattgctttagaaagccattgactatgttttgctttgttttgttttgttttgtattttggagacagggtctcactttgttgcccatgctggagtgcagtggtgtaatcacagctcactgcagcctcaactgcctggactcaagcgattcccccacttcagcctcttgaatagctgagaccactgacctgtaccaccatgcccaactaattttttttttttttttttttttgagacagagtcttgctctgtcgcccaagctggagtgcagtggcgtgatctgggctcactgcaagctccgcctcccaggttcacgccattctcctgcctcagcctcccaagtagctgggactacaggtgcccaccaccacgcccggctaattttttgtatttttagtagagacggggtttcaccacgttagccaggatggtctcgatcacttgacctcgtgatccgcctgcctcggcctcccaaagtgctgggattacaggcatgagccactgcgcccggcccaatttttttattatttgtagagatgaggtcttgctatgttgcccaggctggtcttgaactcctggcctcaagtgatcctcctgcttcagcctccccaagtgctgggattccaggcatgagccattgcacctagcctattttttgtattttaataaaattgccagtaagcatacatttcttgagcactttttacttgcccaatacttgttgggtgggggggggggggaatgtaatggtgcaggaaatatgaaacattatctgtagcagtgaggaaaaggaaatctcatgaaaaatcagtacgattaactgctaaaccacttttaactacaaaagtttcaacaggagagaaattagaatgttaaaaacgataataaagccataagggccgggtgtggtggcctgcatctgtaatctcagcactttgggaggctaaagtgggaggatcgctggagccccagaggtcaaggctgcagtgagtcaagattgcaccactgcactccagcctgggcgacagagggagaccctgtctccaaagtaaataaataaataaagccataagtaaaatattttagttttcatctgtcattgtggaaatttcgaatggacacaaaagtagaactcttgtttcatccttcacccactttttatcctgaaatatttcaaagctcatccaagtcttaaagacaaagctgcatcctggtggctgagaggaagtgggggtgagggttcttctggtggcgcccccaccccccaacgcaggctgcaggctgataggaagctccttcatggaaagttgatctgcttaaagacaggaaggcagaaatctcttagtgagtccagttcttacacaacttctcaggagaataatgtcaaaatcagtttcaaaaaggctgtctccatgcacaaagcgaccctccaatagtgccttctcttggtgaccacagagctcattctttcaacaagtctgccgtcacccagcacgacccattcccacatggagctgagtgtcctggagagggcttggagagggcttggagagggtggagggactcagctaccaccggtaggtaacaaagaccacggtgtgacctcagcatggtggctgagtgcaaggagaacaagatctccagtggaggaaccaagaagctgcagaactgtgaggctcatcgataggaacattggaactgtcatgatttatcactggagaatggtggaaaagggtgacagtaggccaggcgcggtggttcatgcctgtaatcccagcactttgggaggctgaggcaggcggatcacctgaggtcaggagttcgagactagcctggccaacatggtgaaaccccgtctctactaaaaatacaaaaattagtttggtgtcgtggtgggcgcctgtaatcccagctactctggaggctgaggcaggagaatcgctggaacccgggaggtggaggctgcagtgagccgagatcgcaccactgcactccagcctgggcgacagagggagactccatctcaaaaataaaaataaaagcaaagaaaaagaaaagggtgatagtgagccagggaatgaaagggagtgactctggagtcagcaaatgacttcacctgcacagagaacagggtggtatgagcccaggacaccagcagcctcaaggcaggggatttaagtggggagaaagcaggtggaaaaaggtgagtggggccaggaagccgccttcaccaccccctgcctgagcagggtagtcaggaggggtgtggggaggaaagcagcccatgctccatggctggaggaggcacagtgccagggagggccaggtgtccctccgtgcctccttcagaaggggccactgagagaggaggctgaggatgggaattcctggtgattgcgggtttccggtggaggcggggcgcacctggaggcttggctagcatgagcagaaaacagtggaggctgggggcgtgggcttcgagggctcaaagacctcgaaatgaagtgtggggtgggggggtgatgttgtggggggtgtgttaaaactaactcctgggtttctgggctaagtaactgagttgagagacagataaatggaagattggaagtggaagaagtggaagagccaaggaggggaggcaatgatttgtgcttcagcaggtggagtttgacatgcctttgggatactgtatgagtttcctagggctgtgtgtacaaattaccattatggcttagaacaagagaaatttctcttttttctttttcttttcttttcttttttttttttgttgttgttgttgagacaggtctcactctgttgcccggtcaggaaagtggcacaatcacagctcactgcagtctcagtctcccaggctcaagatggatacatttaaggtcagatatcagctggggaaagggccacactaccttaatctggagttactcagtgccaatgtacacctatctctctcttttttctccttcctgccacctcatcccacccttctggccatgcagttaggaggaccccaactgagcatgagcgaggggatcagcaaatggaaggtgcttggtgtcagcactgcagctctgtcagaaagacgtgggagcgagtgttcttggccatagctgtggcttgccgttagcctgctgggcagccatggtgtgagttgggtctctcagggagaggacacgagtggccagaatgggcatcccagtgctaaccagtgtaagacctcaggaatatttggggccttgttggttcttccatccctccctatctatctatggctcacatactctctgcttaatgtatgcatccaacatttcttgtaagccgcttgcttcattacatgctgtctccttttttccttttttttttgagatggagtctcactctgtcgcccaggctggagtgcagtggcgcgatctcagctcactgtgagctccgcctcccaggttcatgccattctcctgcctcagcctcccgagtagctgggactacaggtgcccaccaccacacccagctaatttttttgtatttttagtagagacggggtttcaccatgttagccaggatggtctcgatctcctgacctcatgatcctcccgcctcggcctcccaaagtgctgggattacaagcgtgagtcaccgcacctggcccccttttttttttttttaaagagatggagtctcactatgttactcagactggaatggattacaaaaaggccatgtacataattttaggtggtacacatcccagatgcttcaggtacaatgatgaggcagagatgatgataattaatttgaagtgacttctttctttttctttttcttttttttgtttttttgagacagggtctctaaaaggaatagacatggcattgtgtcaataaaactttatttagagaaacagatggacataatttaccaatccctgctctgttgtagaaaactaagtaaaacaaaataacaataaaatacgatacgtacgggattttgaaatgtgtcacattctctccctgagagattcagttcacaccatggctgcccagcaggctaacagcaggatcacaccatgtcacccaggctggagtgcagtggtgcaatcatagctcactgtaggctcaatctcccaggctgaagccatcctaccacctcactctcctaagtagctgggactacaggtgtgtgccaccacgcctggctgagtttcttttattttgtaaagccgaatcaaatactcttaaaaatccaacaaatacacatttcaaaagcccatgcatatttcttattttattgttatgttttacttagtttgctacaatacagtggtggttggtaaattatgtccatctgttcctccaaataaagttttattgacacaacaccatgcccattcctttacctcctgtctgtggacacttcatggttcttatggcagagttgggtaattgcaacaaagaccaggtgggctgcaaagtttgaagaatttaccatctggctcattttttaaagttttctgactcctgtaataaagaaatgtccagtctgggcaacatggtgaaaccccatctctacaaaaaatagaaaaaaattagccaggcatggtggtgtacctgtagtcccagccactggggaggctgaagtgggaggatcgcttgagcctgagagttggaggctgcagtgagccataactactccactgcactccagcctgggtaatagagtgagaccctgtctcaaaaataaaataaaattaagtaatgtcacaagtttgggccaggcacagtgactcacacctgtaatcccagcattttggtaggccaaggcaggaggatcactcgaggccaggagttcaagaccagccttggcaacatggccagtccccatctctaccaaaaaaaaaaaaaaaaaaagctaggcatggtttcatgtgcctgtagttgcagctactggggaggctggggcaggaggatgccttgaacccaggagctgcagtgagctgtggtggtgccactgcactccagcctgggcaacagagcgagactctgtctttgaaaagaagaaatgtcacaaatttaagaacctcaggttatacacacgttacgtttactctaggtcactagatgttcaaaccaggacaaagcaatcaccccgaggacttaggggtaaagggccactgcacttaaaccatcaggctctgctctgaggagtaactgaccacactgggtatgttagtgcctttgcatgctcctgatcctgacgtgcgttctagtgagcatcacagacaatgtctccgcagggcgcagtgcagtgttgagggaagccgtgctgtctgcctgcaggtcagctttaaccgcagccatgcccctgaggttaatgtgggtttcctattctctacccaaggctacttgagtgcctgggaagcagtcattgcaaaattagccaaagtctatggttaaggaggaattgagtcctttttgttagatacatgagatttcacagtcttgtatgaaggcggactccaaggcagacagtcatcccagagtcatctcattttaatgtgttagtataatgtgctaaatatgtaatatgtgtataggcatgtctgtcctcatcaccccagcccaccctgccgcacacacacttccttgaaaccacagttgcacttagcatcaaattcggccacctgcaactgcctcagccttctgaaaagtggacttcaagaaaagtgcagcttcaagagggtggggtgagaagatgcattttcttgtcggactagtttgcagacactcttggtgactgcaaggggcatccccagtccccctcttgtggcagtactcatggcatcatctgcctgggtttgattctcagctccaccagatgtgtgatcttagacgagttccttcccctctgctggtgcctcatgcattaagaagggataaaacagaggagccacaggggtggaggtgagagttacgaaagacgatgcatatctgatgttcccagcccatggaaggcaatcatataatatcactgaactttcctcttctcagtacacaacccacctctctccgtggctcctgttgttcacctctcttcccatgctgagaccacctggctcacagaatcgttatctgcctgttgcacagctgaagttctacccttaggcaccatttctccattcatgaatttctcatgttttccagaggatggacacagtccaagactctcatgtttcattcagccaggtcaataccgaacaaccaccacagatcaggctgtctgggttctaagtctgtgttcaaaacccattcctttcacacctataatcccagcactttgggaggccaaagtgggaggattgcttgaggccaggagttccagactagcctgtgcaacatagtaagaccctgtctttacatttttttaaagttagctgggcatggtggcacatgcctgtcgtctctgctactcaggaggctaaggtgggagtatcgcttgagcccgggaggtcaaggctgcagtgagccctgatcacaccactgcactccagcttgggcaacagagcgagaccttgtctcaaaaaaaaccaaacaaacaaaaaaacaattaaaaaaaatccttatgtggaatatttgcagagctgccaaattcccctgggaggagaagaaggggttcaagtccaaacactaagccactgcaacaagttttactttctcaaagttttgtaatcaaccctaagcatttttggccattccacaaggtcaaaccaagcacatttaattctggatggagagggcagcagatgctacctagagaccccaggatggagtcctccttccgtccattaaagatttccttcagtctcagttgctggtccttgcccctctttgtaggaagacgtgctcaggtggcaggaactcactcagggaggctgaagggccagccaaccctgggtgttgaagtgcccacccccaggggcaggctggactggctgactggcagaagtgggacaggaacactgcagccccctcgccccaccaggcggccctgagagtggctgtggtggactctttctcgctgactgtgaggaaccaaccggccttgttgtgagctgccctgtggggaggcccatgtgacaaggaactacacggccttggagacagcccacaagggactgaatcctgccaggaaacacagaagctggcatcctaatgggatttctgtcttttgactttggtaggagataggatattcaagaacatctatacattcgggacatcatttcaaattggaatggttttactgacttttttttctttaagagatgaggatgggaggtgtgggaaggggtctcgccatgttgcccaggctggtcttgaactcctggcctcaagtgatcatcccacctcagcctcccaagtcactgagattagaggtgtgaaccattgcatctggctgggtttgctgacttttgattgaacaaatcattttcatcattcatgatcttaaaagcacaaataaaactttttttctaagttcaatttggctgtcaatgaagtgtatgtaatttttctaaaattctttattattattatgagactgggtctcagtctgtcgccccaggctggagtgaagtggtgcgacctcggctcactgcagcttcaacttccctggctacagagatcctcccaccttagcctcccaggtagttgggaccacaggcgtgcaccaccatgcttctgtatttttggtagagacagggttttgccatgttgcccaggctggtcttgaactccggagctcaagtgacccacccgcctcggcctcccaaagtgctgagattataggtgtgaagcaccactccagggcaatttttctaaaattcaatgaagagtcaattttgtttgtagatatgacgaaaaagtatatgtgtgtgcgtgtgtgtttatgtgtgtgtgtgtgtgtgtgtgtgtgtgtgtactttcaaagccactccaaagagagcagatttatgtaaaagtgtttgcttttaatgggccttgagcgtttgtcaactgaactcaagtacatagctaagcatcaggtctcaaaatcattacattccttttgtggatgttggaaattttccttaaaaactttttctccttttgagctgaaaagtccaaatatcaccaaataggataaggtgaactgaactgaaactctgacattcttataaagaaatgtagacaaatgtctttaggcagacagatgtctttaggcaggcaaatgtgagaacgattctcaccatgaaggcgtgtagaattatgcatgctttcttgcacatcagaaaaagcacgcgatgtgaatttacatgtaaaacaccgtacttgatgttaatttaaataaacattgaactgtctttaatagtctgtactcgtccatttatttgtggctctgttgtggtagtcattaaacatttaatagcatcaaccactcataccacaatcagcttttcatatctgtcttgtttccttttctttctacttgctgtttattccatcacaaatgccagtttcaactctgagctatatgaaaattgttacttttggcatatttactccatcagactgttatcaatgtctttttttttttttttttttttttgagacaggatcttgctctgttacccaggctggagtgcagtgacactatcacggctcactgcagcctcaaccctggaggctcaagcaatcctcccgcctcagcccccaacagcagctgggaccacaggtgcatgccaccacacctggctaatttttttgaattttagtagagatgaggtctcactatatgttgtccaaggctggtcttggactcctgagctcaagcaatcctcccacctcagcctcccaaaggcataagccactgcgcccaggtcagttgttctttttgaaatagacgtgttctgccaaatttaattgtgaattgaaaattgaatcactgtgaagcaaaccctgttttactttccattttcaccttgttctcacagttaacaactgactagttgacttttacggagaaagcatttaaaatggagtgtgatgagttaggaggttagccatggataggtccatgggagggcaatgtgctactcacttgggcaagagcttctcctgggagtttatcacaatactggcttcctattttaacagaccaggatggaaatgctcccttaagtttcaataggagaaaattgtcaggacatcctatttttcaacacaaatcgcgtatttgcctctctcagtccttatctgttgtcttcctcttccctttcttttcctccctgcgtcctgacttctgtcccaggttagtcccaaacacatcagaatccaagaggaaggacattgctcaccattctccgactaatgattccctccttgactcatccactgtgttgagaatgctccagccgggcgcggtggctcatgcctgtaatcccagcactttgggaggccaaggtgggtggatcacctgagatcaggagttcaagaccagcctggctaacatggtgaaaccctacctctactaaaaataccaaagttagccaggggtggtggcacgcatctgtaatcccagctactcaagagctgaggcaggagaatcgcttcaacctgggaggcggaggttgcagtgagccaagatcacaccactctattgccacagcctgggcaacagagcaagactccatccaaaaaaaaaaaaaaaagagagagaatgctccatggcttagttggatgctaatcaattttactgcatctattttgaaccaagtcctccataaattcaaatatggcctgggagttttctttgcttttcaggataagatacaagctctagggtcttggcactcaaagtaggagccataggtcagcagcagccatgtctccttggagaatgtaagaaatgcagagtcttgggccccacccccagaaaccctgaatcaggatttgcctttccacaagatctgcacgcgaatgcacagtaaagttgaactagtaccattctcaggcctgatgccacttcacatgtctccctatttaaaaaaatgtacaatttggtctgggtgaggtgactcaggcctgtaatttcggcactctgggaggccaaggtgaaaggatggcttgagaccaggaattcgagaccagcctgggcaacatagcaagacctcatttctacaacattttttttttaattagccagacatgatggtgtatgcctgtggtcccagctactcaggaggctgaggcgggaggactgcaccaccatgcctggctagtttttgtattttcagtagagaaggggtttcttcatgttggccaagctggtcctgaactcctgacctcaggcaatctgcccaccttggcctcccaaagtgctgggatcacaggcatgagccaccgcacctggcctgtgttcttcattaaggtctggtgacactaccttatttattggacacagaatctataccattgctcaatcaacttgcgtatgttactcataaactcctgttgaattgcacttaaatgaaaggcaaagatgctgttggtcatctggtggacccaaaagagggctgtggctggagcagctgaaatcctttctcaggaagagcagctatctgagcacagagtttaaggcacattgtgtgtctataaggactctaggagtgagcacaaaagcagggtgaggcaaggaaggaagaaagcaaattaagagcagtgccattcatgaactggccacaagattcccaagaaacccagctggttacacaggaacatatgaaaccactcctcagaaacctccctaggaaggaagggtgagcaatacatctgccagtgacttcctgcttcctctctcattggaataagtttgtctgccccactaagtgttaatcctcctccatttctcggttgttgcccagcctttcaagcagctgctagataagccagagcctcaggtggtagacttacaggaactgcagcctatggccctttgcctgttttgtaaataaagttttattggcacacagccatacccatggacttatgtattggctggtcttcctctctctctctctctctctctctctctctctctttttctttctttctttctcctgttcttgctctgtcgcccaggctggagtgtagtgaactcctgacctcaggtgatctgcccgcctcagcctcccaaagtgctaggattacaggtgtgagccactgagcccggcttttttttttttttttttttttttttttttgactgggggaggtgggggacagggtctccctatgttgccccaggctggtcttgaactcctgggctcaaacaatgctcccaccttggcctcccaaagtactgggattacagacataagccactgcacctggccatgttttgtctatatcaatttaagtatcagtaaaacccacttggaaggctcattctgaatattaaatgagataatgaatgtaatattcaaagcatagtgcctgcctacactccataaattattttattatttaaatcttatttattaggctgggcgcagtgactcacgcctgcaatccccgcactttgggaggctgaggcgggcggatcacctgaggtcaggagttcgagaccagcctggacaacttggcaaaacgccgtctgtactctaaatacaaaaaatagccaggtgtggtggcaggcgcctgtaatcccagctacttgggagcctgaggcaggagaatcacttgaacccgggaggcagaggttgcagtgagctgagatcgcaccactgcactccagcctggatgatatagtgagactccatgtcaataaataaataaacaaatcttatttattatttaaattcaaattattgtgaatggcagtctccttacttaggctgtttctgccatccatctgcccctagccacctcctctactggattctaagggatatctgagtctcaccataaaccccattcttttggttgagacatctcgatgtcaggggactcaccatgaaaaataaactgcctgggagagaaactcaggaaccgtcttccagcagttgatcaagtgcatctgatcaagtgggaatggtgggtaaatggtggattgtggaatgagagaaagccaagatgatggagcatttccagggaacagatgccccaggcagcccaaactgtgaaaatggagagcgaattcaggtgctaaactgggaaggagggaaaaacggaggaagggttcatgcaaaaacagatgtaccttcatgtactcaaagaccgattgtttctgcacacatacctcaaagttcatattcagcaccgccatccctgtatctcccatatctacgaaacttccagatgtttctgcctcccaagtgtgtgcgtgtgtatttgcttcacttttctcagatttgtagttgtactgtttcatgaaaagttttgtcaggccaggcatgatggctcatgcctgtaatcccagcactttgagaggccaaagcgggtggatcacttgaggccaggagttcaagaccagcctggccaacatgacgaaacctatctctactaaaaagacaaaaaattagctgagtgtgatggcatgtgcctgtggtcccagctgctcaggaggctgaggcatgagaatcacttgaacccaggaggcagagattgcagtgagctgagatcacgccactgcactccagcctgggcaatggagcaagactctgtctcaaaggaaaaaaaaaaaaaaagtttgtcatctcagttcacccaagctggagtttggtggtgcaatcacagctcactgcaacctcaaactcctgggctcaagtgatcctcccacctcatcctccccagtagctgcaactacaggtgcgcagcagcacgctctgctaatttgagatgtgtcgtcttcctctagggacagcaggactggccttcccttgggaccccacagaaggcaggcaggaggctccactgccagacaggaagcagagccttatttaacaacaatgagctgcaaactccaccacttcaaaagatgctgctcctagaggaagacgctagagatgggctctcactatgttgcccaggatggtctcaaactcttgggctcaagtaatcctcctgcctcagcctccttaagtgctgagattacaggtgtgagccactgggcccagcctctcataccaatttctagttccctctcactttgatgacagggttttaaatttagtcttacactcatgcttctgcacctttactctgaggctcatctttaccattgtcatctgtgccatggccctaggaatctgcattcatatccattttctcactgatgagattctgactactgagcttgagtagtgggcaccagagtcagccagagccccctggagagtactcccaggttatcacgtaggaagcagagaggcggagtgtgttttctggggcatgaaacagtgactcaaatgcagggacccctttgcctggcccactggccctcaaccttcaggcaaatgtacagacactcttcatttttatcttttaaagcactttccattacactaacctccagaagcaactctgcttaccaaggcagaaggaaagagagccactgtccaaattagatattagaattcaagcttttaaacattaatgcttggggagtagttctatggtgcttctgactgtttttacaatggagtgtgtaatccagcagagctgttaagctttctgaagatgtcagtctgttctgacttctaggaaggcagctgtggagtgaacaggctgcgtttatagacgtgccagatctggactcttttgaagtggtggagtttgcacctcattgttgttaaataaggctccgcttcctgtctggcagtggagcctcccgcctgccttctgtggggtcccaagggaaggccagtcctgctatccctagaggaagacggcacagatcatgccttccttaaaaccgcaaagctggtggggagaacaagtgaggaaagtccatgaacacaatggggacacctgcaccttggttgcttgaaaaaaacccagagaggggcccattttaccaggagagaggaggaagggtgtctcttgtgtggtcacaaagagccaatgaggtttgttgaagatgataaatatgatggagctggatttttttttcttttctttttttaaaataaaggccataatctagaaggagcacttctattttcagccttgaagaacttaaaaaaaaaaatcttagtatgcttactgtaatcattaacacaatattacttggaaacttacatgtatagaataaagcaagattttcaatgtatgagaaaacatagaaaaattaacgcagttaagaaaaatccaaataaatagaactgaaagttaaggtgcaaaatgtgtctgtgtgtacttatgctgagtacttttccctttatttttttaatgtttttaaattttaaacttaattctgtgtgtgtgtgtgtgtgtgtgtgtgtgtgtgtgtgtgtgtgtgagagagagagatagggtctcactccattgctcaggctggagtgcagtggtgtaatctctgctcactgcaacctccacttgccgggctcaagtgatcctcccacctcagcctccccagaagctagggctacaagcacgccccaccacatccagctaatttttgttttgtttcgttttttgatacaaggtctggctctatcgctcaggctggagtgcagtggcactatcttggctcactgcaaactccacctcctgggctcaagcgatcctcccacctcagcctgccgagtagcttggatcacaggcctgggccaccacaccgggctaatgtttgtatttttaatagaggtggggtttcgccatgttgcccacgctggtctccaactcttgagctcaagcgatctgcctgcctcggcctcccaaggtgctgggattacaggtgtgagctactgctctttctttaacattgatctgtttgtttcattcattaattgtaaacgaaaatcctgcctctgtgggattatatccatgaatgagagaggccataaaaaaaagcactaattggacaaccatctctacttaggaaaaaagcagttacagggatcagtcacagtttatgaacatgttctggcgccttaaaggcatcaaaatcaggatgtcagagtcccaaataggaaagatctagtccacgaggcctgtttctctagaagaccagtaaagatggcaggtttggcgctctaggtggcagagaaaccaccaggaaggcttggtgaatggggagaaaggtaaccttcccaacctttctgcttctccttccacttccctcctcctcctccctcttcctctcctctcagccctccctctctctgtcctcctcctccgcccgcccaagcatcacctcgtgaggcctcgtggcgttagcccagtgctctcggcccccaccgagcctggctctactgcaggcgctgggggttggggtgggggagaggcccagggcacatgatgccgcccccagcccgcccagcacatgacccaggcaggccggcggggtcctggcacacccgagccgcgtccgcgaacacagcccatggcctccccgcgcctagggaccttctgctgccccacgcgggacgcagccacgcagctcgtgctgagcttccagccgcgggccttccacgcgctctgcctgggcagcggcgggctccgcttggcgctgggccttctgcagctgctgcccggccgccggcccgcgggccccgggtcccccgcgacgtccccgccggcctcggtccgcatcctgcgcgctgccgctgcctgcgaccttctcggctgcctgggtaagggcgcgcgcggcccgcgggttggaatctgatcagcgcctgggtgagggcgcgtggcccgcaggttgagacccgactggtgcccggataagggcgcacggcctgtggatttggacctgttccgtgatggagtgaggacgagaggcccgcgggttggaacctgcccggtgcagggctgagggcgcgtagctggctggttgggacctgctcggtccccggctgagggcttgaggcccgcgggttgggacctgctcagtgctggggtgagggcgtgaggccctggggttgggacctgctcaatccccgggtgagagtgcgtggcccgcaggttgagaccggatcgatgcccgggtgagggcgcatggcccgcaggttggaactcgatccactcgggttggaacttgatcggtgcccgggtgatggcgcacggctagcgggttgggctggccgtcttaacacttgaaccacagagaaaagagaaagcggaggctgttccctagggaccggatgggacaactaggtaatttttttttttttttttgagacggagtcttgctctgtcgcccagactgaagtgcagtggcgcaatctcggctcactgcaacctccacctcccgggttcaagggattctcttgcctcagcctcccgagtagctgggggaggcgcgcgccaccatgcccgactaatttttgtatttttagtagagacggagtttcaccatgttggccaggctgctctcgaactcctgacctcaggtaatccacccgcctcggcctcccaaagtgctgggattacaggcgtaagccaccgcgcccggccgactaggtagttttgcaaacacatggtcggtaaaattcccatccaagggacgttgggttttaaaaaatccgtttattgtgtttgttatatggaaacttcagatggcgcagttaagcaaaacccagaccagaaaagatttcctcatttttgcccaactgcaccagggagagactaacaattaacttctctctgtctcgctctgtgtgtgtgtgtgtgtgtgtgtgtgtgtgtgtgtgtgtgcgcgtgtgtaaattcttttctattgtgcactatatattctctcgagtattttgtaagctgaaatcccttccctatccaggctttttgggtatggtttttacaccacaggtgcgcaaactgcagccctcagaccaaatcctgcccgttttctagggtccacgagctaagaatggttttacatcctactttttaaaaaattaatgattttgttttttgagacagggtctcaccctcttgcccaggttgagtgcagtgtcacaatcacagctcactgcagcctcgacctcctgggttcaagcgatcctcccacctcagctacccgagtagctgggactacagccacacgccaccatgctagggtaaatatatgtggggtctcactatgttgcccaggctggtctccaactcctgggcttaattaaaagatcaccacccttggcatcgtaaagtgttaggattacaggcgtgagccacctcacccagccctaaaatgtttttaaaaatcaaaattaaaaaatatttcctggcatgtgactattactgaaatttaaatgttaatgtctacaaataaagtttgatgggaacgcagctatgttgttcatgtgcatttgtgaattattcatggctgcctttaccctacaagggcagggtgaatattggactgagaaagtatggctcccaaagccaaaaatattaagaatgagtttgccaacatctgctttaaactattatgtgacactttatacagacctctcagctagatttggccattctgtttagctttttggaacatttccaccatgcgtaaatgcagtctataatagaaacacttacagtgaatccctgtacgtgggattcgtgaggtacgggtacccggctcatctgctcccctcttcaccctcctcactggattaatgtgaagccaatctcaggctccatcatcctgcccattcagatctcagagagagccctaaaacataataattctaaacatttgcaaccccaatatcattatcactttatttttgagacagggtctcactctgttgcccaggttggagtgtgctggcatgatcatagctcactgcagcctcgaacttctaggctcaagggatcctcctacctcagcctcctgagcagctggaactacaggcatgcatcaccacactggctaatttttgcattattttttcagagctggagtctcaccatcttgcccaggctggtcaaacttctaggctcaagcgatcctcctacttcggcctcctaaaggtgcggtggctcacgcctgtaatcctaactactcaggaggctgtggtggacggattgcttgaacccaggagttcaagactagcctgggcaacgtaacgagacccaggctctacccccaagaaaaaaaaaacaacaaaaaaaaggcccgtcatggtgggatgcacatgtggtcccagctactcaccaggctgaggcaggaggaccatttgagcccaggaattccaggctagagtgagctacgatccagcctgggtgacagccaagaccctgtctctaaaaaagtaaggtgtacccaaacatcttttgagggttagtgaataatacttgcatatcctttagcctttagaagggaagtggatgaggttgcgagcaaataagcagaagtcaggaaaaggctgggtgatcgggaccccttactgaaaaataagaaatttcaatgcccatgggatagggcttttattaagctcaaaggagtgataaatgctgaaaattctaaggcaccgtacagaagaaaggcattgtttttgttggcagtggcttgataatgagaagatgtcttgagctttttagtgttcacagttgtcgtttagtagtgtattacatagtgtgtgtttagtggtatattacatggtatgtgtttagtagtatattacgtagcatttgtttagtggtgtatcgcatggtgtgtgttgcatattatatggtgtgattttagtagtgtattgcacagtgtgtgtttagtggtgtatggcatgtttaccagtgagcactactacatagtatgtagcttggtgttgtttacagttctcccctttatattacctagcatacttttttttttctcagatggagtctcactctgtcgcccaggctggagtgcagtggtacagtcttggctcactgcaacctccacctcccaggttcaagcgattcttgtgcctcagcctcctgagcagctgggattataggtgcccaccaccgtgcctggctaatttttgtatttttagtagagatgtggtttccccatgttggctaggctggtcttaaactcctgacctcaggtgatccacccacctcagcctcccaaagtgctgggattacaggcgtgagccaccatgccaggctctttacttttcttttctttttgacacagggtctcactctgtcgcccaggctggagtacagtggtgcgatctcgactcactgcaacctccgccttccgggctcaagcgattctcccacctcagcctcctgagtagctgggaccacaggcgcgtgccaccacctccagctaattattgtatttttgtagagatggggttttgccaggctggtgtcatctcctgggctcaagtgatccgccggccttggcctcccaaagtgctgggattacaggcgtgagcaccgcgctcagaccctagtgtacttttaaacaacggatattgcattacctaacaaagaaccataatatgtaccatgagtgtgcatactgttttgaggatattagacatttgggtctaatagcaagagaaactcacaaagaataaatgttaaaggcaaattattgagaattaatttgtgaaaattttaaatgttgtgtttaaaaaagaatgaaggaactatatattcaaacttctaaattgtgctttttgaaaaattcttttttatgtgaggaataactaatatggccactgaaaatgcagccgagaaatccagattgctagtcacatattgcaagtaaaccaacagacaaacaaaatagggatgagactgtggccaactatggtttgcgttaaagtgcctgcgtttgttttgctaccataagttattttctgagtttcaggccaggcgcggtggctcacgcctgtcatcccactttgggagaccaaggcggacagatcacttgaggtcaggagtttgagaccagcctggccaacatggtgataccccgtctctactaaaaatacaaaaattagctgggcgtggttgtgggtgcctgtaatcccagccactcgggaggctgaggcaggagaattacttaaacctgggaggcggaatttgcagtgagcagggtttttaccactgtactgcagcctgggtgacagagccagactccgtctcaaaaaaaaagataaataaaaaataaaaataaaaaaaagttattttatgagtttcaatcttctttttctctctctgcacacacaaatatgtatgttttttcttcctttcttccttttccctccttgtctttttccctccctctctccctccctcctttccttccttccttcttccttcctctcttcctatctctatctattatgtatctatcatttttccaaagcaagaagtcagctttatatttgattaggatcagatacaaagtattatccaattctctcttaggtatggtgatccggtccaccgtgtggttaggattcccaaattttgttgacagcgtctcggatatgaaccacacggaaatttggcctgctgctttctgcgtggggagtgcggtgagtccaccccctctgcatgccctctcctccctacttatgctcctcaaatcgcagcagcagcaaaccctgggagtctgttagaaatgcaggttctcacgtcctgccccatcctgctgatcaggaacccagccctctctgttttaacaaaaccctccaggggatgctgcccagacactcaagtgttgtttctcccacctcttcacaaatgcatcctccgcttacatggggccacgagcaaaaccagctggcacagaaaaagttatcaatccattggatgcattttgtataaatatatacataaatatattaaataaaacatacaagccgggcacggcagcccacacctgtaatcccagcactttgggaggccaaggcaggtggatcacttgaggccaggagttccagaccaccctggtcaacagggtgaaaccccgtctctactaaaaatacaaaaattagctcggcgtggtggtgtgtgcccatggtcctagctactcaggtggctaagacaggagaattgcttcaacccgggaggcggaggttgcagtgagccaagatcgcgccactgcactccagcctgggtgacagagtgaaactccatcttcaaagaaaaaaaataaaaccacataattatatataaacaaattattgaaaaagtaaatagatatcatatatacacagacacacatacacatgtatgttatgctccatccgtcacggtggtgctcaggtgagtgatttgaagcacattccctgatgctgtgttgattgccctgtgctggagcagaattgccagtttccttgcttccctgtcctcagtggcttcctaactgcatctatggaggctctgtctcagcccgcagtggcgagacatcttgaccttgtgtcgtttctaacactggagtccccttactccatcttctctttggaaggactgcctgagtccctcctccccgtactcattcttcctcagaacaagagcttctatctagttcaaagcccccttgagcctgcacctcagtttaaatgacatatcttggaacttcatcctccctgcatacaagtggagcagaaggcatagttccttagtcaaatctgaatgcctacacctatcccaggccacaccctccttggtcccaggaactgtgcccacttgtgtcccgagagctgtcacgtgcggcttcctgacgtcagaggaagccagtgtctaccctgccgtctcaaggatgggctgggcttcttgtacctgtttccagacattttgatgcaggctcttcccgattgcagatgtggatccagctgttgtacagtgcctgcttctggtggctgttttgctatgcagtggatgcttatctggtgatccggagatcggcaggactgaggtattcaccgaggaaatgggatttctgccctagttctattttagagggaagataagagatggcactgagcgtttaaaagtattttgcagtgttgcagacaccgtcattcagaatctgtcagctggcccctccgcctagaaacatccacagcagctcatttttataagaggccaaaggcacatttaaaatattagccaggcacagtggcttgtgcctgtaatcccagctacttgggaggtaggaggattgcatgaggccaggagtttgagaccagcctgtgaaacttagtgagagtccatctccaaaataataaaagaaaatcttgaggattttaaaaaccttgaaagcaagtaattcaataaatgaaatatttggaactggacaaatactaaaacagaatgggcatgtacataaacaattttattgtttattttttactttttagaggcagggtctcgctttgacacccaggctggagtgcagtggtgagagtatggttcactgcagcctcaacctcccaggctcaagcgattcttccacctcggcctcctcagtctgtagctgggactacagacatgtgccaccaaacctggctaattttattatttttgtagagatggggtcttgctatgcagcccaggctggtctcaaactcctggcttcaagtgatcctcctgcctcggcctcccaaagtgctgggattacaggcataagccactgcataaacaattttttattatatttaaaggttcaaaggatgtatatattgacacttcatgctaaatctggaacctgagaatgccggggctggaggtggctgcttggcagggagttactcagtggctagtatctggggcactggtgtgtttgaactgatgcccagtcactcgtgagctgtgtaactgttggcgagttgtttaacttctctggacttctgttttctcagctgtgaaatggtacccaccacacaaggtcactgtgaagagtaaatgtgataacccctgtatatggttaagaacagtcctgaaacgttgccagctcttgatacctatcagctgttacagtaggtgggctgcacatgtgttgaggaaacatccacatagaaagctgaactgacacagagaagctggatgtggcatggcagggctccaaatccaggaagcatttgcccccaccaagttcatggtccacttgattcaggtcccctttgaagggagcccctccttgcctgttttttgttctggtttttgtttaaatacagctttgtaggccaggcacagtggcttacacctgtaatcccagaactttgggatgctgaagcaggaggactgcttgagcccaggagttttgagaccagcctgggcaatacagtgagacccatctctacaaaaaataaaaaaaagatagccaggcatggtggggtgcaacggtggtcccagctactcgggaggctgaggtgggaggatggcttcagcccaggaggtcaaagcacatgatcgtgtcactgtactccagcctgggcgacagagtgagaccctatctcaaaaaacaatagaaacaaacaacaacaacaacaaaaaacccagctttataaaggtcacctgtttaaagcctaaaatccagtggtttttcgtgtattcacagaattgcataaccatcaccgttatcgatgttacaccattttaatcatcccctctacatctctgtggtggttattagtcactcctcactgccccctccccacagcccccagcaaccacttatctactttctgtctctgtggagctgcatgttctggacatttcatagcaatggaatcatacagtacgtgacctttcgtgtttgggtttttaactcagtgtaacattttcacggtttatccgtgttgtcacatgtctgtgcttcattcctgttatggtctgaatgtttctgtccctccaaaaattcctgtattgaaattctaacccctaaggtgatggtattaggaggcagggcctttgggaagttattaggtcataagtgggatcagtgcccttgtaaaaggggccccagagagttccctcaccccttctaccatgtggggacacagcaagaaggtgctatctatgaaccaggaagcagggcctcaccagacatcacatctgctataccttgatcttggactcccagcctccagagctgtgagcaataattgtttataagccacctagtgtgtgatattttgttatagcagcctacatggactaaaacaaccccttttcattgctaaataatattccagtgtaaggctatactacattttgtttatccatttatcagttgatggacattttgtgtgcttccattgttttgactacttccattgtttggctactaggaataatgctgcaactgacatttgtctgcaagtgtttgtgtggacatatgttttcatcacatattcctgagtatatatctaggtgtgtaattgctgagccatgtggtaactctaggtataaccaggtaagaaactgttaaactgctttccaaggtgagtgtaccattttacattctagcagtaatgtgagggttgcagtttatccacatccttgtcaatacttgttattatctgttttaattttagccatcctagcatgtgtgaattggtagctcctcatggttttgatttcactgatgagtaatgatgctaagcatcttttcatgtgctgattggtcatgtatatatcttcttagagaaatatctattcacctcttttgcacattatttcattgggctatttggttttttattattgagttgtaggagttctttatatattctagatacaagtagcatattacatacgtgattcacaaatagtttctcccattctgtggtttgtctttacacctacttgatgatatctttcaaagcacagaagtttttcattctgatgaagtccaatttttctatttctttccttgatttcttattcttttgttgtcatatctaagaaatcattgcctaacccaaggtcacaaagatttagacctatgttttcttatggtttgaatgcttaaatttaggtccacttagaatttttgtgcacaggtgactaatgggtccatcttcattattttgcatgtggatatccagttgtcccagcaccatttattgaataaatttacttttaaagccaatatcagtaaatagagatcatatgtaggctatagaatatattgggtaatcccagtagatccccgctctaaaatcattgacattccttatgtagatcacatcatcaactttggtctctctggcctgaagtttagtgcttacttcatttttatgcttgttccttccatctttttaccttagctcccaaactcttacacatctgaaccaaactgagatatgcctggttgtgaaaattctccagggaagatagtcaaggtcagagccagccaattaggtgtatcagtgaagattcattttggctacataaaatatatataataataatgacttaaacaaggtagagatttctctttcatgctaaagatgtccagaggtaggcaatccaggacacttgtgatggacatcagggacccaggttcctttgattttcctgcgtcactatcctatcgtgtgacttccatcctcaaagtgtcatggcccaatatagctgctggtgctccagtcatcacacctacattctgggcatcaggaagtgggaagagagcaatgcaatgcaatagaggcctgtgttcccctgagccagctttaagtagtgtcttgggagtttcatacaatgccagttacatattatcggtcagaagttagttttttttttttttttttagatggagtttcactcttagtttcttttttcttttcttttttttgagatggagtttcactcttagggtgaaaaagatagagtttcactctttttgcccaggccagagtgcaatggcacgatcttggctcactgcaacctgcaccgcctgggttcaagcgattctcctgcctcagtttcccacgtagctgggattacaggtgcctgccaccatgaccagctaatttttgtatttttagtagagatggggtttcgccatgttggtcaggctggtctcgaactcctgacctcaggtgatccacccgcctcggcatcccaaagtgttgggattacaggcttgagccaccatgcctggccagaacttagtttcatgccacacttagctgctaaaggaggtaggaaatagactctgtgagccgagcatgcagctgccctcatgacatccaggttatgttactgagggaaaaaggaaatatggctttgagtaggtaatcagcagtgtgatacagccatggccctgcagctctcatgattggcatgtctctgagcatccctcagtgttggagaggtcggaggtctgacacaactgtaggtcttatagatgccagttatgggtagaagaagcgtctcagagtgctggaaggaagctgggagaaaagtaatgccctctgctgccatagaggatatattacttcacctccacccacggtggggatgtgggggaaaagggatggggtcccacagggcaatctgagaactgtctggacccagaggacagacagggccctgagaagctgggacaggcaatcatgaagccctccttaccccaaggatagtatttgggagttcatttggagctcagtgatcagaaggcaggatgttgggaccaagggtcttcagccagtggggggcgcaggcttctcctgatctgctgtggattggggttcagacttctgccccggtgtgggtttcagaggcccagcccgaagtcagggtctggaatgcagagattctgcactctcaaacacccagccctttgcagaaagcctctccgttagttatctgagtctcatacagagcttctggttcctggcccacattgctgagacatacccccaaccctcacccgctcccagcccagccaggctagggaagagccatgccaggaaccagtcacagtgtgggaggcaaaacatgctggaagtgtttcttttcctcccgaagctctttgggcttgtttctttcctcttgtctcattgtagaagggtgtcctttctcactcagatccctttgtctacacagctgatcttccaagttgaagtcccgatggggtgggggttgtgatatttgccaggaatctggtagggttttgagtgacagccatgcatcccatggagctccagccccctaccccacctcgtcccatcagacaggagaggcaaacccaagactggatggcaccagtcagctctgcagagcttccatcttcagtcttcctgcggcatctggaaggctgcggcctcaactcctgggggaaacggggtggggtgtatggaagtacaaagatgaaagctagagactgtgcaagaatgccagctgtgcagggaatggggaggcgaaaggcaagtcccccgctctcctctcgggaagcatgtagtagctgctgtttctgcagagacagccttcccaggtgggactgagcattcagacttggctattaggtgtggaggtgactctggaagggcttggggataggagctccttgcttatcgggtgagccaggtattcaggaggcataaggcctctctcgctggggggctgtgagggcccacacagctgagaaggaaccccacgttcatgtccttctgttgggaaacctcaggttcaggtttgctgcagatccacctggattcgcttccatgccagaggatcaggtaggaaaaagcaaaccagacaagcccaagcacagctcctcctccctttctgacatctccataaaaaactttgcagtcacagccattggctgatttcttctctaagctatcccctcatcttttataactgggttttttttttttttttcagattctgtttttttcaattatttttatttttatttatttatttatttttttgagacggagtcttgctctgtcgcccaggctggagtgcagtggtgtgatctcggctcactgcaacctccacctcccaggttccaggaactctcctgcctcagtctcctgagtagctgggactacaggcacctgccaccacacccagctaatttttgtatttttagtagagatggggtttcaccatgttggcctggctggtcctgatccacccgccttggcctcccaacgtgctgggattataggcatgagccactgcgcccggcctttttcaagttttaaggtttatcttgttgcaaatttttttttgaatagatgaaaagagcccttcagtaggttatcagacttacacttaaactgacatggtcctgtggcccacagaggcttctgtgacccagtcctcaacacacggcgctccctctgtcgtctctcaccctccccactccagccacgcccagctcccagcttctagaaggcgcctgtattcctttttttttctttctttcttatttttaatagctgcatctcactctgtcatctaggctggagggcagtggcatgatcacagctcactgcaaccttcaactcctgggctcaagcaatcctcccgcctcagcctcctgagtagctggggctacaggtgtgcacctccaggccaggctgcagctcacattctttgacttgtggccttttcctccatcttcaaagccagcaatggtgggttacgtccttctcaaattccctcctctctggttctctgcagctgatagtctctgcttttctggattctggcagttacattggcccaacccagataacccaggatgacttccttatctcaaacatccttaacttcatcacacctgcagagtctcttttgccatataagggaacatattcacaggttccagaaattaggacagggacatctttagggaaatgtatttgggctatcacaagtgtttatccactctaacttataaacatagtctctgccaggcatgttggctcatgcctgtaatcctagcactttgggaggctgagatgggaggattgcttgagcccgggagtttgagacaagcctgggcaacatagcaagactccatctctactaaaaataaaaataaaaaagttagctgggtgtggtggtgagtgcttgtagtcctagctacttgggagcctgaggcaggcttgagctcaggagtttgaagttactgtgagctatcattgtgccattgcatgccagtatgggtgacagagggaaaccccatctcttaaaacaacaaccaccacaaacatagtctcatcttttagattaatcacagctacgagcctgacttcatgtaaaatcttctccatccagctatggcctctggggctggcccccagcaggggcacaggctggaacattacactgattcttctatgtcatcctctcaagatggtcactcccatgcaggcagggattctgttttttgtgcctagaacaggcatgatctttgctcaataaacattcagccaatgtacactgagtgagacatactgcgctgatacaactctgtgattcttttagttgagacgtaacttaaatactgtaatatttgccctttaaacgtgtgcagttcagtggcttttagtgccatctgcaaggttatacatcagttagcctcactattactagttccagaacatttctaccatcccaaaaagaaaccctgtacccattagcagccacccccatgtctgcacaatcacacaatatgtgcaccctttgtgtctggcttttcactcagcattgttgctgaggttcacccatggagtagcatgcattagtacttcattcctttcaactcgatattaccttcgcacgtgctgacagccatcttgtaggttaagggtgtgggaagtgtttcctatcactggcccctcttctgtagagaatgtgcaccggaagggaaatcccagagtaacagcgctgatggtccagtacatgtctccacctccctgagcacaggatgctggtaaatcccattgctggggccgcctgattgtcctcaaagtgaagacagctgggcatccagggcaagcccagccttgtaggaaagtggaggtgggcggggacggccagcctgccctggagggcagcgtaagtagcagaaagcagccaggcctgacgtccacctggccccttagcgtagtggcacaggaaggccgcagagggtttccgtgttcacccagctgagaggagcaactcacggctctgagaagtgggtctggccgaggtgatgcagctagttaatgtgccagctgtttgcattcggttcaaacctgttgagcctcagagcatcctcctgggatgaggctgtaagaggagtaagtggggaggctgggaggagcacctggcgagtgctgtgcccgtgaggtgcagtcttagtccgtccaggctgctataacaaacatcacagactggcggcagcttataaatagcagaaatgtatggccgggcacggcggctcatgcctgcaatcccagtactttgggaggccaaggcaggtggatgacttgaggtcaggagtttaagaccagcctggccaacatggtgaaatgctgcctctactaaaaatacaaaaattagccaggttggtggtgggcgcctgtaatcccaactactcgggaggctgaggcaggagaattgcttgaacccgggaggtggaggttgcagtgagccgagattgcaccactgcactccagcctgggtgacagagcaagtctccatcttgaaaaaaaaaatgccatctgacccagcaactccactcccacgtatacaccccaaagaactgaaaacaggaacccagccaggtgcagtggctcatgcctgtaatcccagcactttgggaggccaaggtgaggggatcactgaggccaggagtttgaaaccagcctgggcaacatagtaagacccatctctacaaaaaaaaaaaaaattagctgggcatggtggtgcatgcctgtggtcccagctacttgggaggcttaggtgggagggttgcttacgcctaggaattggaggctgcagtgaactatgattgcatcactggactccagcctgggccacagagtgagactctatctcaaaacaaaacaggaactcaaacaaatactggtacataacacatgttcatagcagccctactcacagtagacaaacagtggaaacaacctaaatgtccattgatgggtgaatcttggcccatgtatacaatggaatggtattcagtcagaaaaagggaagaaagggccgccgctatggctcacgcctgtaatcccagcactttgggaggccgaggcagggggatcacttgaactgaggagttcaagagcagcctggcaacatggcataacctcatctccacaaaaaaatacaaagaaatagctgggcatgatggcgtgtgcctgtggtcccagctactcaggaggctgaggtgggaggattgcttgagctcaggagacagttgcagtgagccgagattgcaccactgcactgcagtctgaatgacagtgcaagaccctgacccctaacccctacaaaaagaggaaagaaagggcacagtggctcatgcctataatcccagcaatttgggaggccaaggtgggaggattgcttgagatcacgagttcaagaccagcttgggcaacatagcaagatactgcctcaacagaatattaaaagaaacaagggaatgaagaaactgatccatgctacaacgtcagtgaacctggaaagcattatgctgagtgaaggaagccaggtgcagaaggccacgtagcatatatttccatttacatgaaatatccagaacatgcaaatccacagagacagaaactagattagtggttgctaggggctgggggatgggcaaaggggagtgaccatttatattagcctcttctcacactgctatgaagaactgcctgagactaattgataaaggaaagaggtttaattgactcacagttcagcgtggctggggaggtctcaggaaacttacaatcgtggcagaaggccaaggggaagcaggacaccttcttcacaaggcagccgagcgattgggggccggagggggttggggggggagggaaatccccttataaaaccatcagctctcgtgagaactcactcactatcacgagaacagcatgggggaaaccgcccccatgattcaattacctccacctggtcatttccgtcctccaaccacctaaccaattgatttccatccaacagtgattagttcaacttgttctatcccttgggattttggagattacaattcaagatgagattcaggtggagacacaaagcctaaccatatcaccaattaatggatatggggtctccttttggaatgatgaaaacattttggaaggagacgctggtgatggctgcagagcattgtgaatgtactaaatgccactttgttgttcactttaaaatagttaattttatgtgatgtgaatttcacctcaatggaaaacaaccaaccaacctcagcagcacgaggaaactctttgccgaggggctttcctctgtgtacattttcctgacctttccagagcgcaggagctggcctggcagttccaggcaggcctctgtgccccactgagctgtggctgctgttgtgcttgtcccctagcaccatcctgctgtatcacatcatggcgtggggcctggccaccctgctctgtgtggagggagccgccatgctctactacccttccgtgtccaggtaagttgggactccagcgccccaggcagccccatccttggctcataatgtgttgtcttgcagggaatacatgagccccgacccacagagtgggtgccttggaggttaggccgttgtctcagggccacatgaggccatgctcacggcccagccccagagggctgactacaatagcttggagaatgaccctggaatcattctccctggctctgcctttctcgtttgtgtgcataggcacccatgcacacaagcatgtaggcaaagctttccgcatatttccctccacgtaaggtgtattcccagcccctgtattggtacagttttctcatgcccactcttaagtatttggtcttcaagcttcctctggatgagcaggtgagcttaacattctaggaatgagtgtaggataatgtggaagaggccataaggatccctgggcagagcttattctctagctttgcttcctacgctttctcacttctcttctatcctccacacagagggagatgtggccgctggaactgtctcaagcatttcctcaagtttacattcctgtccatgcaaccctcagttgcaaagccaaggtctttccaaggatatatactctaacttccaatggaaaactggaaaatggaagtggacagtgtctttgtctgtgatttttataccagggatcaacacagtgtagccctcaggacaaatccggcgttcttccgtttttgtaaataaagttttattggaatatagtcacactcatttctttatgtactgtctgactgcttttgcatgacaacatcagagttgagtagttgcctcagagaccacagtgtggcccatgaagctgaaaatatttactatctgttcttttacagaaaaaaaatcgacagaaaaaaattggtgtagataatttatctccctcttctcttgcttcttgcggctactcagtgaggatgtctccaaattggtgttgccttgtcaaccatgaatacaagcagggagctctgtatagatccatccatacattctgcttttctggggaactttaaaaggacagatgcactgtcagcagctgttataacggaatgcacttagttggaaagggagtttctgtgactctccctcgcctgtgggaccccggagactcctggcaaagttgcatctgagccttagggtgccattgctgcagggcgcacagggagccttgaggtgctcccagggtctttaggagctgtaccttttaagcatcttatccttaatcatctcttcattttcacaacgcctgacccagggcgctcggtgttcttcatgctcacagtctcactctcttatttgtcatttcctttctgtctttgcatcggagtcacttctctttctcctcttgtttctctttctcctttcaagcctttccagattgaattttagcctctacagctaaagataaaaccgcctgttaaaagaaagtggcagcgttgagaggtggtatagtaattcttcctatggcaagaggagacgggtattgcatttttcccacctgatttttttttttttttttttttttttttttacattttctgccactttcccctctggtttgacaactccgtcaatattaagggtgtttaatttattttttgtcattcccccttccgtggccatgaggctgtttggttagccccttttccacctccctctttggttgagctggagcagacctccctcccctttgccttcagtttcctcttcctctgtgccattttgcttctctcctacattaagcatttcgcagctgagagttgttaccttggtaacatatgtttgtgaggccctccagcacattctgtggtgaccagtgactcctatgacccctcagtagaaatctttgtccttttctctgacaagaacctctgaaactattgttatccataaccatgagaacacatttcctctgaaatatgcagctggcatattttgagttgttcaagcccagggacaagattttattcatgttattgcccaaaaccatgtagtaagtactcaaaacctcactatttaatggagtgcctttgtctctacttgaattgcgttttttccttgagacccagtgcagggaatcccccatcccagggtgtttttctttccgatcttttcccagcaggaacctttaaaagcttcctccagtggaatgccttaggggtcctcccatttctgagacagaaacatggttgatctcccttactctcctgcaatttatggcttgttccagacatgagaaatgactcacatttcctttgggcagtcagcagcagatttatgcatttccctttttgttctcatcctcttatcttgacttccagataagtagatgtcttttagccaaaactttgcttttgagaagaatgactttggttttcctctctcaggtgtgagcggggcctggaccacgccatcccccactatgtcaccatgtacctgcccctgctgctggttctcgtggcgaaccccatcctgttccaaaagacagtgactgcaggtaaatactagggaagctctctgggtacacggccactgggagcggccccatgcctcgggctcagacagtgacacatgttgtcctggaattctccaggacagttgacctcatttgtcatcctccagagacatcagcagaacacagctgcagaaagtaagcaggttcaataaatgaaaatgtgcaggcctctgcccgcacaagttctgtaccatcgtttgttagctcagtgccaggactagttgacttttcacttctgtactgggcttctcctgggtcggctgcaggagtgcccttggacgactgtggaggtgtgagaggaacagaaggagaagagaagggagggggaagggactgagtctgtactgaggcggctccagccccataatgcacttggctgatgttttttctcagatgggcaggaaacaggaagtggagcacaggaaatgagtcaaggtcaatggttagaaaaggataagagtaatgaagtcgttggcaacatgtctgggaaagacttctaggctggggctggagacctgcagtccagcccctactttcccctcaaggaagtgtgtcctggagtgagcctcccacctcctcaggctgccagagatctctcaaggggagaatgggaataaggaaatttgccttaactgagaggtcctttgaagatcacctgttgattgttgaactttttaaaaacattgttgagagtactctatcattggtaataggaaattattgtgattcttcggaccattctcttcatatctacactttttgttttcattgagacggagtctcgctctgtcaccccaggctggagtgcagtggcgtgatctcggctcactgcaacctctgctgcccatgttcaagtgattctcctgcctcagcctcctgagtagctgggactacaggcaagcgccaccacgcccggctacttttttttgtatttttagtagagacggggtttcactatgttggccaggctggtcttaaactcctgacctcgggtgatccacccaccttggcctcccaaagtgccgggattacaggcgtgagccaccacgcctggcgcatatctacatttaaatatagtgtgttaaatatagcattttaagacaaaatctcatcaaaaatagtgatttgagctgatggaaatgacttatagaaaaaagactgaaaagaaatacactaagatgttaacagtggttacctctgggtggacggaccatgggtcattcatacttctctaaacttttaaatattttctaacttgtctataagaagaaattaaatttttttcaatattttaacaagcgtgcactatttttatttttttgagatggggtttcgctcttttgcccaggctggagtgaattgacgtgatctcggctcactgaaacctccgcctcccaggttcaagcgattctcctgcctcagcctcccgagtagctgggattataggcatctgccaccacagccagctaatttttgcatttttagtagagatggggtttcaccatgttggccaggctggcctcgaactcctgacctcaggtgatccacctgcctcagcctcccaaagtgctaagattacagttgtgagccactgcacctctatttttataacagagaaaatgagcttttaaaaatatagtttctgaactaggagcattcaaataaaattgggaatttatttatttagttattttgagacggagtcttgctctgtcacccaggctggagtgcagtgatcttgcctcactgcaatctctgcctcctgagtccaagggattctcgtgcaccagcctcccggatagctgggattacagacgtgcaccaccatgcctggataatttttgtatttttagtaaagacagagtttcaccatgttggccaggctggtctcgaactcctgacctcaaatgatccacccaccttggcctcccaagtgctgagattacaggtgtgagccactgcacccagccaaaattgggagttaacatagtaatgtacctgtgttaatttcatagttgtgaagaacatccccatggttgcataagatgcttacattgaggggaatctgggtaaagggtagggatatacagggactctctgtgctatcttttatctttgcaacttttatgtaaatctaaaattatttcaaagcagaagtttaaaaatatgtatattccttagggtctatgaggactccaacctggaagttgtgaggaatgaatgtcagtgacttgctttgcttcctgcccctctggccttgcttgtgggctcacacctgcttccattgccttctctgtcactccgtaaacatgaataatgaacaccatacatagttccttctgttcttcacagtggcctctttacttaaaggaagacaaggcatttacacggagaacgagaggaggatgggagccgtgatcaagatccgatttttcaaaatcatgctggttttaattatttggtaacctttcttctatatatgtgtatttttattgccagtgggaagggctatggaaacaacttgccatgttgcatgcgtgaccagaagttccaaagggaagagcctttgggaaggaaatctttgagactgtgctaggtgccctttgaggaaaggcacagaggacaggggagcaagtccaaaattcatgaatttctggaaaaacattcaaatctactcaaattatatataaagcccttagaaaacgaacacccaagtttagttttgaaatgtcccaaccatgtgcattgctggggttaaccaaaacaaaggggttgcgtatgctttttttttttttttttttttttttgagacagggtctttctctgtcacccaggctggagtgctggagtgcagtggctcaatcacagctcactgcaaccttgatctttagggctcaagtgatcttctcacctcagcctcccaagtagtcttactctgtcacccaggctggagtgcaatggcacgatctcagctcgctgcaacctccgcctctcaggttcaagtgattcttctgcctcagcctcccgagtagctgggattacaggtgtgtgccaccacactcagctcatttttgtatttttagtagagttgaggtttcaccatgttggccaggctggtctcaaactcctgacctcaagtgatccacccgtctaggcctcccaaagtactgggattacaggcgtgagccaccacactcagctggtcatgctttataaactcacccatttgcctcactcctgacaccagaattcctgtgcctgacagaggggcaagggcacgtctttggtcaagaaggttggagaacggcctgagcagtttgtctctcctcatttttccccaccactggtatcctgtccaaacctttcaggtggatactttgaaaacagacctgtaaccaatgcaaaaaataaaactggaatcagaacatgctgcactgtggtgaatcagtaccttgcaggcagggcaagtacttatgatgttaaaaattcacctgcgcgggtcgtggtagctcacactttggtagttggaggcaggagtattccttgaggtcaggagttcaaaaccatcctgggcgatacaacaacaacaattagccaggaatggtggcacatgcctatagtcccagctactcgggaggctgaggcaggaggatcacttgagcctaggagttcgaggctacagtgagctatgatcatgccactgctctccagcctgtgtgacagagcgagaccttgtctctaaaacataatagtaataataattcacctgatatgagctttgtttggacacctttcttggagatacataaatcatctcctactaaaaatacactcagttcaacatttcatatttcactgagccacctaaaataacattgaaaaatactattataaaatggcaagaaaaaattgttttgatctccatgaaaactgtacgttgctcttcaaacaaaaaatgaattctgggttatttgatacagtgctagaaccttacaccctgatgtggtgttgagtggtaccattggaaggatttgctgatctgtgctttagactgagaaaacgaattatgttttttaaattaaattcttagtgtgctggttcctcttagtctcatttcttttctttttctttctgagacagggtctcactttgtcccccaggctggagtgcagtggcacattcatagctcactgcaggctcgatttcctgggctcaagcgatcctcccaccccagcctcccaattagctgggactacaggtgcacaccaccacacctggttaatttttttattttttatttttagtagagacaaatttcactgtgttgcccaggctggtctcagactcctgggctcaagcaatcctcctgcctcagcctcccaaagtgctgggattacaggagggagccattgcacctggccctcttagtttcttactgcagaagtggccatgtctataccgggagttggtacttttaggtcttggtagaaattcttctctgactctccagcatttaaaaacgagtttcattgcatgttctctttacctgctgccattttctttctaacagttggttgtcgaatatcatcaatgaaagccttttattctatcttgagatgcaaacagatatcaatggaggttctttgaaacctgtcagaactgcagccaagaccacatggtttattatggtaggtcaatctatattttattttaattagttaattatttaattaatttgcttcagagacaaggtctcactctgtcacccaggctggaaagcggtggcatgatcatagctcactgcagccttaaactcctgggctcaagcaatcctctgtcttggcctcctgagtaactgggactacaggtgtatgcctccaccctgggcaatgtagggagaccccatctctttttttaattatctatatttaacactttctgcttgaaaaaaaatcagaagaaaaagaagcagtcagaagtacaatatattatatttaaatacaggatgagcaaaataggctcctggccttagtgtgctagctggctgttttgtttgttgtcgggatccttattaaatgcttcaactctggtcaaacagtttggtgcagtgtatcaaagctcctggcagtctcacaatatcagagcatggatcttgaaggaatgcttcagaccatgaaaaagccacacagatgaagatattcctggtagcattatccttcataattgtaaagcattataggcaacctggagttccaaaaaaaaaaaaaaaaaagaaagaaagaaatgtttaagtaaattatggtctttcatcttgatggactattactcagatgttaaaaatgatgattatgaaatctctggtattaactgggaaatcaaatatatacaattataccaattacaagtacagaaaaacatgtttatcttttttcaacggggaaacaatgaaaaaacacaagaaatgaaacagaaaaaaaattcatgtattggatggacatacatgaagagaatgatggggtagaagccccatgggcaagttgccccagtgctgccattctctcacctttataagaagaaatgcacacgtgttgttggcagggaggtgcatattgtactatacagaatccatatttatattgcttttgaaatggggaaagtctcatttacaaagactttcaaatggagccagcaccggtccttccatccctgcacgtggtttggagcttggctgggttcctctggtgaactttatgtgtccttagcacacaagagtggagggatgtttcccagactccgtctgagcctcaggaacctttattacatcaagtgctcccttggcagcacagggtggcaaactggggagaacagaggcccccaggctgcaggaggagctggctgttcagtccctgtgctacagcgctccctctccccttctcccactgctgccctcttctcctcccccaccctctcctcccactttctccttctcctgtcttccctcctctctcttgtcctctgtcccctttcttcccttctctactccagctcctccccgtcccctcctctccccactcccctctgctttcaggcacccttgaaggtacagcacctactgtggccaatcttcatcttgccccaaaccaacccaccaaccagtcaaccagccaccagccaacccatggtcccttccaagcgagtccagccctgtgggcatcctggggggagtgtgtcactctgtgacagcccagggctctgacttctgctacgctgcactgactgccatgtgtctttctgtcctctctccagggaatcctgaatccagcccagggatttctcttgtctttggccttctacggctggacaggatgcagcctgggttttcagtctcccaggaaggagatccagtgggaatcactgaccacctcggctgctgagggggctcacccatccccactgatgccccatgaaaaccc

SEQ ID NO: 4230 - DNA, 22624 bp, human
taaagatggcaggtttggcgctctaggtggcagagaaaccaccaggaaggcttggtgaatggggagaaaggtaaccttcccaacctttctgcttctccttccacttccctcctcctcctccctcttcctctcctctcagccctccctctctctgtcctcctcctccgcccgcccaagcatcacctcgtgaggcctcgtggcgttagcccagtgctctcggcccccaccgagcctggctctactgcaggcgctgggggttggggtgggggagaggcccagggcacatgatgccgcccccagcccgcccagcacatgacccaggcaggccggcggggtcctggcacacccgagccgcgtccgcgaacacagcccatggcctccccgcgcctagggaccttctgctgccccacgcgggacgcagccacgcagctcgtgctgagcttccagccgcgggccttccacgcgctctgcctgggcagcggcgggctccgcttggcgctgggccttctgcagctgctgcccggccgccggcccgcgggccccgggtcccccgcgacgtccccgccggcctcggtccgcatcctgcgcgctgccgctgcctgcgaccttctcggctgcctgggtaagggcgcgcgcggcccgcgggttggaatctgatcagcgcctgggtgagggcgcgtggcccgcaggttgagacccgactggtgcccggataagggcgcacggcctgtggatttggacctgttccgtgatggagtgaggacgagaggcccgcgggttggaacctgcccggtgcagggctgagggcgcgtagctggctggttgggacctgctcggtccccggctgagggcttgaggcccgcgggttgggacctgctcagtgctggggtgagggcgtgaggccctggggttgggacctgctcaatccccgggtgagagtgcgtggcccgcaggttgagaccggatcgatgcccgggtgagggcgcatggcccgcaggttggaactcgatccactcgggttggaacttgatcggtgcccgggtgatggcgcacggctagcgggttgggctggccgtcttaacacttgaaccacagagaaaagagaaagcggaggctgttccctagggaccggatgggacaactaggtaatttttttttttttttttgagacggagtcttgctctgtcgcccagactgaagtgcagtggcgcaatctcggctcactgcaacctccacctcccgggttcaagggattctcttgcctcagcctcccgagtagctgggggaggcgcgcgccaccatgcccgactaatttttgtatttttagtagagacggagtttcaccatgttggccaggctgctctcgaactcctgacctcaggtaatccacccgcctcggcctcccaaagtgctgggattacaggcgtaagccaccgcgcccggccgactaggtagttttgcaaacacatggtcggtaaaattcccatccaagggacgttgggttttaaaaaatccgtttattgtgtttgttatatggaaacttcagatggcgcagttaagcaaaacccagaccagaaaagatttcctcatttttgcccaactgcaccagggagagactaacaattaacttctctctgtctcgctctgtgtgtgtgtgtgtgtgtgtgtgtgtgtgtgtgtgtgtgcgcgtgtgtaaattcttttctattgtgcactatatattctctcgagtattttgtaagctgaaatcccttccctatccaggctttttgggtatggtttttacaccacaggtgcgcaaactgcagccctcagaccaaatcctgcccgttttctagggtccacgagctaagaatggttttacatcctactttttaaaaaattaatgattttgttttttgagacagggtctcaccctcttgcccaggttgagtgcagtgtcacaatcacagctcactgcagcctcgacctcctgggttcaagcgatcctcccacctcagctacccgagtagctgggactacagccacacgccaccatgctagggtaaatatatgtggggtctcactatgttgcccaggctggtctccaactcctgggcttaattaaaagatcaccacccttggcatcgtaaagtgttaggattacaggcgtgagccacctcacccagccctaaaatgtttttaaaaatcaaaattaaaaaatatttcctggcatgtgactattactgaaatttaaatgttaatgtctacaaataaagtttgatgggaacgcagctatgttgttcatgtgcatttgtgaattattcatggctgcctttaccctacaagggcagggtgaatattggactgagaaagtatggctcccaaagccaaaaatattaagaatgagtttgccaacatctgctttaaactattatgtgacactttatacagacctctcagctagatttggccattctgtttagctttttggaacatttccaccatgcgtaaatgcagtctataatagaaacacttacagtgaatccctgtacgtgggattcgtgaggtacgggtacccggctcatctgctcccctcttcaccctcctcactggattaatgtgaagccaatctcaggctccatcatcctgcccattcagatctcagagagagccctaaaacataataattctaaacatttgcaaccccaatatcattatcactttatttttgagacagggtctcactctgttgcccaggttggagtgtgctggcatgatcatagctcactgcagcctcgaacttctaggctcaagggatcctcctacctcagcctcctgagcagctggaactacaggcatgcatcaccacactggctaatttttgcattattttttcagagctggagtctcaccatcttgcccaggctggtcaaacttctaggctcaagcgatcctcctacttcggcctcctaaaggtgcggtggctcacgcctgtaatcctaactactcaggaggctgtggtggacggattgcttgaacccaggagttcaagactagcctgggcaacgtaacgagacccaggctctacccccaagaaaaaaaaaacaacaaaaaaaaggcccgtcatggtgggatgcacatgtggtcccagctactcaccaggctgaggcaggaggaccatttgagcccaggaattccaggctagagtgagctacgatccagcctgggtgacagccaagaccctgtctctaaaaaagtaaggtgtacccaaacatcttttgagggttagtgaataatacttgcatatcctttagcctttagaagggaagtggatgaggttgcgagcaaataagcagaagtcaggaaaaggctgggtgatcgggaccccttactgaaaaataagaaatttcaatgcccatgggatagggcttttattaagctcaaaggagtgataaatgctgaaaattctaaggcaccgtacagaagaaaggcattgtttttgttggcagtggcttgataatgagaagatgtcttgagctttttagtgttcacagttgtcgtttagtagtgtattacatagtgtgtgtttagtggtatattacatggtatgtgtttagtagtatattacgtagcatttgtttagtggtgtatcgcatggtgtgtgttgcatattatatggtgtgattttagtagtgtattgcacagtgtgtgtttagtggtgtatggcatgtttaccagtgagcactactacatagtatgtagcttggtgttgtttacagttctcccctttatattacctagcatacttttttttttctcagatggagtctcactctgtcgcccaggctggagtgcagtggtacagtcttggctcactgcaacctccacctcccaggttcaagcgattcttgtgcctcagcctcctgagcagctgggattataggtgcccaccaccgtgcctggctaatttttgtatttttagtagagatgtggtttccccatgttggctaggctggtcttaaactcctgacctcaggtgatccacccacctcagcctcccaaagtgctgggattacaggcgtgagccaccatgccaggctctttacttttcttttctttttgacacagggtctcactctgtcgcccaggctggagtacagtggtgcgatctcgactcactgcaacctccgccttccgggctcaagcgattctcccacctcagcctcctgagtagctgggaccacaggcgcgtgccaccacctccagctaattattgtatttttgtagagatggggttttgccaggctggtgtcatctcctgggctcaagtgatccgccggccttggcctcccaaagtgctgggattacaggcgtgagcaccgcgctcagaccctagtgtacttttaaacaacggatattgcattacctaacaaagaaccataatatgtaccatgagtgtgcatactgttttgaggatattagacatttgggtctaatagcaagagaaactcacaaagaataaatgttaaaggcaaattattgagaattaatttgtgaaaattttaaatgttgtgtttaaaaaagaatgaaggaactatatattcaaacttctaaattgtgctttttgaaaaattcttttttatgtgaggaataactaatatggccactgaaaatgcagccgagaaatccagattgctagtcacatattgcaagtaaaccaacagacaaacaaaatagggatgagactgtggccaactatggtttgcgttaaagtgcctgcgtttgttttgctaccataagttattttctgagtttcaggccaggcgcggtggctcacgcctgtcatcccactttgggagaccaaggcggacagatcacttgaggtcaggagtttgagaccagcctggccaacatggtgataccccgtctctactaaaaatacaaaaattagctgggcgtggttgtgggtgcctgtaatcccagccactcgggaggctgaggcaggagaattacttaaacctgggaggcggaatttgcagtgagcagggtttttaccactgtactgcagcctgggtgacagagccagactccgtctcaaaaaaaaagataaataaaaaataaaaataaaaaaaagttattttatgagtttcaatcttctttttctctctctgcacacacaaatatgtatgttttttcttcctttcttccttttccctccttgtctttttccctccctctctccctccctcctttccttccttccttcttccttcctctcttcctatctctatctattatgtatctatcatttttccaaagcaagaagtcagctttatatttgattaggatcagatacaaagtattatccaattctctcttaggtatggtgatccggtccaccgtgtggttaggattcccaaattttgttgacagcgtctcggatatgaaccacacggaaatttggcctgctgctttctgcgtggggagtgcggtgagtccaccccctctgcatgccctctcctccctacttatgctcctcaaatcgcagcagcagcaaaccctgggagtctgttagaaatgcaggttctcacgtcctgccccatcctgctgatcaggaacccagccctctctgttttaacaaaaccctccaggggatgctgcccagacactcaagtgttgtttctcccacctcttcacaaatgcatcctccgcttacatggggccacgagcaaaaccagctggcacagaaaaagttatcaatccattggatgcattttgtataaatatatacataaatatattaaataaaacatacaagccgggcacggcagcccacacctgtaatcccagcactttgggaggccaaggcaggtggatcacttgaggccaggagttccagaccaccctggtcaacagggtgaaaccccgtctctactaaaaatacaaaaattagctcggcgtggtggtgtgtgcccatggtcctagctactcaggtggctaagacaggagaattgcttcaacccgggaggcggaggttgcagtgagccaagatcgcgccactgcactccagcctgggtgacagagtgaaactccatcttcaaagaaaaaaaataaaaccacataattatatataaacaaattattgaaaaagtaaatagatatcatatatacacagacacacatacacatgtatgttatgctccatccgtcacggtggtgctcaggtgagtgatttgaagcacattccctgatgctgtgttgattgccctgtgctggagcagaattgccagtttccttgcttccctgtcctcagtggcttcctaactgcatctatggaggctctgtctcagcccgcagtggcgagacatcttgaccttgtgtcgtttctaacactggagtccccttactccatcttctctttggaaggactgcctgagtccctcctccccgtactcattcttcctcagaacaagagcttctatctagttcaaagcccccttgagcctgcacctcagtttaaatgacatatcttggaacttcatcctccctgcatacaagtggagcagaaggcatagttccttagtcaaatctgaatgcctacacctatcccaggccacaccctccttggtcccaggaactgtgcccacttgtgtcccgagagctgtcacgtgcggcttcctgacgtcagaggaagccagtgtctaccctgccgtctcaaggatgggctgggcttcttgtacctgtttccagacattttgatgcaggctcttcccgattgcagatgtggatccagctgttgtacagtgcctgcttctggtggctgttttgctatgcagtggatgcttatctggtgatccggagatcggcaggactgaggtattcaccgaggaaatgggatttctgccctagttctattttagagggaagataagagatggcactgagcgtttaaaagtattttgcagtgttgcagacaccgtcattcagaatctgtcagctggcccctccgcctagaaacatccacagcagctcatttttataagaggccaaaggcacatttaaaatattagccaggcacagtggcttgtgcctgtaatcccagctacttgggaggtaggaggattgcatgaggccaggagtttgagaccagcctgtgaaacttagtgagagtccatctccaaaataataaaagaaaatcttgaggattttaaaaaccttgaaagcaagtaattcaataaatgaaatatttggaactggacaaatactaaaacagaatgggcatgtacataaacaattttattgtttattttttactttttagaggcagggtctcgctttgacacccaggctggagtgcagtggtgagagtatggttcactgcagcctcaacctcccaggctcaagcgattcttccacctcggcctcctcagtctgtagctgggactacagacatgtgccaccaaacctggctaattttattatttttgtagagatggggtcttgctatgcagcccaggctggtctcaaactcctggcttcaagtgatcctcctgcctcggcctcccaaagtgctgggattacaggcataagccactgcataaacaattttttattatatttaaaggttcaaaggatgtatatattgacacttcatgctaaatctggaacctgagaatgccggggctggaggtggctgcttggcagggagttactcagtggctagtatctggggcactggtgtgtttgaactgatgcccagtcactcgtgagctgtgtaactgttggcgagttgtttaacttctctggacttctgttttctcagctgtgaaatggtacccaccacacaaggtcactgtgaagagtaaatgtgataacccctgtatatggttaagaacagtcctgaaacgttgccagctcttgatacctatcagctgttacagtaggtgggctgcacatgtgttgaggaaacatccacatagaaagctgaactgacacagagaagctggatgtggcatggcagggctccaaatccaggaagcatttgcccccaccaagttcatggtccacttgattcaggtcccctttgaagggagcccctccttgcctgttttttgttctggtttttgtttaaatacagctttgtaggccaggcacagtggcttacacctgtaatcccagaactttgggatgctgaagcaggaggactgcttgagcccaggagttttgagaccagcctgggcaatacagtgagacccatctctacaaaaaataaaaaaaagatagccaggcatggtggggtgcaacggtggtcccagctactcgggaggctgaggtgggaggatggcttcagcccaggaggtcaaagcacatgatcgtgtcactgtactccagcctgggcgacagagtgagaccctatctcaaaaaacaatagaaacaaacaacaacaacaacaaaaaacccagctttataaaggtcacctgtttaaagcctaaaatccagtggtttttcgtgtattcacagaattgcataaccatcaccgttatcgatgttacaccattttaatcatcccctctacatctctgtggtggttattagtcactcctcactgccccctccccacagcccccagcaaccacttatctactttctgtctctgtggagctgcatgttctggacatttcatagcaatggaatcatacagtacgtgacctttcgtgtttgggtttttaactcagtgtaacattttcacggtttatccgtgttgtcacatgtctgtgcttcattcctgttatggtctgaatgtttctgtccctccaaaaattcctgtattgaaattctaacccctaaggtgatggtattaggaggcagggcctttgggaagttattaggtcataagtgggatcagtgcccttgtaaaaggggccccagagagttccctcaccccttctaccatgtggggacacagcaagaaggtgctatctatgaaccaggaagcagggcctcaccagacatcacatctgctataccttgatcttggactcccagcctccagagctgtgagcaataattgtttataagccacctagtgtgtgatattttgttatagcagcctacatggactaaaacaaccccttttcattgctaaataatattccagtgtaaggctatactacattttgtttatccatttatcagttgatggacattttgtgtgcttccattgttttgactacttccattgtttggctactaggaataatgctgcaactgacatttgtctgcaagtgtttgtgtggacatatgttttcatcacatattcctgagtatatatctaggtgtgtaattgctgagccatgtggtaactctaggtataaccaggtaagaaactgttaaactgctttccaaggtgagtgtaccattttacattctagcagtaatgtgagggttgcagtttatccacatccttgtcaatacttgttattatctgttttaattttagccatcctagcatgtgtgaattggtagctcctcatggttttgatttcactgatgagtaatgatgctaagcatcttttcatgtgctgattggtcatgtatatatcttcttagagaaatatctattcacctcttttgcacattatttcattgggctatttggttttttattattgagttgtaggagttctttatatattctagatacaagtagcatattacatacgtgattcacaaatagtttctcccattctgtggtttgtctttacacctacttgatgatatctttcaaagcacagaagtttttcattctgatgaagtccaatttttctatttctttccttgatttcttattcttttgttgtcatatctaagaaatcattgcctaacccaaggtcacaaagatttagacctatgttttcttatggtttgaatgcttaaatttaggtccacttagaatttttgtgcacaggtgactaatgggtccatcttcattattttgcatgtggatatccagttgtcccagcaccatttattgaataaatttacttttaaagccaatatcagtaaatagagatcatatgtaggctatagaatatattgggtaatcccagtagatccccgctctaaaatcattgacattccttatgtagatcacatcatcaactttggtctctctggcctgaagtttagtgcttacttcatttttatgcttgttccttccatctttttaccttagctcccaaactcttacacatctgaaccaaactgagatatgcctggttgtgaaaattctccagggaagatagtcaaggtcagagccagccaattaggtgtatcagtgaagattcattttggctacataaaatatatataataataatgacttaaacaaggtagagatttctctttcatgctaaagatgtccagaggtaggcaatccaggacacttgtgatggacatcagggacccaggttcctttgattttcctgcgtcactatcctatcgtgtgacttccatcctcaaagtgtcatggcccaatatagctgctggtgctccagtcatcacacctacattctgggcatcaggaagtgggaagagagcaatgcaatgcaatagaggcctgtgttcccctgagccagctttaagtagtgtcttgggagtttcatacaatgccagttacatattatcggtcagaagttagttttttttttttttttttagatggagtttcactcttagtttcttttttcttttcttttttttgagatggagtttcactcttagggtgaaaaagatagagtttcactctttttgcccaggccagagtgcaatggcacgatcttggctcactgcaacctgcaccgcctgggttcaagcgattctcctgcctcagtttcccacgtagctgggattacaggtgcctgccaccatgaccagctaatttttgtatttttagtagagatggggtttcgccatgttggtcaggctggtctcgaactcctgacctcaggtgatccacccgcctcggcatcccaaagtgttgggattacaggcttgagccaccatgcctggccagaacttagtttcatgccacacttagctgctaaaggaggtaggaaatagactctgtgagccgagcatgcagctgccctcatgacatccaggttatgttactgagggaaaaaggaaatatggctttgagtaggtaatcagcagtgtgatacagccatggccctgcagctctcatgattggcatgtctctgagcatccctcagtgttggagaggtcggaggtctgacacaactgtaggtcttatagatgccagttatgggtagaagaagcgtctcagagtgctggaaggaagctgggagaaaagtaatgccctctgctgccatagaggatatattacttcacctccacccacggtggggatgtgggggaaaagggatggggtcccacagggcaatctgagaactgtctggacccagaggacagacagggccctgagaagctgggacaggcaatcatgaagccctccttaccccaaggatagtatttgggagttcatttggagctcagtgatcagaaggcaggatgttgggaccaagggtcttcagccagtggggggcgcaggcttctcctgatctgctgtggattggggttcagacttctgccccggtgtgggtttcagaggcccagcccgaagtcagggtctggaatgcagagattctgcactctcaaacacccagccctttgcagaaagcctctccgttagttatctgagtctcatacagagcttctggttcctggcccacattgctgagacatacccccaaccctcacccgctcccagcccagccaggctagggaagagccatgccaggaaccagtcacagtgtgggaggcaaaacatgctggaagtgtttcttttcctcccgaagctctttgggcttgtttctttcctcttgtctcattgtagaagggtgtcctttctcactcagatccctttgtctacacagctgatcttccaagttgaagtcccgatggggtgggggttgtgatatttgccaggaatctggtagggttttgagtgacagccatgcatcccatggagctccagccccctaccccacctcgtcccatcagacaggagaggcaaacccaagactggatggcaccagtcagctctgcagagcttccatcttcagtcttcctgcggcatctggaaggctgcggcctcaactcctgggggaaacggggtggggtgtatggaagtacaaagatgaaagctagagactgtgcaagaatgccagctgtgcagggaatggggaggcgaaaggcaagtcccccgctctcctctcgggaagcatgtagtagctgctgtttctgcagagacagccttcccaggtgggactgagcattcagacttggctattaggtgtggaggtgactctggaagggcttggggataggagctccttgcttatcgggtgagccaggtattcaggaggcataaggcctctctcgctggggggctgtgagggcccacacagctgagaaggaaccccacgttcatgtccttctgttgggaaacctcaggttcaggtttgctgcagatccacctggattcgcttccatgccagaggatcaggtaggaaaaagcaaaccagacaagcccaagcacagctcctcctccctttctgacatctccataaaaaactttgcagtcacagccattggctgatttcttctctaagctatcccctcatcttttataactgggttttttttttttttttcagattctgtttttttcaattatttttatttttatttatttatttatttttttgagacggagtcttgctctgtcgcccaggctggagtgcagtggtgtgatctcggctcactgcaacctccacctcccaggttccaggaactctcctgcctcagtctcctgagtagctgggactacaggcacctgccaccacacccagctaatttttgtatttttagtagagatggggtttcaccatgttggcctggctggtcctgatccacccgccttggcctcccaacgtgctgggattataggcatgagccactgcgcccggcctttttcaagttttaaggtttatcttgttgcaaatttttttttgaatagatgaaaagagcccttcagtaggttatcagacttacacttaaactgacatggtcctgtggcccacagaggcttctgtgacccagtcctcaacacacggcgctccctctgtcgtctctcaccctccccactccagccacgcccagctcccagcttctagaaggcgcctgtattcctttttttttctttctttcttatttttaatagctgcatctcactctgtcatctaggctggagggcagtggcatgatcacagctcactgcaaccttcaactcctgggctcaagcaatcctcccgcctcagcctcctgagtagctggggctacaggtgtgcacctccaggccaggctgcagctcacattctttgacttgtggccttttcctccatcttcaaagccagcaatggtgggttacgtccttctcaaattccctcctctctggttctctgcagctgatagtctctgcttttctggattctggcagttacattggcccaacccagataacccaggatgacttccttatctcaaacatccttaacttcatcacacctgcagagtctcttttgccatataagggaacatattcacaggttccagaaattaggacagggacatctttagggaaatgtatttgggctatcacaagtgtttatccactctaacttataaacatagtctctgccaggcatgttggctcatgcctgtaatcctagcactttgggaggctgagatgggaggattgcttgagcccgggagtttgagacaagcctgggcaacatagcaagactccatctctactaaaaataaaaataaaaaagttagctgggtgtggtggtgagtgcttgtagtcctagctacttgggagcctgaggcaggcttgagctcaggagtttgaagttactgtgagctatcattgtgccattgcatgccagtatgggtgacagagggaaaccccatctcttaaaacaacaaccaccacaaacatagtctcatcttttagattaatcacagctacgagcctgacttcatgtaaaatcttctccatccagctatggcctctggggctggcccccagcaggggcacaggctggaacattacactgattcttctatgtcatcctctcaagatggtcactcccatgcaggcagggattctgttttttgtgcctagaacaggcatgatctttgctcaataaacattcagccaatgtacactgagtgagacatactgcgctgatacaactctgtgattcttttagttgagacgtaacttaaatactgtaatatttgccctttaaacgtgtgcagttcagtggcttttagtgccatctgcaaggttatacatcagttagcctcactattactagttccagaacatttctaccatcccaaaaagaaaccctgtacccattagcagccacccccatgtctgcacaatcacacaatatgtgcaccctttgtgtctggcttttcactcagcattgttgctgaggttcacccatggagtagcatgcattagtacttcattcctttcaactcgatattaccttcgcacgtgctgacagccatcttgtaggttaagggtgtgggaagtgtttcctatcactggcccctcttctgtagagaatgtgcaccggaagggaaatcccagagtaacagcgctgatggtccagtacatgtctccacctccctgagcacaggatgctggtaaatcccattgctggggccgcctgattgtcctcaaagtgaagacagctgggcatccagggcaagcccagccttgtaggaaagtggaggtgggcggggacggccagcctgccctggagggcagcgtaagtagcagaaagcagccaggcctgacgtccacctggccccttagcgtagtggcacaggaaggccgcagagggtttccgtgttcacccagctgagaggagcaactcacggctctgagaagtgggtctggccgaggtgatgcagctagttaatgtgccagctgtttgcattcggttcaaacctgttgagcctcagagcatcctcctgggatgaggctgtaagaggagtaagtggggaggctgggaggagcacctggcgagtgctgtgcccgtgaggtgcagtcttagtccgtccaggctgctataacaaacatcacagactggcggcagcttataaatagcagaaatgtatggccgggcacggcggctcatgcctgcaatcccagtactttgggaggccaaggcaggtggatgacttgaggtcaggagtttaagaccagcctggccaacatggtgaaatgctgcctctactaaaaatacaaaaattagccaggttggtggtgggcgcctgtaatcccaactactcgggaggctgaggcaggagaattgcttgaacccgggaggtggaggttgcagtgagccgagattgcaccactgcactccagcctgggtgacagagcaagtctccatcttgaaaaaaaaaatgccatctgacccagcaactccactcccacgtatacaccccaaagaactgaaaacaggaacccagccaggtgcagtggctcatgcctgtaatcccagcactttgggaggccaaggtgaggggatcactgaggccaggagtttgaaaccagcctgggcaacatagtaagacccatctctacaaaaaaaaaaaaaattagctgggcatggtggtgcatgcctgtggtcccagctacttgggaggcttaggtgggagggttgcttacgcctaggaattggaggctgcagtgaactatgattgcatcactggactccagcctgggccacagagtgagactctatctcaaaacaaaacaggaactcaaacaaatactggtacataacacatgttcatagcagccctactcacagtagacaaacagtggaaacaacctaaatgtccattgatgggtgaatcttggcccatgtatacaatggaatggtattcagtcagaaaaagggaagaaagggccgccgctatggctcacgcctgtaatcccagcactttgggaggccgaggcagggggatcacttgaactgaggagttcaagagcagcctggcaacatggcataacctcatctccacaaaaaaatacaaagaaatagctgggcatgatggcgtgtgcctgtggtcccagctactcaggaggctgaggtgggaggattgcttgagctcaggagacagttgcagtgagccgagattgcaccactgcactgcagtctgaatgacagtgcaagaccctgacccctaacccctacaaaaagaggaaagaaagggcacagtggctcatgcctataatcccagcaatttgggaggccaaggtgggaggattgcttgagatcacgagttcaagaccagcttgggcaacatagcaagatactgcctcaacagaatattaaaagaaacaagggaatgaagaaactgatccatgctacaacgtcagtgaacctggaaagcattatgctgagtgaaggaagccaggtgcagaaggccacgtagcatatatttccatttacatgaaatatccagaacatgcaaatccacagagacagaaactagattagtggttgctaggggctgggggatgggcaaaggggagtgaccatttatattagcctcttctcacactgctatgaagaactgcctgagactaattgataaaggaaagaggtttaattgactcacagttcagcgtggctggggaggtctcaggaaacttacaatcgtggcagaaggccaaggggaagcaggacaccttcttcacaaggcagccgagcgattgggggccggagggggttggggggggagggaaatccccttataaaaccatcagctctcgtgagaactcactcactatcacgagaacagcatgggggaaaccgcccccatgattcaattacctccacctggtcatttccgtcctccaaccacctaaccaattgatttccatccaacagtgattagttcaacttgttctatcccttgggattttggagattacaattcaagatgagattcaggtggagacacaaagcctaaccatatcaccaattaatggatatggggtctccttttggaatgatgaaaacattttggaaggagacgctggtgatggctgcagagcattgtgaatgtactaaatgccactttgttgttcactttaaaatagttaattttatgtgatgtgaatttcacctcaatggaaaacaaccaaccaacctcagcagcacgaggaaactctttgccgaggggctttcctctgtgtacattttcctgacctttccagagcgcaggagctggcctggcagttccaggcaggcctctgtgccccactgagctgtggctgctgttgtgcttgtcccctagcaccatcctgctgtatcacatcatggcgtggggcctggccaccctgctctgtgtggagggagccgccatgctctactacccttccgtgtccaggtaagttgggactccagcgccccaggcagccccatccttggctcataatgtgttgtcttgcagggaatacatgagccccgacccacagagtgggtgccttggaggttaggccgttgtctcagggccacatgaggccatgctcacggcccagccccagagggctgactacaatagcttggagaatgaccctggaatcattctccctggctctgcctttctcgtttgtgtgcataggcacccatgcacacaagcatgtaggcaaagctttccgcatatttccctccacgtaaggtgtattcccagcccctgtattggtacagttttctcatgcccactcttaagtatttggtcttcaagcttcctctggatgagcaggtgagcttaacattctaggaatgagtgtaggataatgtggaagaggccataaggatccctgggcagagcttattctctagctttgcttcctacgctttctcacttctcttctatcctccacacagagggagatgtggccgctggaactgtctcaagcatttcctcaagtttacattcctgtccatgcaaccctcagttgcaaagccaaggtctttccaaggatatatactctaacttccaatggaaaactggaaaatggaagtggacagtgtctttgtctgtgatttttataccagggatcaacacagtgtagccctcaggacaaatccggcgttcttccgtttttgtaaataaagttttattggaatatagtcacactcatttctttatgtactgtctgactgcttttgcatgacaacatcagagttgagtagttgcctcagagaccacagtgtggcccatgaagctgaaaatatttactatctgttcttttacagaaaaaaaatcgacagaaaaaaattggtgtagataatttatctccctcttctcttgcttcttgcggctactcagtgaggatgtctccaaattggtgttgccttgtcaaccatgaatacaagcagggagctctgtatagatccatccatacattctgcttttctggggaactttaaaaggacagatgcactgtcagcagctgttataacggaatgcacttagttggaaagggagtttctgtgactctccctcgcctgtgggaccccggagactcctggcaaagttgcatctgagccttagggtgccattgctgcagggcgcacagggagccttgaggtgctcccagggtctttaggagctgtaccttttaagcatcttatccttaatcatctcttcattttcacaacgcctgacccagggcgctcggtgttcttcatgctcacagtctcactctcttatttgtcatttcctttctgtctttgcatcggagtcacttctctttctcctcttgtttctctttctcctttcaagcctttccagattgaattttagcctctacagctaaagataaaaccgcctgttaaaagaaagtggcagcgttgagaggtggtatagtaattcttcctatggcaagaggagacgggtattgcatttttcccacctgatttttttttttttttttttttttttttttacattttctgccactttcccctctggtttgacaactccgtcaatattaagggtgtttaatttattttttgtcattcccccttccgtggccatgaggctgtttggttagccccttttccacctccctctttggttgagctggagcagacctccctcccctttgccttcagtttcctcttcctctgtgccattttgcttctctcctacattaagcatttcgcagctgagagttgttaccttggtaacatatgtttgtgaggccctccagcacattctgtggtgaccagtgactcctatgacccctcagtagaaatctttgtccttttctctgacaagaacctctgaaactattgttatccataaccatgagaacacatttcctctgaaatatgcagctggcatattttgagttgttcaagcccagggacaagattttattcatgttattgcccaaaaccatgtagtaagtactcaaaacctcactatttaatggagtgcctttgtctctacttgaattgcgttttttccttgagacccagtgcagggaatcccccatcccagggtgtttttctttccgatcttttcccagcaggaacctttaaaagcttcctccagtggaatgccttaggggtcctcccatttctgagacagaaacatggttgatctcccttactctcctgcaatttatggcttgttccagacatgagaaatgactcacatttcctttgggcagtcagcagcagatttatgcatttccctttttgttctcatcctcttatcttgacttccagataagtagatgtcttttagccaaaactttgcttttgagaagaatgactttggttttcctctctcaggtgtgagcggggcctggaccacgccatcccccactatgtcaccatgtacctgcccctgctgctggttctcgtggcgaaccccatcctgttccaaaagacagtgactgcaggtaaatactagggaagctctctgggtacacggccactgggagcggccccatgcctcgggctcagacagtgacacatgttgtcctggaattctccaggacagttgacctcatttgtcatcctccagagacatcagcagaacacagctgcagaaagtaagcaggttcaataaatgaaaatgtgcaggcctctgcccgcacaagttctgtaccatcgtttgttagctcagtgccaggactagttgacttttcacttctgtactgggcttctcctgggtcggctgcaggagtgcccttggacgactgtggaggtgtgagaggaacagaaggagaagagaagggagggggaagggactgagtctgtactgaggcggctccagccccataatgcacttggctgatgttttttctcagatgggcaggaaacaggaagtggagcacaggaaatgagtcaaggtcaatggttagaaaaggataagagtaatgaagtcgttggcaacatgtctgggaaagacttctaggctggggctggagacctgcagtccagcccctactttcccctcaaggaagtgtgtcctggagtgagcctcccacctcctcaggctgccagagatctctcaaggggagaatgggaataaggaaatttgccttaactgagaggtcctttgaagatcacctgttgattgttgaactttttaaaaacattgttgagagtactctatcattggtaataggaaattattgtgattcttcggaccattctcttcatatctacactttttgttttcattgagacggagtctcgctctgtcaccccaggctggagtgcagtggcgtgatctcggctcactgcaacctctgctgcccatgttcaagtgattctcctgcctcagcctcctgagtagctgggactacaggcaagcgccaccacgcccggctacttttttttgtatttttagtagagacggggtttcactatgttggccaggctggtcttaaactcctgacctcgggtgatccacccaccttggcctcccaaagtgccgggattacaggcgtgagccaccacgcctggcgcatatctacatttaaatatagtgtgttaaatatagcattttaagacaaaatctcatcaaaaatagtgatttgagctgatggaaatgacttatagaaaaaagactgaaaagaaatacactaagatgttaacagtggttacctctgggtggacggaccatgggtcattcatacttctctaaacttttaaatattttctaacttgtctataagaagaaattaaatttttttcaatattttaacaagcgtgcactatttttatttttttgagatggggtttcgctcttttgcccaggctggagtgaattgacgtgatctcggctcactgaaacctccgcctcccaggttcaagcgattctcctgcctcagcctcccgagtagctgggattataggcatctgccaccacagccagctaatttttgcatttttagtagagatggggtttcaccatgttggccaggctggcctcgaactcctgacctcaggtgatccacctgcctcagcctcccaaagtgctaagattacagttgtgagccactgcacctctatttttataacagagaaaatgagcttttaaaaatatagtttctgaactaggagcattcaaataaaattgggaatttatttatttagttattttgagacggagtcttgctctgtcacccaggctggagtgcagtgatcttgcctcactgcaatctctgcctcctgagtccaagggattctcgtgcaccagcctcccggatagctgggattacagacgtgcaccaccatgcctggataatttttgtatttttagtaaagacagagtttcaccatgttggccaggctggtctcgaactcctgacctcaaatgatccacccaccttggcctcccaagtgctgagattacaggtgtgagccactgcacccagccaaaattgggagttaacatagtaatgtacctgtgttaatttcatagttgtgaagaacatccccatggttgcataagatgcttacattgaggggaatctgggtaaagggtagggatatacagggactctctgtgctatcttttatctttgcaacttttatgtaaatctaaaattatttcaaagcagaagtttaaaaatatgtatattccttagggtctatgaggactccaacctggaagttgtgaggaatgaatgtcagtgacttgctttgcttcctgcccctctggccttgcttgtgggctcacacctgcttccattgccttctctgtcactccgtaaacatgaataatgaacaccatacatagttccttctgttcttcacagtggcctctttacttaaaggaagacaaggcatttacacggagaacgagaggaggatgggagccgtgatcaagatccgatttttcaaaatcatgctggttttaattattt

SEQ ID NO: 4231 - DNA, 40618 bp, human
accgagcctggctctactgcaggcgctgggggttggggtgggggagaggcccagggcacatgatgccgcccccagcccgcccagcacatgacccaggcaggccggcggggtcctggcacacccgagccgcgtccgcgaacacagcccatggcctccccgcgcctagggaccttctgctgccccacgcgggacgcagccacgcagctcgtgctgagcttccagccgcgggccttccacgcgctctgcctgggcagcggcgggctccgcttggcgctgggccttctgcagctgctgcccggccgccggcccgcgggccccgggtcccccgcgacgtccccgccggcctcggtccgcatcctgcgcgctgccgctgcctgcgaccttctcggctgcctgggtaagggcgcgcgcggcccgcgggttggaatctgatcagcgcctgggtgagggcgcgtggcccgcaggttgagacccgactggtgcccggataagggcgcacggcctgtggatttggacctgttccgtgatggagtgaggacgagaggcccgcgggttggaacctgcccggtgcagggctgagggcgcgtagctggctggttgggacctgctcggtccccggctgagggcttgaggcccgcgggttgggacctgctcagtgctggggtgagggcgtgaggccctggggttgggacctgctcaatccccgggtgagagtgcgtggcccgcaggttgagaccggatcgatgcccgggtgagggcgcatggcccgcaggttggaactcgatccactcgggttggaacttgatcggtgcccgggtgatggcgcacggctagcgggttgggctggccgtcttaacacttgaaccacagagaaaagagaaagcggaggctgttccctagggaccggatgggacaactaggtaatttttttttttttttttgagacggagtcttgctctgtcgcccagactgaagtgcagtggcgcaatctcggctcactgcaacctccacctcccgggttcaagggattctcttgcctcagcctcccgagtagctgggggaggcgcgcgccaccatgcccgactaatttttgtatttttagtagagacggagtttcaccatgttggccaggctgctctcgaactcctgacctcaggtaatccacccgcctcggcctcccaaagtgctgggattacaggcgtaagccaccgcgcccggccgactaggtagttttgcaaacacatggtcggtaaaattcccatccaagggacgttgggttttaaaaaatccgtttattgtgtttgttatatggaaacttcagatggcgcagttaagcaaaacccagaccagaaaagatttcctcatttttgcccaactgcaccagggagagactaacaattaacttctctctgtctcgctctgtgtgtgtgtgtgtgtgtgtgtgtgtgtgtgtgtgtgtgcgcgtgtgtaaattcttttctattgtgcactatatattctctcgagtattttgtaagctgaaatcccttccctatccaggctttttgggtatggtttttacaccacaggtgcgcaaactgcagccctcagaccaaatcctgcccgttttctagggtccacgagctaagaatggttttacatcctactttttaaaaaattaatgattttgttttttgagacagggtctcaccctcttgcccaggttgagtgcagtgtcacaatcacagctcactgcagcctcgacctcctgggttcaagcgatcctcccacctcagctacccgagtagctgggactacagccacacgccaccatgctagggtaaatatatgtggggtctcactatgttgcccaggctggtctccaactcctgggcttaattaaaagatcaccacccttggcatcgtaaagtgttaggattacaggcgtgagccacctcacccagccctaaaatgtttttaaaaatcaaaattaaaaaatatttcctggcatgtgactattactgaaatttaaatgttaatgtctacaaataaagtttgatgggaacgcagctatgttgttcatgtgcatttgtgaattattcatggctgcctttaccctacaagggcagggtgaatattggactgagaaagtatggctcccaaagccaaaaatattaagaatgagtttgccaacatctgctttaaactattatgtgacactttatacagacctctcagctagatttggccattctgtttagctttttggaacatttccaccatgcgtaaatgcagtctataatagaaacacttacagtgaatccctgtacgtgggattcgtgaggtacgggtacccggctcatctgctcccctcttcaccctcctcactggattaatgtgaagccaatctcaggctccatcatcctgcccattcagatctcagagagagccctaaaacataataattctaaacatttgcaaccccaatatcattatcactttatttttgagacagggtctcactctgttgcccaggttggagtgtgctggcatgatcatagctcactgcagcctcgaacttctaggctcaagggatcctcctacctcagcctcctgagcagctggaactacaggcatgcatcaccacactggctaatttttgcattattttttcagagctggagtctcaccatcttgcccaggctggtcaaacttctaggctcaagcgatcctcctacttcggcctcctaaaggtgcggtggctcacgcctgtaatcctaactactcaggaggctgtggtggacggattgcttgaacccaggagttcaagactagcctgggcaacgtaacgagacccaggctctacccccaagaaaaaaaaaacaacaaaaaaaaggcccgtcatggtgggatgcacatgtggtcccagctactcaccaggctgaggcaggaggaccatttgagcccaggaattccaggctagagtgagctacgatccagcctgggtgacagccaagaccctgtctctaaaaaagtaaggtgtacccaaacatcttttgagggttagtgaataatacttgcatatcctttagcctttagaagggaagtggatgaggttgcgagcaaataagcagaagtcaggaaaaggctgggtgatcgggaccccttactgaaaaataagaaatttcaatgcccatgggatagggcttttattaagctcaaaggagtgataaatgctgaaaattctaaggcaccgtacagaagaaaggcattgtttttgttggcagtggcttgataatgagaagatgtcttgagctttttagtgttcacagttgtcgtttagtagtgtattacatagtgtgtgtttagtggtatattacatggtatgtgtttagtagtatattacgtagcatttgtttagtggtgtatcgcatggtgtgtgttgcatattatatggtgtgattttagtagtgtattgcacagtgtgtgtttagtggtgtatggcatgtttaccagtgagcactactacatagtatgtagcttggtgttgtttacagttctcccctttatattacctagcatacttttttttttctcagatggagtctcactctgtcgcccaggctggagtgcagtggtacagtcttggctcactgcaacctccacctcccaggttcaagcgattcttgtgcctcagcctcctgagcagctgggattataggtgcccaccaccgtgcctggctaatttttgtatttttagtagagatgtggtttccccatgttggctaggctggtcttaaactcctgacctcaggtgatccacccacctcagcctcccaaagtgctgggattacaggcgtgagccaccatgccaggctctttacttttcttttctttttgacacagggtctcactctgtcgcccaggctggagtacagtggtgcgatctcgactcactgcaacctccgccttccgggctcaagcgattctcccacctcagcctcctgagtagctgggaccacaggcgcgtgccaccacctccagctaattattgtatttttgtagagatggggttttgccaggctggtgtcatctcctgggctcaagtgatccgccggccttggcctcccaaagtgctgggattacaggcgtgagcaccgcgctcagaccctagtgtacttttaaacaacggatattgcattacctaacaaagaaccataatatgtaccatgagtgtgcatactgttttgaggatattagacatttgggtctaatagcaagagaaactcacaaagaataaatgttaaaggcaaattattgagaattaatttgtgaaaattttaaatgttgtgtttaaaaaagaatgaaggaactatatattcaaacttctaaattgtgctttttgaaaaattcttttttatgtgaggaataactaatatggccactgaaaatgcagccgagaaatccagattgctagtcacatattgcaagtaaaccaacagacaaacaaaatagggatgagactgtggccaactatggtttgcgttaaagtgcctgcgtttgttttgctaccataagttattttctgagtttcaggccaggcgcggtggctcacgcctgtcatcccactttgggagaccaaggcggacagatcacttgaggtcaggagtttgagaccagcctggccaacatggtgataccccgtctctactaaaaatacaaaaattagctgggcgtggttgtgggtgcctgtaatcccagccactcgggaggctgaggcaggagaattacttaaacctgggaggcggaatttgcagtgagcagggtttttaccactgtactgcagcctgggtgacagagccagactccgtctcaaaaaaaaagataaataaaaaataaaaataaaaaaaagttattttatgagtttcaatcttctttttctctctctgcacacacaaatatgtatgttttttcttcctttcttccttttccctccttgtctttttccctccctctctccctccctcctttccttccttccttcttccttcctctcttcctatctctatctattatgtatctatcatttttccaaagcaagaagtcagctttatatttgattaggatcagatacaaagtattatccaattctctcttaggtatggtgatccggtccaccgtgtggttaggattcccaaattttgttgacagcgtctcggatatgaaccacacggaaatttggcctgctgctttctgcgtggggagtgcggtgagtccaccccctctgcatgccctctcctccctacttatgctcctcaaatcgcagcagcagcaaaccctgggagtctgttagaaatgcaggttctcacgtcctgccccatcctgctgatcaggaacccagccctctctgttttaacaaaaccctccaggggatgctgcccagacactcaagtgttgtttctcccacctcttcacaaatgcatcctccgcttacatggggccacgagcaaaaccagctggcacagaaaaagttatcaatccattggatgcattttgtataaatatatacataaatatattaaataaaacatacaagccgggcacggcagcccacacctgtaatcccagcactttgggaggccaaggcaggtggatcacttgaggccaggagttccagaccaccctggtcaacagggtgaaaccccgtctctactaaaaatacaaaaattagctcggcgtggtggtgtgtgcccatggtcctagctactcaggtggctaagacaggagaattgcttcaacccgggaggcggaggttgcagtgagccaagatcgcgccactgcactccagcctgggtgacagagtgaaactccatcttcaaagaaaaaaaataaaaccacataattatatataaacaaattattgaaaaagtaaatagatatcatatatacacagacacacatacacatgtatgttatgctccatccgtcacggtggtgctcaggtgagtgatttgaagcacattccctgatgctgtgttgattgccctgtgctggagcagaattgccagtttccttgcttccctgtcctcagtggcttcctaactgcatctatggaggctctgtctcagcccgcagtggcgagacatcttgaccttgtgtcgtttctaacactggagtccccttactccatcttctctttggaaggactgcctgagtccctcctccccgtactcattcttcctcagaacaagagcttctatctagttcaaagcccccttgagcctgcacctcagtttaaatgacatatcttggaacttcatcctccctgcatacaagtggagcagaaggcatagttccttagtcaaatctgaatgcctacacctatcccaggccacaccctccttggtcccaggaactgtgcccacttgtgtcccgagagctgtcacgtgcggcttcctgacgtcagaggaagccagtgtctaccctgccgtctcaaggatgggctgggcttcttgtacctgtttccagacattttgatgcaggctcttcccgattgcagatgtggatccagctgttgtacagtgcctgcttctggtggctgttttgctatgcagtggatgcttatctggtgatccggagatcggcaggactgaggtattcaccgaggaaatgggatttctgccctagttctattttagagggaagataagagatggcactgagcgtttaaaagtattttgcagtgttgcagacaccgtcattcagaatctgtcagctggcccctccgcctagaaacatccacagcagctcatttttataagaggccaaaggcacatttaaaatattagccaggcacagtggcttgtgcctgtaatcccagctacttgggaggtaggaggattgcatgaggccaggagtttgagaccagcctgtgaaacttagtgagagtccatctccaaaataataaaagaaaatcttgaggattttaaaaaccttgaaagcaagtaattcaataaatgaaatatttggaactggacaaatactaaaacagaatgggcatgtacataaacaattttattgtttattttttactttttagaggcagggtctcgctttgacacccaggctggagtgcagtggtgagagtatggttcactgcagcctcaacctcccaggctcaagcgattcttccacctcggcctcctcagtctgtagctgggactacagacatgtgccaccaaacctggctaattttattatttttgtagagatggggtcttgctatgcagcccaggctggtctcaaactcctggcttcaagtgatcctcctgcctcggcctcccaaagtgctgggattacaggcataagccactgcataaacaattttttattatatttaaaggttcaaaggatgtatatattgacacttcatgctaaatctggaacctgagaatgccggggctggaggtggctgcttggcagggagttactcagtggctagtatctggggcactggtgtgtttgaactgatgcccagtcactcgtgagctgtgtaactgttggcgagttgtttaacttctctggacttctgttttctcagctgtgaaatggtacccaccacacaaggtcactgtgaagagtaaatgtgataacccctgtatatggttaagaacagtcctgaaacgttgccagctcttgatacctatcagctgttacagtaggtgggctgcacatgtgttgaggaaacatccacatagaaagctgaactgacacagagaagctggatgtggcatggcagggctccaaatccaggaagcatttgcccccaccaagttcatggtccacttgattcaggtcccctttgaagggagcccctccttgcctgttttttgttctggtttttgtttaaatacagctttgtaggccaggcacagtggcttacacctgtaatcccagaactttgggatgctgaagcaggaggactgcttgagcccaggagttttgagaccagcctgggcaatacagtgagacccatctctacaaaaaataaaaaaaagatagccaggcatggtggggtgcaacggtggtcccagctactcgggaggctgaggtgggaggatggcttcagcccaggaggtcaaagcacatgatcgtgtcactgtactccagcctgggcgacagagtgagaccctatctcaaaaaacaatagaaacaaacaacaacaacaacaaaaaacccagctttataaaggtcacctgtttaaagcctaaaatccagtggtttttcgtgtattcacagaattgcataaccatcaccgttatcgatgttacaccattttaatcatcccctctacatctctgtggtggttattagtcactcctcactgccccctccccacagcccccagcaaccacttatctactttctgtctctgtggagctgcatgttctggacatttcatagcaatggaatcatacagtacgtgacctttcgtgtttgggtttttaactcagtgtaacattttcacggtttatccgtgttgtcacatgtctgtgcttcattcctgttatggtctgaatgtttctgtccctccaaaaattcctgtattgaaattctaacccctaaggtgatggtattaggaggcagggcctttgggaagttattaggtcataagtgggatcagtgcccttgtaaaaggggccccagagagttccctcaccccttctaccatgtggggacacagcaagaaggtgctatctatgaaccaggaagcagggcctcaccagacatcacatctgctataccttgatcttggactcccagcctccagagctgtgagcaataattgtttataagccacctagtgtgtgatattttgttatagcagcctacatggactaaaacaaccccttttcattgctaaataatattccagtgtaaggctatactacattttgtttatccatttatcagttgatggacattttgtgtgcttccattgttttgactacttccattgtttggctactaggaataatgctgcaactgacatttgtctgcaagtgtttgtgtggacatatgttttcatcacatattcctgagtatatatctaggtgtgtaattgctgagccatgtggtaactctaggtataaccaggtaagaaactgttaaactgctttccaaggtgagtgtaccattttacattctagcagtaatgtgagggttgcagtttatccacatccttgtcaatacttgttattatctgttttaattttagccatcctagcatgtgtgaattggtagctcctcatggttttgatttcactgatgagtaatgatgctaagcatcttttcatgtgctgattggtcatgtatatatcttcttagagaaatatctattcacctcttttgcacattatttcattgggctatttggttttttattattgagttgtaggagttctttatatattctagatacaagtagcatattacatacgtgattcacaaatagtttctcccattctgtggtttgtctttacacctacttgatgatatctttcaaagcacagaagtttttcattctgatgaagtccaatttttctatttctttccttgatttcttattcttttgttgtcatatctaagaaatcattgcctaacccaaggtcacaaagatttagacctatgttttcttatggtttgaatgcttaaatttaggtccacttagaatttttgtgcacaggtgactaatgggtccatcttcattattttgcatgtggatatccagttgtcccagcaccatttattgaataaatttacttttaaagccaatatcagtaaatagagatcatatgtaggctatagaatatattgggtaatcccagtagatccccgctctaaaatcattgacattccttatgtagatcacatcatcaactttggtctctctggcctgaagtttagtgcttacttcatttttatgcttgttccttccatctttttaccttagctcccaaactcttacacatctgaaccaaactgagatatgcctggttgtgaaaattctccagggaagatagtcaaggtcagagccagccaattaggtgtatcagtgaagattcattttggctacataaaatatatataataataatgacttaaacaaggtagagatttctctttcatgctaaagatgtccagaggtaggcaatccaggacacttgtgatggacatcagggacccaggttcctttgattttcctgcgtcactatcctatcgtgtgacttccatcctcaaagtgtcatggcccaatatagctgctggtgctccagtcatcacacctacattctgggcatcaggaagtgggaagagagcaatgcaatgcaatagaggcctgtgttcccctgagccagctttaagtagtgtcttgggagtttcatacaatgccagttacatattatcggtcagaagttagttttttttttttttttttagatggagtttcactcttagtttcttttttcttttcttttttttgagatggagtttcactcttagggtgaaaaagatagagtttcactctttttgcccaggccagagtgcaatggcacgatcttggctcactgcaacctgcaccgcctgggttcaagcgattctcctgcctcagtttcccacgtagctgggattacaggtgcctgccaccatgaccagctaatttttgtatttttagtagagatggggtttcgccatgttggtcaggctggtctcgaactcctgacctcaggtgatccacccgcctcggcatcccaaagtgttgggattacaggcttgagccaccatgcctggccagaacttagtttcatgccacacttagctgctaaaggaggtaggaaatagactctgtgagccgagcatgcagctgccctcatgacatccaggttatgttactgagggaaaaaggaaatatggctttgagtaggtaatcagcagtgtgatacagccatggccctgcagctctcatgattggcatgtctctgagcatccctcagtgttggagaggtcggaggtctgacacaactgtaggtcttatagatgccagttatgggtagaagaagcgtctcagagtgctggaaggaagctgggagaaaagtaatgccctctgctgccatagaggatatattacttcacctccacccacggtggggatgtgggggaaaagggatggggtcccacagggcaatctgagaactgtctggacccagaggacagacagggccctgagaagctgggacaggcaatcatgaagccctccttaccccaaggatagtatttgggagttcatttggagctcagtgatcagaaggcaggatgttgggaccaagggtcttcagccagtggggggcgcaggcttctcctgatctgctgtggattggggttcagacttctgccccggtgtgggtttcagaggcccagcccgaagtcagggtctggaatgcagagattctgcactctcaaacacccagccctttgcagaaagcctctccgttagttatctgagtctcatacagagcttctggttcctggcccacattgctgagacatacccccaaccctcacccgctcccagcccagccaggctagggaagagccatgccaggaaccagtcacagtgtgggaggcaaaacatgctggaagtgtttcttttcctcccgaagctctttgggcttgtttctttcctcttgtctcattgtagaagggtgtcctttctcactcagatccctttgtctacacagctgatcttccaagttgaagtcccgatggggtgggggttgtgatatttgccaggaatctggtagggttttgagtgacagccatgcatcccatggagctccagccccctaccccacctcgtcccatcagacaggagaggcaaacccaagactggatggcaccagtcagctctgcagagcttccatcttcagtcttcctgcggcatctggaaggctgcggcctcaactcctgggggaaacggggtggggtgtatggaagtacaaagatgaaagctagagactgtgcaagaatgccagctgtgcagggaatggggaggcgaaaggcaagtcccccgctctcctctcgggaagcatgtagtagctgctgtttctgcagagacagccttcccaggtgggactgagcattcagacttggctattaggtgtggaggtgactctggaagggcttggggataggagctccttgcttatcgggtgagccaggtattcaggaggcataaggcctctctcgctggggggctgtgagggcccacacagctgagaaggaaccccacgttcatgtccttctgttgggaaacctcaggttcaggtttgctgcagatccacctggattcgcttccatgccagaggatcaggtaggaaaaagcaaaccagacaagcccaagcacagctcctcctccctttctgacatctccataaaaaactttgcagtcacagccattggctgatttcttctctaagctatcccctcatcttttataactgggttttttttttttttttcagattctgtttttttcaattatttttatttttatttatttatttatttttttgagacggagtcttgctctgtcgcccaggctggagtgcagtggtgtgatctcggctcactgcaacctccacctcccaggttccaggaactctcctgcctcagtctcctgagtagctgggactacaggcacctgccaccacacccagctaatttttgtatttttagtagagatggggtttcaccatgttggcctggctggtcctgatccacccgccttggcctcccaacgtgctgggattataggcatgagccactgcgcccggcctttttcaagttttaaggtttatcttgttgcaaatttttttttgaatagatgaaaagagcccttcagtaggttatcagacttacacttaaactgacatggtcctgtggcccacagaggcttctgtgacccagtcctcaacacacggcgctccctctgtcgtctctcaccctccccactccagccacgcccagctcccagcttctagaaggcgcctgtattcctttttttttctttctttcttatttttaatagctgcatctcactctgtcatctaggctggagggcagtggcatgatcacagctcactgcaaccttcaactcctgggctcaagcaatcctcccgcctcagcctcctgagtagctggggctacaggtgtgcacctccaggccaggctgcagctcacattctttgacttgtggccttttcctccatcttcaaagccagcaatggtgggttacgtccttctcaaattccctcctctctggttctctgcagctgatagtctctgcttttctggattctggcagttacattggcccaacccagataacccaggatgacttccttatctcaaacatccttaacttcatcacacctgcagagtctcttttgccatataagggaacatattcacaggttccagaaattaggacagggacatctttagggaaatgtatttgggctatcacaagtgtttatccactctaacttataaacatagtctctgccaggcatgttggctcatgcctgtaatcctagcactttgggaggctgagatgggaggattgcttgagcccgggagtttgagacaagcctgggcaacatagcaagactccatctctactaaaaataaaaataaaaaagttagctgggtgtggtggtgagtgcttgtagtcctagctacttgggagcctgaggcaggcttgagctcaggagtttgaagttactgtgagctatcattgtgccattgcatgccagtatgggtgacagagggaaaccccatctcttaaaacaacaaccaccacaaacatagtctcatcttttagattaatcacagctacgagcctgacttcatgtaaaatcttctccatccagctatggcctctggggctggcccccagcaggggcacaggctggaacattacactgattcttctatgtcatcctctcaagatggtcactcccatgcaggcagggattctgttttttgtgcctagaacaggcatgatctttgctcaataaacattcagccaatgtacactgagtgagacatactgcgctgatacaactctgtgattcttttagttgagacgtaacttaaatactgtaatatttgccctttaaacgtgtgcagttcagtggcttttagtgccatctgcaaggttatacatcagttagcctcactattactagttccagaacatttctaccatcccaaaaagaaaccctgtacccattagcagccacccccatgtctgcacaatcacacaatatgtgcaccctttgtgtctggcttttcactcagcattgttgctgaggttcacccatggagtagcatgcattagtacttcattcctttcaactcgatattaccttcgcacgtgctgacagccatcttgtaggttaagggtgtgggaagtgtttcctatcactggcccctcttctgtagagaatgtgcaccggaagggaaatcccagagtaacagcgctgatggtccagtacatgtctccacctccctgagcacaggatgctggtaaatcccattgctggggccgcctgattgtcctcaaagtgaagacagctgggcatccagggcaagcccagccttgtaggaaagtggaggtgggcggggacggccagcctgccctggagggcagcgtaagtagcagaaagcagccaggcctgacgtccacctggccccttagcgtagtggcacaggaaggccgcagagggtttccgtgttcacccagctgagaggagcaactcacggctctgagaagtgggtctggccgaggtgatgcagctagttaatgtgccagctgtttgcattcggttcaaacctgttgagcctcagagcatcctcctgggatgaggctgtaagaggagtaagtggggaggctgggaggagcacctggcgagtgctgtgcccgtgaggtgcagtcttagtccgtccaggctgctataacaaacatcacagactggcggcagcttataaatagcagaaatgtatggccgggcacggcggctcatgcctgcaatcccagtactttgggaggccaaggcaggtggatgacttgaggtcaggagtttaagaccagcctggccaacatggtgaaatgctgcctctactaaaaatacaaaaattagccaggttggtggtgggcgcctgtaatcccaactactcgggaggctgaggcaggagaattgcttgaacccgggaggtggaggttgcagtgagccgagattgcaccactgcactccagcctgggtgacagagcaagtctccatcttgaaaaaaaaaatgccatctgacccagcaactccactcccacgtatacaccccaaagaactgaaaacaggaacccagccaggtgcagtggctcatgcctgtaatcccagcactttgggaggccaaggtgaggggatcactgaggccaggagtttgaaaccagcctgggcaacatagtaagacccatctctacaaaaaaaaaaaaaattagctgggcatggtggtgcatgcctgtggtcccagctacttgggaggcttaggtgggagggttgcttacgcctaggaattggaggctgcagtgaactatgattgcatcactggactccagcctgggccacagagtgagactctatctcaaaacaaaacaggaactcaaacaaatactggtacataacacatgttcatagcagccctactcacagtagacaaacagtggaaacaacctaaatgtccattgatgggtgaatcttggcccatgtatacaatggaatggtattcagtcagaaaaagggaagaaagggccgccgctatggctcacgcctgtaatcccagcactttgggaggccgaggcagggggatcacttgaactgaggagttcaagagcagcctggcaacatggcataacctcatctccacaaaaaaatacaaagaaatagctgggcatgatggcgtgtgcctgtggtcccagctactcaggaggctgaggtgggaggattgcttgagctcaggagacagttgcagtgagccgagattgcaccactgcactgcagtctgaatgacagtgcaagaccctgacccctaacccctacaaaaagaggaaagaaagggcacagtggctcatgcctataatcccagcaatttgggaggccaaggtgggaggattgcttgagatcacgagttcaagaccagcttgggcaacatagcaagatactgcctcaacagaatattaaaagaaacaagggaatgaagaaactgatccatgctacaacgtcagtgaacctggaaagcattatgctgagtgaaggaagccaggtgcagaaggccacgtagcatatatttccatttacatgaaatatccagaacatgcaaatccacagagacagaaactagattagtggttgctaggggctgggggatgggcaaaggggagtgaccatttatattagcctcttctcacactgctatgaagaactgcctgagactaattgataaaggaaagaggtttaattgactcacagttcagcgtggctggggaggtctcaggaaacttacaatcgtggcagaaggccaaggggaagcaggacaccttcttcacaaggcagccgagcgattgggggccggagggggttggggggggagggaaatccccttataaaaccatcagctctcgtgagaactcactcactatcacgagaacagcatgggggaaaccgcccccatgattcaattacctccacctggtcatttccgtcctccaaccacctaaccaattgatttccatccaacagtgattagttcaacttgttctatcccttgggattttggagattacaattcaagatgagattcaggtggagacacaaagcctaaccatatcaccaattaatggatatggggtctccttttggaatgatgaaaacattttggaaggagacgctggtgatggctgcagagcattgtgaatgtactaaatgccactttgttgttcactttaaaatagttaattttatgtgatgtgaatttcacctcaatggaaaacaaccaaccaacctcagcagcacgaggaaactctttgccgaggggctttcctctgtgtacattttcctgacctttccagagcgcaggagctggcctggcagttccaggcaggcctctgtgccccactgagctgtggctgctgttgtgcttgtcccctagcaccatcctgctgtatcacatcatggcgtggggcctggccaccctgctctgtgtggagggagccgccatgctctactacccttccgtgtccaggtaagttgggactccagcgccccaggcagccccatccttggctcataatgtgttgtcttgcagggaatacatgagccccgacccacagagtgggtgccttggaggttaggccgttgtctcagggccacatgaggccatgctcacggcccagccccagagggctgactacaatagcttggagaatgaccctggaatcattctccctggctctgcctttctcgtttgtgtgcataggcacccatgcacacaagcatgtaggcaaagctttccgcatatttccctccacgtaaggtgtattcccagcccctgtattggtacagttttctcatgcccactcttaagtatttggtcttcaagcttcctctggatgagcaggtgagcttaacattctaggaatgagtgtaggataatgtggaagaggccataaggatccctgggcagagcttattctctagctttgcttcctacgctttctcacttctcttctatcctccacacagagggagatgtggccgctggaactgtctcaagcatttcctcaagtttacattcctgtccatgcaaccctcagttgcaaagccaaggtctttccaaggatatatactctaacttccaatggaaaactggaaaatggaagtggacagtgtctttgtctgtgatttttataccagggatcaacacagtgtagccctcaggacaaatccggcgttcttccgtttttgtaaataaagttttattggaatatagtcacactcatttctttatgtactgtctgactgcttttgcatgacaacatcagagttgagtagttgcctcagagaccacagtgtggcccatgaagctgaaaatatttactatctgttcttttacagaaaaaaaatcgacagaaaaaaattggtgtagataatttatctccctcttctcttgcttcttgcggctactcagtgaggatgtctccaaattggtgttgccttgtcaaccatgaatacaagcagggagctctgtatagatccatccatacattctgcttttctggggaactttaaaaggacagatgcactgtcagcagctgttataacggaatgcacttagttggaaagggagtttctgtgactctccctcgcctgtgggaccccggagactcctggcaaagttgcatctgagccttagggtgccattgctgcagggcgcacagggagccttgaggtgctcccagggtctttaggagctgtaccttttaagcatcttatccttaatcatctcttcattttcacaacgcctgacccagggcgctcggtgttcttcatgctcacagtctcactctcttatttgtcatttcctttctgtctttgcatcggagtcacttctctttctcctcttgtttctctttctcctttcaagcctttccagattgaattttagcctctacagctaaagataaaaccgcctgttaaaagaaagtggcagcgttgagaggtggtatagtaattcttcctatggcaagaggagacgggtattgcatttttcccacctgatttttttttttttttttttttttttttttacattttctgccactttcccctctggtttgacaactccgtcaatattaagggtgtttaatttattttttgtcattcccccttccgtggccatgaggctgtttggttagccccttttccacctccctctttggttgagctggagcagacctccctcccctttgccttcagtttcctcttcctctgtgccattttgcttctctcctacattaagcatttcgcagctgagagttgttaccttggtaacatatgtttgtgaggccctccagcacattctgtggtgaccagtgactcctatgacccctcagtagaaatctttgtccttttctctgacaagaacctctgaaactattgttatccataaccatgagaacacatttcctctgaaatatgcagctggcatattttgagttgttcaagcccagggacaagattttattcatgttattgcccaaaaccatgtagtaagtactcaaaacctcactatttaatggagtgcctttgtctctacttgaattgcgttttttccttgagacccagtgcagggaatcccccatcccagggtgtttttctttccgatcttttcccagcaggaacctttaaaagcttcctccagtggaatgccttaggggtcctcccatttctgagacagaaacatggttgatctcccttactctcctgcaatttatggcttgttccagacatgagaaatgactcacatttcctttgggcagtcagcagcagatttatgcatttccctttttgttctcatcctcttatcttgacttccagataagtagatgtcttttagccaaaactttgcttttgagaagaatgactttggttttcctctctcaggtgtgagcggggcctggaccacgccatcccccactatgtcaccatgtacctgcccctgctgctggttctcgtggcgaaccccatcctgttccaaaagacagtgactgcaggtaaatactagggaagctctctgggtacacggccactgggagcggccccatgcctcgggctcagacagtgacacatgttgtcctggaattctccaggacagttgacctcatttgtcatcctccagagacatcagcagaacacagctgcagaaagtaagcaggttcaataaatgaaaatgtgcaggcctctgcccgcacaagttctgtaccatcgtttgttagctcagtgccaggactagttgacttttcacttctgtactgggcttctcctgggtcggctgcaggagtgcccttggacgactgtggaggtgtgagaggaacagaaggagaagagaagggagggggaagggactgagtctgtactgaggcggctccagccccataatgcacttggctgatgttttttctcagatgggcaggaaacaggaagtggagcacaggaaatgagtcaaggtcaatggttagaaaaggataagagtaatgaagtcgttggcaacatgtctgggaaagacttctaggctggggctggagacctgcagtccagcccctactttcccctcaaggaagtgtgtcctggagtgagcctcccacctcctcaggctgccagagatctctcaaggggagaatgggaataaggaaatttgccttaactgagaggtcctttgaagatcacctgttgattgttgaactttttaaaaacattgttgagagtactctatcattggtaataggaaattattgtgattcttcggaccattctcttcatatctacactttttgttttcattgagacggagtctcgctctgtcaccccaggctggagtgcagtggcgtgatctcggctcactgcaacctctgctgcccatgttcaagtgattctcctgcctcagcctcctgagtagctgggactacaggcaagcgccaccacgcccggctacttttttttgtatttttagtagagacggggtttcactatgttggccaggctggtcttaaactcctgacctcgggtgatccacccaccttggcctcccaaagtgccgggattacaggcgtgagccaccacgcctggcgcatatctacatttaaatatagtgtgttaaatatagcattttaagacaaaatctcatcaaaaatagtgatttgagctgatggaaatgacttatagaaaaaagactgaaaagaaatacactaagatgttaacagtggttacctctgggtggacggaccatgggtcattcatacttctctaaacttttaaatattttctaacttgtctataagaagaaattaaatttttttcaatattttaacaagcgtgcactatttttatttttttgagatggggtttcgctcttttgcccaggctggagtgaattgacgtgatctcggctcactgaaacctccgcctcccaggttcaagcgattctcctgcctcagcctcccgagtagctgggattataggcatctgccaccacagccagctaatttttgcatttttagtagagatggggtttcaccatgttggccaggctggcctcgaactcctgacctcaggtgatccacctgcctcagcctcccaaagtgctaagattacagttgtgagccactgcacctctatttttataacagagaaaatgagcttttaaaaatatagtttctgaactaggagcattcaaataaaattgggaatttatttatttagttattttgagacggagtcttgctctgtcacccaggctggagtgcagtgatcttgcctcactgcaatctctgcctcctgagtccaagggattctcgtgcaccagcctcccggatagctgggattacagacgtgcaccaccatgcctggataatttttgtatttttagtaaagacagagtttcaccatgttggccaggctggtctcgaactcctgacctcaaatgatccacccaccttggcctcccaagtgctgagattacaggtgtgagccactgcacccagccaaaattgggagttaacatagtaatgtacctgtgttaatttcatagttgtgaagaacatccccatggttgcataagatgcttacattgaggggaatctgggtaaagggtagggatatacagggactctctgtgctatcttttatctttgcaacttttatgtaaatctaaaattatttcaaagcagaagtttaaaaatatgtatattccttagggtctatgaggactccaacctggaagttgtgaggaatgaatgtcagtgacttgctttgcttcctgcccctctggccttgcttgtgggctcacacctgcttccattgccttctctgtcactccgtaaacatgaataatgaacaccatacatagttccttctgttcttcacagtggcctctttacttaaaggaagacaaggcatttacacggagaacgagaggaggatgggagccgtgatcaagatccgatttttcaaaatcatgctggttttaattatttggtaacctttcttctatatatgtgtatttttattgccagtgggaagggctatggaaacaacttgccatgttgcatgcgtgaccagaagttccaaagggaagagcctttgggaaggaaatctttgagactgtgctaggtgccctttgaggaaaggcacagaggacaggggagcaagtccaaaattcatgaatttctggaaaaacattcaaatctactcaaattatatataaagcccttagaaaacgaacacccaagtttagttttgaaatgtcccaaccatgtgcattgctggggttaaccaaaacaaaggggttgcgtatgctttttttttttttttttttttttttgagacagggtctttctctgtcacccaggctggagtgctggagtgcagtggctcaatcacagctcactgcaaccttgatctttagggctcaagtgatcttctcacctcagcctcccaagtagtcttactctgtcacccaggctggagtgcaatggcacgatctcagctcgctgcaacctccgcctctcaggttcaagtgattcttctgcctcagcctcccgagtagctgggattacaggtgtgtgccaccacactcagctcatttttgtatttttagtagagttgaggtttcaccatgttggccaggctggtctcaaactcctgacctcaagtgatccacccgtctaggcctcccaaagtactgggattacaggcgtgagccaccacactcagctggtcatgctttataaactcacccatttgcctcactcctgacaccagaattcctgtgcctgacagaggggcaagggcacgtctttggtcaagaaggttggagaacggcctgagcagtttgtctctcctcatttttccccaccactggtatcctgtccaaacctttcaggtggatactttgaaaacagacctgtaaccaatgcaaaaaataaaactggaatcagaacatgctgcactgtggtgaatcagtaccttgcaggcagggcaagtacttatgatgttaaaaattcacctgcgcgggtcgtggtagctcacactttggtagttggaggcaggagtattccttgaggtcaggagttcaaaaccatcctgggcgatacaacaacaacaattagccaggaatggtggcacatgcctatagtcccagctactcgggaggctgaggcaggaggatcacttgagcctaggagttcgaggctacagtgagctatgatcatgccactgctctccagcctgtgtgacagagcgagaccttgtctctaaaacataatagtaataataattcacctgatatgagctttgtttggacacctttcttggagatacataaatcatctcctactaaaaatacactcagttcaacatttcatatttcactgagccacctaaaataacattgaaaaatactattataaaatggcaagaaaaaattgttttgatctccatgaaaactgtacgttgctcttcaaacaaaaaatgaattctgggttatttgatacagtgctagaaccttacaccctgatgtggtgttgagtggtaccattggaaggatttgctgatctgtgctttagactgagaaaacgaattatgttttttaaattaaattcttagtgtgctggttcctcttagtctcatttcttttctttttctttctgagacagggtctcactttgtcccccaggctggagtgcagtggcacattcatagctcactgcaggctcgatttcctgggctcaagcgatcctcccaccccagcctcccaattagctgggactacaggtgcacaccaccacacctggttaatttttttattttttatttttagtagagacaaatttcactgtgttgcccaggctggtctcagactcctgggctcaagcaatcctcctgcctcagcctcccaaagtgctgggattacaggagggagccattgcacctggccctcttagtttcttactgcagaagtggccatgtctataccgggagttggtacttttaggtcttggtagaaattcttctctgactctccagcatttaaaaacgagtttcattgcatgttctctttacctgctgccattttctttctaacagttggttgtcgaatatcatcaatgaaagccttttattctatcttgagatgcaaacagatatcaatggaggttctttgaaacctgtcagaactgcagccaagaccacatggtttattatggtaggtcaatctatattttattttaattagttaattatttaattaatttgcttcagagacaaggtctcactctgtcacccaggctggaaagcggtggcatgatcatagctcactgcagccttaaactcctgggctcaagcaatcctctgtcttggcctcctgagtaactgggactacaggtgtatgcctccaccctgggcaatgtagggagaccccatctctttttttaattatctatatttaacactttctgcttgaaaaaaaatcagaagaaaaagaagcagtcagaagtacaatatattatatttaaatacaggatgagcaaaataggctcctggccttagtgtgctagctggctgttttgtttgttgtcgggatccttattaaatgcttcaactctggtcaaacagtttggtgcagtgtatcaaagctcctggcagtctcacaatatcagagcatggatcttgaaggaatgcttcagaccatgaaaaagccacacagatgaagatattcctggtagcattatccttcataattgtaaagcattataggcaacctggagttccaaaaaaaaaaaaaaaaaagaaagaaagaaatgtttaagtaaattatggtctttcatcttgatggactattactcagatgttaaaaatgatgattatgaaatctctggtattaactgggaaatcaaatatatacaattataccaattacaagtacagaaaaacatgtttatcttttttcaacggggaaacaatgaaaaaacacaagaaatgaaacagaaaaaaaattcatgtattggatggacatacatgaagagaatgatggggtagaagccccatgggcaagttgccccagtgctgccattctctcacctttataagaagaaatgcacacgtgttgttggcagggaggtgcatattgtactatacagaatccatatttatattgcttttgaaatggggaaagtctcatttacaaagactttcaaatggagccagcaccggtccttccatccctgcacgtggtttggagcttggctgggttcctctggtgaactttatgtgtccttagcacacaagagtggagggatgtttcccagactccgtctgagcctcaggaacctttattacatcaagtgctcccttggcagcacagggtggcaaactggggagaacagaggcccccaggctgcaggaggagctggctgttcagtccctgtgctacagcgctccctctccccttctcccactgctgccctcttctcctcccccaccctctcctcccactttctccttctcctgtcttccctcctctctcttgtcctctgtcccctttcttcccttctctactccagctcctccccgtcccctcctctccccactcccctctgctttcaggcacccttgaaggtacagcacctactgtggccaatcttcatcttgccccaaaccaacccaccaaccagtcaaccagccaccagccaacccatggtcccttccaagcgagtccagccctgtgggcatcctggggggagtgtgtcactctgtgacagcccagggctctgacttctgctacgctgcactgactgccatgtgtctttctgtcctctctccagggaatcctgaatccagcccagggatttctcttgtctttggccttctacggctggacaggatgcagcctgggttttcagtctcccaggaaggagatccagtgggaatcactgaccacctcggctgctgagggggctcacccatccccactgatgccccatgaaaaccctgcttccgggaaggtgtctcaagtgggtgggcagacttctgacgaagccctgagcatgctgtctgaaggtaatgccctgtctgccacagcaggtagacttcggggtcccagggctccccttggaaagccttagaggattctttgtcccgggggctgtcctgtgcatggcggggtgttcagcagcacctctcatgtgaactcactagcttccagttgcacctccccaattgtgacaaccaaaactctttctagacattgacaaatgtctcctggggagccacagtggcccccagttcacaaccagtgtctcagaataattaggcttggatctaaaaatgtgatttttttccagatgttgtctgagctaaatgcacacaaacacaaaaccaaagacaaacaccacacaatcccgtgatggggtgtaccaaaataatgttgaaatttggagtaagaaaaataatatgcagaaagatgtttggaaatggcttaaggagttccgttttcttttccattcctactattcaaatacactgaagggaggccaaggcaggtggatcacttgaggtcaggagttagagacgagcttgaccaacatggtgaaactccatctctactaaaaatacaaaaatagctgggtgtggaggctcatgcctgtaatgccagcaggtttgggaggccaaggtgggcggatcacctgaggtcaggaattcgagaccagcctgaccaacatggtgaaaacccgtcgctacgaaaaatacaaaattagccggcatggaggcacacacctgtaatcacagctacttgggaggctgaggcaggagaatcacttgtacctgggaggaggaggttgcagtcagctgagatcgcgccattgcactccagctggggcaacaagagtgaagccccgtctaaaaaacaaaacaaaaacaaaaacaaacaaatacattgaaggaagtttcactttcaggtgacaagcttggtttactttgaagaccaaaaaatatggtgatgaactgatgaattgattccatgataccgtactgtctggttgaaattgggagccatgaagagaaagagatagttctggctgaagctaaaagacacagagagaagatttatttacagactttccgtctggtacaaatagttcacgaagcatgagggacccaccagctggaactgctgttagtctgtagagttactgataccatctagggaatgaagcaaaaaatgttatcttgaattatttggctttgcattcccatcctgctgttttaaagtggctgagcagatatttgacagtcaaataaaacactagaaataacagtaaaagtcccctgcaccccaccccaatcaccaccaccaaacaaaatccatcagcatttccttacttccactccctccggcaagctgttgcatagatcttctgctcaaaggttggatgttttcacatagaggttttagaaaaagcaaatacagatccaatagaaaaataagcagggcagccatccctggaggctgctctctgtgagggctccctgtttttgttttttgagacagggtctccctctgtcatccaggctagagtgtagcggaaggaacacgtctcactgcagcctccaccttctgggctcaagcaatcctcccacctgagtctcctgagtagctgggactacaggtgcacaccaccatgcctagtttattttattttttagtgtttggagacacgaggtcccattatgttgcccaggctagtctcaagtggtcctcctgcatcggcctcccaaagtgctgggataataggcttgagccactgcacctggtcccttggctttttaaaaaatttcagatataattaacgtaccataaaggtcacccctttaaatggcacatttcagtggttgtgcacacgtcaccactatctaagtcagaacatgttcatcgttgcagaaagaaaccctgtgcccccagggagtcatttcccttctcttctccccagcccctggcaaccatgaatctcctttctgtctctatggctttgctgttccagaccttacatggaaagggcattgtgtaatattcgtcctgttgtgtctggtttcttgtacttcggatagtgttttctagattcgcccatgttgtagcaggtgtcagaacttcattctttttatggattgataatatttcgttgtatggatacacctattctttgttttatttatttatttttgagacagggtctcactctgttgtccaggctgaagtgcagtggaatgaacatggctcactgcagccttgatctcctgggctcaagctatctttccacctcagcctcctgagtagctaggacaacaagcaggtgccaacacaccctgctaattttctttggttttgtgtgtgtgtttttaaaatttattttatagagctggggtctccctatgttgcccagattggtcttaaactcttgtaaatgatcctcccaccttggcctcccaaagtgctaggattataggcctgagccactgcacctggcccactcttattctgttaataactacttatgactgccccaaactctaccaggctgtgtactaggagctgagtggggtggagatactggagatgtgtaaacctggccctcaaggatctcacagtctattggagaaaattaaaatattttaaaaaatcattctattctaacaatagaacactcaatggaaataccaattggagaaaacactggaggaaaaggaaagaacaaaaggaaagccttttgagaaaaatgagaaatacaatcggtatttttttattgtgggaagaattcctgtaaaaatggcagctgccaatttagaactccaagtgacatattattaggtaacatctgtcagggtttttgaggatagagcttgaagcatagagtgagttttcagaattaacaacaaacatctgcaaaagtataaagtggcctggcctggtagtatgaacctgtatccccagctactcaggaggctgaggaaggaggatcgtttgaggccaggagttggagtccagactgggcaacatagtgagaccccatctctttaaaaaaaagtataaagtggcggtgctactgaggtggtggttagggtcataagtttacatctagtcaccctttgaatatcttaaaattgcccataacatgcagtcatcaccattttgtatggtaaccctatgcaggaatttgcatacattaatctaaaaagaattgaaaaggcttttattcagaaattaatttgctgcctaggacacctcacattttttaatatttccacatcggacttttggctctcatcaccattgtattgtttggggacaattttaggatcccttctaaatctttcctggtcggtatgtctctggggccacttgcctgtcaccccagaatgtgcttcccttctgtcagtggcgggggaaacgcaggtgtcattccgattttcctaccagagctttaccagcttgcaggcagcaggatccctgggactatgtaaatcctcacctactctccctgccatacctccccagcccctcactaagtagaggtgaatttgggtaagttaagtgtgcatcggatactacttctgtgcgtaaagtcaaggaaaaccccttaccagggctgctttcctattggctgcacctgattactacgatggcagatacagaaaaaacttagccatgggcttctccctatgtagacagtggatataaagctcaacttgttcatcatacccttcagaccctactgcttcgggtttcactacaagaccaataggctggcatggagctttattaagtatctgatatggtgtctggaacttactaggtacttcacacaagttaactgaattttgtcttaagcaaatattcaacaccattttagccgggatgggtgagtgttcctgagaagtataatttgtgaaactcccaagtaagtaaggacaatactgtttttttttttaaacctgtgaagggttaaaggaacacaggcaatgcaggactaagttggttttggaacactggtgagagttcctggagaaggtgatgtgcgggctgggtcttagatgatagaacagcataggcaaagaggagacagaaaatctagatgaggaagacgcggtgttgagagttagcatagaaagtctgcgtcttgtttggggacggttgtggctcagcgtggtatggaggcgttgggggaagctggagaagtggtgaagggtttataaagattctgctagggcgtttgggctttatccggtggccagcgaaaggccagttaaggtttttaagtggagagacactgcaatttgcttgtaggaccagcccagtgcatgggcgtggaagaaaacacgtaatgcatcgcgttttgtgattgtggcagcagtttccattgaggggatctgtgtctccgcttagggaggcggagagccgctggatggagctcggttccacgccccgtcaccattgtgcctccttgctgaacactctctgctcatcaagtcgaggtgttgggatctgggacaatcctgaagagagtcattactaggggaggattgtgcacctgaaccgcttttgactccctagatgtgcaggcacccaactcccgggcctgcgctggctctcaggagacccagccccttggtacctcccggtttccctccagggagcgagccaggggggcatggcctggcaggaggggtggggactgggtggagcttatagagcctggccggggctgtgttttggggtagggcctggtgagagcgaaggggcagagtctggcaggagggatgtggctactaagagcagggcatttctgatgggagcaggagtatagatctttcctggaagacgagtgtgctagtacacaaacttgcaagatttaaggatcatcccggggagaagcccaggccggtgaggctgaggcttagggcttgttgggagtggaggggtcgtggttaggatagaacagaggggctgtgttcccacacaggtggggtgaggcccattcagagcccagaaacatggccagaaaggagcgtagctgtatctcccacaatgccttttatctcccccaattccatatgacacccaccccgccattcttggtttgaccatcaatcctctctactctccacaattctgtttctcccataattctctgtctctcccacaattccgtgtatctcccacaataccctgtattttccccgattctgtatttctcccagagttccatggctctcccataatttggcattcttccccacagtcccctgtctctcccacaattcttttttctctcataattccctatttctctcacaataacattctcctaacaattgttttctcccacaattctccattctattttttcttgaaaatctgttttcttctataatctattttattcttcttctttttttttttttttttgagacagagtttcgctgttgttgcccagactggagtgcaatggcgcgatctaagctcaccacaacctctgcctcctgggttcaaatgattctcctgcctcagcctcctgagtagctgggattataggcacccaccactacgcccagctaatttttgtatttttagtagagacggagtttcaccaggttggccaggctggtctggaactcctgactttgtgatctgcccgcctcggcctcccaaagtgttgggattacaggcgtgagccactgcatcaggcctcttctataatctattttctaccacaatctgtctctcctacagttctccattctccactctaatttgttctctcccacaagtctccattctctaccacaattccctgcctgtccctcaattcctcttctttcccataattctccattcttcccaataatcctttctttttttccacagttctctttctcacactaccttgagtcccccacaatcccaatctttcccacaattccttgtttctcccacaatccctttttacaatttttcataatgccgtgaatcttccataatacctggaatctcgcacaagccttgtctttcccacaattctgttacacagtaccttgagtctcccacaatccccatctttcccacaattactattttctcccacaatatggcttcatggttttccataaatgccttgcatctcccataatacctggaatctcccacaagccttgtctttcccgcaattctgtgtttctcccatagtaccttcagtctcccacaacctccatctttcccatgattccttttttctcccacaatacggcttcacaattttctataatgccttgcatttcccataataccttgcgtctcccacaattcctttcgtctgccacaatccttgcctttctccagcaatttcctgtttctttctcccacaatttctttctcccacaatccccatctttcccacgattccttttttctcccacgataaagcttcagaattttccataatgccttgtgtctcccatgatatcttgagtctcccataattccttttgtctcccacaatccttgtctttctccaggaatttcctgtttctcccactgtaccatatttctctaacaatttcttctttcccactcgtctcttctttctctcagaatttgccattctttttttttttttttttttttgagatggagtttcattcactctgtcgccaaggctgagtgcagcggcacgatctcggctcactgcaacctccacctcttgggctcaagtgattcttgtgcctcagcctccggagtagctgggactacaggtgcacaccaccatgcctggctaatttttgtatttttagtagagatggggtttcaccatgttggccaggctagtttcaaactcccgacctcaagtgatctgcccacttcggcttcccaaagtgctgggattataggtgtgagtcaccgtgcccagccaattctccatttttctatttcagaaatctttcttttgtaattgtattctctctataccatattctctctgccctgtaattccatttctcctacaactaattctgcaccataattccttttctcccaagatacagtattctctcccgccatttcctgcttttcccacaattgcagctctttcccacaattctctattcccacccatagtcctgtatgtttcttaccggtctgtctttcccacaatgccttgttttcccatacttctttgtttctcccacaactctgttctccacagttcctgtccttcacacaattccctgctctcccagaattccttatttctcccacaattttggtcattcctacaatcctctgtttcctcccataattccctattcatctcacaatctctgtctttcccatggttctctggtctctcccacagttccgtttctctcttaagtccccatttatccaataatctttgtctttgccacaaattctctatttctcctacaattttttattcttatctttcacagatctctttttctataattctactctctattaaattgtctcacatgcagttctttttcaatttttcattttctgccataatttctctccccaaattcaacattttcctccacaattcctgacctttctcacaatttcatcactttcccataactctctagtctttcccattaatcctttgtgcctggcacagttctcttttccacagtatcttgccttccacaattccttccccccccccccaattccttatattgcccacaattccctattctctctcacaattctctgttctctgttctctctcacaaatctctgttccctcctacaattccattttctcccatgatgttttgtattcctcacacttccctggctctccccaaattccctttctgtcccatagtgcctcattctcactaaaattcttatttttttctacatttttctgttctctcccacaataccctatctttcccataattctttttctcttgtaagtcccagttttccaccattttttccccatgagtctgtcctttcccataattcttggctctccctccaaattctgttcccttccgcacttttccattatcttccatatttctccatcattcttgtacatctccactgtttctcttctaagattctccttccctttttttttttgagacagagtcttgctctgttgcccaggctggagtgcagtagcatgatttcagctcactgcaacctctgcctcctgggctcaagcgattctcctgcctcaggctccctaagttccagctactttttttgtatttttcgtagagatgtggtttccccattttggctaggctagtcttgaattcctgacctcaagcttttttattttttaaattccatatcccaacaggcctctgttttagtaggttattaaaatccagcttttgaaatataaataagtattctctcagagcacttctttcaagacagcaaacacccaaagccccagcccttccccttcccgtgcctgttaccctctcatagtttcagtggaaccctgctgattcattcaaatactgacagcaacaagtgagtgggagagagtggggtgctttggaccagttggggcttgtttccacaagtaagctgtagagataaatgtgggcatatggaggaaggtagggaaggcaggagtacctgtgagggacagacccttttctggaacaggaggagtcatgcttcaaacaagagcctttggggcactcagtggctgcctttcaaggctgcttcttttcactgcctctgaaaagccatcatgttagcctggacttctcttcccctccataatttgcaaaatttctagtaagctgttagaccagccacctcccaatggcaaggccccttacctagcaccatgcatacacagaattttttcagcagcctgttctccaagtagcaccctgagacactgcccaagaattggacattattccactcctctgcaaaacccacccagctcaggtgaagtctcagcttgggctctgggagatcagctttcccctcagtggtctgctgttaccttcccctctccctaaaagtaacacgtggtgtcttcatcaactgtagttgctttgagggtgtggaagagaaaataccctagggccttggactttgttgagctggcgagatcaaatttaacaccttgaagtggagttgggccaggtgtcatgttttctatggttcatgctcagtgcccactggttggggtttcagttctaggacttcaaagatttcaggggatctgagaaaggcagttgagggcacaagggacatccaatatacagtcatgcaacacttaacgatgaggatacattctgagaaatgcatgttaggcaatttcattgctgtgtgaacaccatagagtttaaacaaacctagagggtatacccaactacacacctgggctagatggtacagcctcttgctcctaagctacagacctgtaaagcatgttactgcactgaatactgtaggcaactgtagcacagtaatacttgtatatataaacatggctaaatataaaaaagggacagtaaaaatgcagtattataatcttatgggaccactgtcatatatgtggaatgttgttgaccaaaaggttattatgtggtgcatggctgtatgtccaaatctcagatctgcatggggctgagagaatccaaacaacctacctggacttgcaaggctcattaaagagggccagttggaagggggttggcccttgggtaccatgaggtcactgggacgtgcatttcctgcagggacgttagatcttcacagattttgcaacaattgggaattagtcaacatcttccaacagcctggttgaattatcttctcagagacttgctcagccagcacgttccctgctcacagagacctttaagaccagcagagaaacccttggaaattcaaggctgctggaaagcactcattgagctgagcacaggcaggctgaacttgggcagctccctcccagcagaatttacttcaagaaagttgtcatgcataaatattctcttccatggagccctagggagaggatgaaagcactagaaattcttcaaagccacaggacccagaacatgtcccagagtgtgaggtcacgggggagtgtcctcagtccagaccttgatcacaagccaccatgtgacatcccagcccagagtctatttgaaaagaaccacagaaatcacaaaggagttcccatgaatccagatgtcctcataaacagtgtgtgaccctgttagaatcaagtatttttgaagtgccaccagcccccttccagcaagaatgttgctccggaactggaaggctcctttagaagttttcccagctggtgtctgggctccagaaaaagcagattcaccacactgacaaaaccaccctctccaccatccttgtcggctacccagactctcctcaggatctggctgggcgatctacggccagatccatcctccccacatccttgaatccctttacctgcccttcaagcagctcatcacacttgatctgagttactcagaccaagattatccaggactcatcttaatccaaacctgggaggaagatctgagtgtcgtgtcctcccacagcccacagtgcttgtgtgtgtgtgggcaggtgcatgtgtatgtgttggaggaacaccacaatattgcacttgcctttttttttgaggtgggatctcactctgttgcccaggctggagtgcagtggcatgatcatggctcactgcagcttcaaactcctgggcttaagagatccttccacctcagcctcccaagtagctggaaccacaggcacacgcaatcatgcctttttttttttttttttttttttttttttttaagagatagggtctatgttgcccaggctggtctcacactcaagcactcctcctgactcggtctcccaaagtgctagggttacagctggagccatcgtgcccagcccacacttgccttcttggtaatattgtcatctcttgctgtagctcaggcttccctaatcctttccaagtacatctctcctgatgtcacagtttctcacttcctcttttctatataactctaattttttttttttttgttccttaacatgtcctctcaaactctgcatgtatctcttttaaaattgtgcttgttcctgcccttttctttatactcatgtcttaatgagtgctccaaggtactagtgctgcatcccgttgctgtcaaggcacctatgtgactgtactgacccattccccatgtttattgggcaccctctacatgccaggtgttgtctggggcattaggtacactatggtgaccaagacacattccctgtccactgagactccactctagtggcagagacagaaagaaaaacacaaataatgacatcatattccagccaggtagtgggacgtgccatgaagaaaaatcagggaggaggtaggagcatggttttagagagggtgtcctgagagtcttcctgagcatgacgtaatattagaattgagaccttaatgaactgtaggagccatgagaaaatcagaagagctttacaggcagaaaaagagaggcaccaatgccctgtggcaggaccaagcctggagtgagagggagagaggcagtgtgcttaagggtgtgagggagctgagaggaacacagagtaagctgcagttgtcagcaaggcccatgggtggagggctttggaggctttttggagtgcagtcacttgccccatctgttgttaggaaggccactctctgttgtgtcttccacctgtgtattccccatgtgaaagcccataacctgtgttgcggctggagcaagtactctaggatatttggggattggaagaataattctgacattggttccaaagggtctcacagattctgaaggaagacatgttgctggaattgatgcaggattttattcttggtcactttgcaagctggggacctctggctggtgatgccccgcccaggcctcgctcggccatgctacctgttgcaggagatggcctgcccacccagcttgcatgggccaagtctggcttgcacaccagttctcaagttcttgtcccatgcccaagaagaatgaggatgcactgactatagaagagtgagcaaggcagggagttttgagtgatgaaactgctttcagcagaaaggggacacaggggtggtccccctaccagaaggtgggaaagtttccctaatatggctgagtctggggcttttatgggctcagaatcggggaggagcaggccttaggtagtactggaaaaggcaatgttcgattggttaaaaggcattattcagaaagaatcaattgagaaagggcaggaacagaggttctccctttgggttgtggatttcatccgttaccagcagtccagtctttcagacttcaggctgtttttggcttgaaggtggggtcgaaaccccaaaccagggacccactcctatctgcctaggcatttggctgcctcctgtcactatcagaatgatgactgacatccaggattactctttcgatgggagtgatgttaactttcatactgctgattgctgcctacgtttttctccctctttgtattgtgtctgctttttgtaaatcttgtcacattctggaaggacaggagaaaggggaagattgattaacaaataaagaaaacaggaccaaaggaaataatgaaatcaaaagaaagccaggtagaattagccccacatagttaaaatggattagtagtttggctttgggctttctaaatggggagtaaagagaaaaatgtgaccagttacaagattcttcatgatttaaaagaaaacattgggcacggaagcaaactgccatgaaatccaggcctgagaaaaatgtctccagcgatttctcatgaagggaatgctgagcatatttggacaaatatattctggtatttacaaaaatatcattcatcactttatcatcatatctagggtcacaatcagaaaaaatgagcccaatttgacagagttaccaggcatgtactactgtgtatttagttgggcattgagagatgagttttccatgagtagagttagatgctgacagggaggagctacttgctgaaaccatatggcatcgtccatgaaaagacaattgggagatggcatagttttacagagcggtggtctccctccctttgggcacttcctagaattgagtgtaggtagccaggcaaccatagggtccctgttgtgttagttaccatcctcagtagaagctgcaccagtggtcacaagagtgtgttctgctcctgcatcagacagcacgtgtcctggggctctgaaatcttcctaaaccaacagttgtgtcacctgcagcatctgtgccgcagtcacctatcaatcaactggcctagatgattctgtagggcttgtgtcatccgttgtaatgatttaataaaatgtagatggaaagttgatgtagatttccacccctcccacctttttttttttttttttttttttttgcagatgagatgaatgctaggactttgaccaaagttggtccatgaaaaactccatgcactgaatactgagcattttctgaagctgatgacaaacctgctaggacacagacacagtcagtcttttgtcttttcctctccaggttctgatgccagcacaattgaaattcacactgcaagtgaatcctgcaacaaaaatgagggtgaccctgctctcccaacccatggagacctatgaaggggatgtgctgggggtccagaccccatattcctcagactcaacaattcttgttctttagaactgtgttctcaccttcccaacactgcactgccgaagtgtagcggcccccaaaccttgctctcatcaccagctagagcttcttcccgaagggcctttaggataggagaaagggttcatgcacacacgtgtgagaatggaagagccccctccagaccactctacagctgctctagccttagttgccactaggaagttttctgaggctggctgtaaagtaagtgtaaggtccacatccttggggaagtagttaaataaaatagttatgactgagctctcagcctgacttggattctgtcttaacacttctagcaaaagaaaataaatacatgtacagtt

SEQ ID NO: 4232 - DNA, 40551 bp, human
caccgagcctggctctactgcaggcgctgggggttggggtgggggagaggcccagggcacatgatgccgcccccagcccgcccagcacatgacccaggcaggccggcggggtcctggcacacccgagccgcgtccgcgaacacagcccatggcctccccgcgcctagggaccttctgctgccccacgcgggacgcagccacgcagctcgtgctgagcttccagccgcgggccttccacgcgctctgcctgggcagcggcgggctccgcttggcgctgggccttctgcagctgctgcccggccgccggcccgcgggccccgggtcccccgcgacgtccccgccggcctcggtccgcatcctgcgcgctgccgctgcctgcgaccttctcggctgcctgggtaagggcgcgcgcggcccgcgggttggaatctgatcagcgcctgggtgagggcgcgtggcccgcaggttgagacccgactggtgcccggataagggcgcacggcctgtggatttggacctgttccgtgatggagtgaggacgagaggcccgcgggttggaacctgcccggtgcagggctgagggcgcgtagctggctggttgggacctgctcggtccccggctgagggcttgaggcccgcgggttgggacctgctcagtgctggggtgagggcgtgaggccctggggttgggacctgctcaatccccgggtgagagtgcgtggcccgcaggttgagaccggatcgatgcccgggtgagggcgcatggcccgcaggttggaactcgatccactcgggttggaacttgatcggtgcccgggtgatggcgcacggctagcgggttgggctggccgtcttaacacttgaaccacagagaaaagagaaagcggaggctgttccctagggaccggatgggacaactaggtaatttttttttttttttttgagacggagtcttgctctgtcgcccagactgaagtgcagtggcgcaatctcggctcactgcaacctccacctcccgggttcaagggattctcttgcctcagcctcccgagtagctgggggaggcgcgcgccaccatgcccgactaatttttgtatttttagtagagacggagtttcaccatgttggccaggctgctctcgaactcctgacctcaggtaatccacccgcctcggcctcccaaagtgctgggattacaggcgtaagccaccgcgcccggccgactaggtagttttgcaaacacatggtcggtaaaattcccatccaagggacgttgggttttaaaaaatccgtttattgtgtttgttatatggaaacttcagatggcgcagttaagcaaaacccagaccagaaaagatttcctcatttttgcccaactgcaccagggagagactaacaattaacttctctctgtctcgctctgtgtgtgtgtgtgtgtgtgtgtgtgtgtgtgtgtgtgtgcgcgtgtgtaaattcttttctattgtgcactatatattctctcgagtattttgtaagctgaaatcccttccctatccaggctttttgggtatggtttttacaccacaggtgcgcaaactgcagccctcagaccaaatcctgcccgttttctagggtccacgagctaagaatggttttacatcctactttttaaaaaattaatgattttgttttttgagacagggtctcaccctcttgcccaggttgagtgcagtgtcacaatcacagctcactgcagcctcgacctcctgggttcaagcgatcctcccacctcagctacccgagtagctgggactacagccacacgccaccatgctagggtaaatatatgtggggtctcactatgttgcccaggctggtctccaactcctgggcttaattaaaagatcaccacccttggcatcgtaaagtgttaggattacaggcgtgagccacctcacccagccctaaaatgtttttaaaaatcaaaattaaaaaatatttcctggcatgtgactattactgaaatttaaatgttaatgtctacaaataaagtttgatgggaacgcagctatgttgttcatgtgcatttgtgaattattcatggctgcctttaccctacaagggcagggtgaatattggactgagaaagtatggctcccaaagccaaaaatattaagaatgagtttgccaacatctgctttaaactattatgtgacactttatacagacctctcagctagatttggccattctgtttagctttttggaacatttccaccatgcgtaaatgcagtctataatagaaacacttacagtgaatccctgtacgtgggattcgtgaggtacgggtacccggctcatctgctcccctcttcaccctcctcactggattaatgtgaagccaatctcaggctccatcatcctgcccattcagatctcagagagagccctaaaacataataattctaaacatttgcaaccccaatatcattatcactttatttttgagacagggtctcactctgttgcccaggttggagtgtgctggcatgatcatagctcactgcagcctcgaacttctaggctcaagggatcctcctacctcagcctcctgagcagctggaactacaggcatgcatcaccacactggctaatttttgcattattttttcagagctggagtctcaccatcttgcccaggctggtcaaacttctaggctcaagcgatcctcctacttcggcctcctaaaggtgcggtggctcacgcctgtaatcctaactactcaggaggctgtggtggacggattgcttgaacccaggagttcaagactagcctgggcaacgtaacgagacccaggctctacccccaagaaaaaaaaaacaacaaaaaaaaggcccgtcatggtgggatgcacatgtggtcccagctactcaccaggctgaggcaggaggaccatttgagcccaggaattccaggctagagtgagctacgatccagcctgggtgacagccaagaccctgtctctaaaaaagtaaggtgtacccaaacatcttttgagggttagtgaataatacttgcatatcctttagcctttagaagggaagtggatgaggttgcgagcaaataagcagaagtcaggaaaaggctgggtgatcgggaccccttactgaaaaataagaaatttcaatgcccatgggatagggcttttattaagctcaaaggagtgataaatgctgaaaattctaaggcaccgtacagaagaaaggcattgtttttgttggcagtggcttgataatgagaagatgtcttgagctttttagtgttcacagttgtcgtttagtagtgtattacatagtgtgtgtttagtggtatattacatggtatgtgtttagtagtatattacgtagcatttgtttagtggtgtatcgcatggtgtgtgttgcatattatatggtgtgattttagtagtgtattgcacagtgtgtgtttagtggtgtatggcatgtttaccagtgagcactactacatagtatgtagcttggtgttgtttacagttctcccctttatattacctagcatacttttttttttctcagatggagtctcactctgtcgcccaggctggagtgcagtggtacagtcttggctcactgcaacctccacctcccaggttcaagcgattcttgtgcctcagcctcctgagcagctgggattataggtgcccaccaccgtgcctggctaatttttgtatttttagtagagatgtggtttccccatgttggctaggctggtcttaaactcctgacctcaggtgatccacccacctcagcctcccaaagtgctgggattacaggcgtgagccaccatgccaggctctttacttttcttttctttttgacacagggtctcactctgtcgcccaggctggagtacagtggtgcgatctcgactcactgcaacctccgccttccgggctcaagcgattctcccacctcagcctcctgagtagctgggaccacaggcgcgtgccaccacctccagctaattattgtatttttgtagagatggggttttgccaggctggtgtcatctcctgggctcaagtgatccgccggccttggcctcccaaagtgctgggattacaggcgtgagcaccgcgctcagaccctagtgtacttttaaacaacggatattgcattacctaacaaagaaccataatatgtaccatgagtgtgcatactgttttgaggatattagacatttgggtctaatagcaagagaaactcacaaagaataaatgttaaaggcaaattattgagaattaatttgtgaaaattttaaatgttgtgtttaaaaaagaatgaaggaactatatattcaaacttctaaattgtgctttttgaaaaattcttttttatgtgaggaataactaatatggccactgaaaatgcagccgagaaatccagattgctagtcacatattgcaagtaaaccaacagacaaacaaaatagggatgagactgtggccaactatggtttgcgttaaagtgcctgcgtttgttttgctaccataagttattttctgagtttcaggccaggcgcggtggctcacgcctgtcatcccactttgggagaccaaggcggacagatcacttgaggtcaggagtttgagaccagcctggccaacatggtgataccccgtctctactaaaaatacaaaaattagctgggcgtggttgtgggtgcctgtaatcccagccactcgggaggctgaggcaggagaattacttaaacctgggaggcggaatttgcagtgagcagggtttttaccactgtactgcagcctgggtgacagagccagactccgtctcaaaaaaaaagataaataaaaaataaaaataaaaaaaagttattttatgagtttcaatcttctttttctctctctgcacacacaaatatgtatgttttttcttcctttcttccttttccctccttgtctttttccctccctctctccctccctcctttccttccttccttcttccttcctctcttcctatctctatctattatgtatctatcatttttccaaagcaagaagtcagctttatatttgattaggatcagatacaaagtattatccaattctctcttaggtatggtgatccggtccaccgtgtggttaggattcccaaattttgttgacagcgtctcggatatgaaccacacggaaatttggcctgctgctttctgcgtggggagtgcggtgagtccaccccctctgcatgccctctcctccctacttatgctcctcaaatcgcagcagcagcaaaccctgggagtctgttagaaatgcaggttctcacgtcctgccccatcctgctgatcaggaacccagccctctctgttttaacaaaaccctccaggggatgctgcccagacactcaagtgttgtttctcccacctcttcacaaatgcatcctccgcttacatggggccacgagcaaaaccagctggcacagaaaaagttatcaatccattggatgcattttgtataaatatatacataaatatattaaataaaacatacaagccgggcacggcagcccacacctgtaatcccagcactttgggaggccaaggcaggtggatcacttgaggccaggagttccagaccaccctggtcaacagggtgaaaccccgtctctactaaaaatacaaaaattagctcggcgtggtggtgtgtgcccatggtcctagctactcaggtggctaagacaggagaattgcttcaacccgggaggcggaggttgcagtgagccaagatcgcgccactgcactccagcctgggtgacagagtgaaactccatcttcaaagaaaaaaaataaaaccacataattatatataaacaaattattgaaaaagtaaatagatatcatatatacacagacacacatacacatgtatgttatgctccatccgtcacggtggtgctcaggtgagtgatttgaagcacattccctgatgctgtgttgattgccctgtgctggagcagaattgccagtttccttgcttccctgtcctcagtggcttcctaactgcatctatggaggctctgtctcagcccgcagtggcgagacatcttgaccttgtgtcgtttctaacactggagtccccttactccatcttctctttggaaggactgcctgagtccctcctccccgtactcattcttcctcagaacaagagcttctatctagttcaaagcccccttgagcctgcacctcagtttaaatgacatatcttggaacttcatcctccctgcatacaagtggagcagaaggcatagttccttagtcaaatctgaatgcctacacctatcccaggccacaccctccttggtcccaggaactgtgcccacttgtgtcccgagagctgtcacgtgcggcttcctgacgtcagaggaagccagtgtctaccctgccgtctcaaggatgggctgggcttcttgtacctgtttccagacattttgatgcaggctcttcccgattgcagatgtggatccagctgttgtacagtgcctgcttctggtggctgttttgctatgcagtggatgcttatctggtgatccggagatcggcaggactgaggtattcaccgaggaaatgggatttctgccctagttctattttagagggaagataagagatggcactgagcgtttaaaagtattttgcagtgttgcagacaccgtcattcagaatctgtcagctggcccctccgcctagaaacatccacagcagctcatttttataagaggccaaaggcacatttaaaatattagccaggcacagtggcttgtgcctgtaatcccagctacttgggaggtaggaggattgcatgaggccaggagtttgagaccagcctgtgaaacttagtgagagtccatctccaaaataataaaagaaaatcttgaggattttaaaaaccttgaaagcaagtaattcaataaatgaaatatttggaactggacaaatactaaaacagaatgggcatgtacataaacaattttattgtttattttttactttttagaggcagggtctcgctttgacacccaggctggagtgcagtggtgagagtatggttcactgcagcctcaacctcccaggctcaagcgattcttccacctcggcctcctcagtctgtagctgggactacagacatgtgccaccaaacctggctaattttattatttttgtagagatggggtcttgctatgcagcccaggctggtctcaaactcctggcttcaagtgatcctcctgcctcggcctcccaaagtgctgggattacaggcataagccactgcataaacaattttttattatatttaaaggttcaaaggatgtatatattgacacttcatgctaaatctggaacctgagaatgccggggctggaggtggctgcttggcagggagttactcagtggctagtatctggggcactggtgtgtttgaactgatgcccagtcactcgtgagctgtgtaactgttggcgagttgtttaacttctctggacttctgttttctcagctgtgaaatggtacccaccacacaaggtcactgtgaagagtaaatgtgataacccctgtatatggttaagaacagtcctgaaacgttgccagctcttgatacctatcagctgttacagtaggtgggctgcacatgtgttgaggaaacatccacatagaaagctgaactgacacagagaagctggatgtggcatggcagggctccaaatccaggaagcatttgcccccaccaagttcatggtccacttgattcaggtcccctttgaagggagcccctccttgcctgttttttgttctggtttttgtttaaatacagctttgtaggccaggcacagtggcttacacctgtaatcccagaactttgggatgctgaagcaggaggactgcttgagcccaggagttttgagaccagcctgggcaatacagtgagacccatctctacaaaaaataaaaaaaagatagccaggcatggtggggtgcaacggtggtcccagctactcgggaggctgaggtgggaggatggcttcagcccaggaggtcaaagcacatgatcgtgtcactgtactccagcctgggcgacagagtgagaccctatctcaaaaaacaatagaaacaaacaacaacaacaacaaaaaacccagctttataaaggtcacctgtttaaagcctaaaatccagtggtttttcgtgtattcacagaattgcataaccatcaccgttatcgatgttacaccattttaatcatcccctctacatctctgtggtggttattagtcactcctcactgccccctccccacagcccccagcaaccacttatctactttctgtctctgtggagctgcatgttctggacatttcatagcaatggaatcatacagtacgtgacctttcgtgtttgggtttttaactcagtgtaacattttcacggtttatccgtgttgtcacatgtctgtgcttcattcctgttatggtctgaatgtttctgtccctccaaaaattcctgtattgaaattctaacccctaaggtgatggtattaggaggcagggcctttgggaagttattaggtcataagtgggatcagtgcccttgtaaaaggggccccagagagttccctcaccccttctaccatgtggggacacagcaagaaggtgctatctatgaaccaggaagcagggcctcaccagacatcacatctgctataccttgatcttggactcccagcctccagagctgtgagcaataattgtttataagccacctagtgtgtgatattttgttatagcagcctacatggactaaaacaaccccttttcattgctaaataatattccagtgtaaggctatactacattttgtttatccatttatcagttgatggacattttgtgtgcttccattgttttgactacttccattgtttggctactaggaataatgctgcaactgacatttgtctgcaagtgtttgtgtggacatatgttttcatcacatattcctgagtatatatctaggtgtgtaattgctgagccatgtggtaactctaggtataaccaggtaagaaactgttaaactgctttccaaggtgagtgtaccattttacattctagcagtaatgtgagggttgcagtttatccacatccttgtcaatacttgttattatctgttttaattttagccatcctagcatgtgtgaattggtagctcctcatggttttgatttcactgatgagtaatgatgctaagcatcttttcatgtgctgattggtcatgtatatatcttcttagagaaatatctattcacctcttttgcacattatttcattgggctatttggttttttattattgagttgtaggagttctttatatattctagatacaagtagcatattacatacgtgattcacaaatagtttctcccattctgtggtttgtctttacacctacttgatgatatctttcaaagcacagaagtttttcattctgatgaagtccaatttttctatttctttccttgatttcttattcttttgttgtcatatctaagaaatcattgcctaacccaaggtcacaaagatttagacctatgttttcttatggtttgaatgcttaaatttaggtccacttagaatttttgtgcacaggtgactaatgggtccatcttcattattttgcatgtggatatccagttgtcccagcaccatttattgaataaatttacttttaaagccaatatcagtaaatagagatcatatgtaggctatagaatatattgggtaatcccagtagatccccgctctaaaatcattgacattccttatgtagatcacatcatcaactttggtctctctggcctgaagtttagtgcttacttcatttttatgcttgttccttccatctttttaccttagctcccaaactcttacacatctgaaccaaactgagatatgcctggttgtgaaaattctccagggaagatagtcaaggtcagagccagccaattaggtgtatcagtgaagattcattttggctacataaaatatatataataataatgacttaaacaaggtagagatttctctttcatgctaaagatgtccagaggtaggcaatccaggacacttgtgatggacatcagggacccaggttcctttgattttcctgcgtcactatcctatcgtgtgacttccatcctcaaagtgtcatggcccaatatagctgctggtgctccagtcatcacacctacattctgggcatcaggaagtgggaagagagcaatgcaatgcaatagaggcctgtgttcccctgagccagctttaagtagtgtcttgggagtttcatacaatgccagttacatattatcggtcagaagttagttttttttttttttttttagatggagtttcactcttagtttcttttttcttttcttttttttgagatggagtttcactcttagggtgaaaaagatagagtttcactctttttgcccaggccagagtgcaatggcacgatcttggctcactgcaacctgcaccgcctgggttcaagcgattctcctgcctcagtttcccacgtagctgggattacaggtgcctgccaccatgaccagctaatttttgtatttttagtagagatggggtttcgccatgttggtcaggctggtctcgaactcctgacctcaggtgatccacccgcctcggcatcccaaagtgttgggattacaggcttgagccaccatgcctggccagaacttagtttcatgccacacttagctgctaaaggaggtaggaaatagactctgtgagccgagcatgcagctgccctcatgacatccaggttatgttactgagggaaaaaggaaatatggctttgagtaggtaatcagcagtgtgatacagccatggccctgcagctctcatgattggcatgtctctgagcatccctcagtgttggagaggtcggaggtctgacacaactgtaggtcttatagatgccagttatgggtagaagaagcgtctcagagtgctggaaggaagctgggagaaaagtaatgccctctgctgccatagaggatatattacttcacctccacccacggtggggatgtgggggaaaagggatggggtcccacagggcaatctgagaactgtctggacccagaggacagacagggccctgagaagctgggacaggcaatcatgaagccctccttaccccaaggatagtatttgggagttcatttggagctcagtgatcagaaggcaggatgttgggaccaagggtcttcagccagtggggggcgcaggcttctcctgatctgctgtggattggggttcagacttctgccccggtgtgggtttcagaggcccagcccgaagtcagggtctggaatgcagagattctgcactctcaaacacccagccctttgcagaaagcctctccgttagttatctgagtctcatacagagcttctggttcctggcccacattgctgagacatacccccaaccctcacccgctcccagcccagccaggctagggaagagccatgccaggaaccagtcacagtgtgggaggcaaaacatgctggaagtgtttcttttcctcccgaagctctttgggcttgtttctttcctcttgtctcattgtagaagggtgtcctttctcactcagatccctttgtctacacagctgatcttccaagttgaagtcccgatggggtgggggttgtgatatttgccaggaatctggtagggttttgagtgacagccatgcatcccatggagctccagccccctaccccacctcgtcccatcagacaggagaggcaaacccaagactggatggcaccagtcagctctgcagagcttccatcttcagtcttcctgcggcatctggaaggctgcggcctcaactcctgggggaaacggggtggggtgtatggaagtacaaagatgaaagctagagactgtgcaagaatgccagctgtgcagggaatggggaggcgaaaggcaagtcccccgctctcctctcgggaagcatgtagtagctgctgtttctgcagagacagccttcccaggtgggactgagcattcagacttggctattaggtgtggaggtgactctggaagggcttggggataggagctccttgcttatcgggtgagccaggtattcaggaggcataaggcctctctcgctggggggctgtgagggcccacacagctgagaaggaaccccacgttcatgtccttctgttgggaaacctcaggttcaggtttgctgcagatccacctggattcgcttccatgccagaggatcaggtaggaaaaagcaaaccagacaagcccaagcacagctcctcctccctttctgacatctccataaaaaactttgcagtcacagccattggctgatttcttctctaagctatcccctcatcttttataactgggttttttttttttttttcagattctgtttttttcaattatttttatttttatttatttatttatttttttgagacggagtcttgctctgtcgcccaggctggagtgcagtggtgtgatctcggctcactgcaacctccacctcccaggttccaggaactctcctgcctcagtctcctgagtagctgggactacaggcacctgccaccacacccagctaatttttgtatttttagtagagatggggtttcaccatgttggcctggctggtcctgatccacccgccttggcctcccaacgtgctgggattataggcatgagccactgcgcccggcctttttcaagttttaaggtttatcttgttgcaaatttttttttgaatagatgaaaagagcccttcagtaggttatcagacttacacttaaactgacatggtcctgtggcccacagaggcttctgtgacccagtcctcaacacacggcgctccctctgtcgtctctcaccctccccactccagccacgcccagctcccagcttctagaaggcgcctgtattcctttttttttctttctttcttatttttaatagctgcatctcactctgtcatctaggctggagggcagtggcatgatcacagctcactgcaaccttcaactcctgggctcaagcaatcctcccgcctcagcctcctgagtagctggggctacaggtgtgcacctccaggccaggctgcagctcacattctttgacttgtggccttttcctccatcttcaaagccagcaatggtgggttacgtccttctcaaattccctcctctctggttctctgcagctgatagtctctgcttttctggattctggcagttacattggcccaacccagataacccaggatgacttccttatctcaaacatccttaacttcatcacacctgcagagtctcttttgccatataagggaacatattcacaggttccagaaattaggacagggacatctttagggaaatgtatttgggctatcacaagtgtttatccactctaacttataaacatagtctctgccaggcatgttggctcatgcctgtaatcctagcactttgggaggctgagatgggaggattgcttgagcccgggagtttgagacaagcctgggcaacatagcaagactccatctctactaaaaataaaaataaaaaagttagctgggtgtggtggtgagtgcttgtagtcctagctacttgggagcctgaggcaggcttgagctcaggagtttgaagttactgtgagctatcattgtgccattgcatgccagtatgggtgacagagggaaaccccatctcttaaaacaacaaccaccacaaacatagtctcatcttttagattaatcacagctacgagcctgacttcatgtaaaatcttctccatccagctatggcctctggggctggcccccagcaggggcacaggctggaacattacactgattcttctatgtcatcctctcaagatggtcactcccatgcaggcagggattctgttttttgtgcctagaacaggcatgatctttgctcaataaacattcagccaatgtacactgagtgagacatactgcgctgatacaactctgtgattcttttagttgagacgtaacttaaatactgtaatatttgccctttaaacgtgtgcagttcagtggcttttagtgccatctgcaaggttatacatcagttagcctcactattactagttccagaacatttctaccatcccaaaaagaaaccctgtacccattagcagccacccccatgtctgcacaatcacacaatatgtgcaccctttgtgtctggcttttcactcagcattgttgctgaggttcacccatggagtagcatgcattagtacttcattcctttcaactcgatattaccttcgcacgtgctgacagccatcttgtaggttaagggtgtgggaagtgtttcctatcactggcccctcttctgtagagaatgtgcaccggaagggaaatcccagagtaacagcgctgatggtccagtacatgtctccacctccctgagcacaggatgctggtaaatcccattgctggggccgcctgattgtcctcaaagtgaagacagctgggcatccagggcaagcccagccttgtaggaaagtggaggtgggcggggacggccagcctgccctggagggcagcgtaagtagcagaaagcagccaggcctgacgtccacctggccccttagcgtagtggcacaggaaggccgcagagggtttccgtgttcacccagctgagaggagcaactcacggctctgagaagtgggtctggccgaggtgatgcagctagttaatgtgccagctgtttgcattcggttcaaacctgttgagcctcagagcatcctcctgggatgaggctgtaagaggagtaagtggggaggctgggaggagcacctggcgagtgctgtgcccgtgaggtgcagtcttagtccgtccaggctgctataacaaacatcacagactggcggcagcttataaatagcagaaatgtatggccgggcacggcggctcatgcctgcaatcccagtactttgggaggccaaggcaggtggatgacttgaggtcaggagtttaagaccagcctggccaacatggtgaaatgctgcctctactaaaaatacaaaaattagccaggttggtggtgggcgcctgtaatcccaactactcgggaggctgaggcaggagaattgcttgaacccgggaggtggaggttgcagtgagccgagattgcaccactgcactccagcctgggtgacagagcaagtctccatcttgaaaaaaaaaatgccatctgacccagcaactccactcccacgtatacaccccaaagaactgaaaacaggaacccagccaggtgcagtggctcatgcctgtaatcccagcactttgggaggccaaggtgaggggatcactgaggccaggagtttgaaaccagcctgggcaacatagtaagacccatctctacaaaaaaaaaaaaaattagctgggcatggtggtgcatgcctgtggtcccagctacttgggaggcttaggtgggagggttgcttacgcctaggaattggaggctgcagtgaactatgattgcatcactggactccagcctgggccacagagtgagactctatctcaaaacaaaacaggaactcaaacaaatactggtacataacacatgttcatagcagccctactcacagtagacaaacagtggaaacaacctaaatgtccattgatgggtgaatcttggcccatgtatacaatggaatggtattcagtcagaaaaagggaagaaagggccgccgctatggctcacgcctgtaatcccagcactttgggaggccgaggcagggggatcacttgaactgaggagttcaagagcagcctggcaacatggcataacctcatctccacaaaaaaatacaaagaaatagctgggcatgatggcgtgtgcctgtggtcccagctactcaggaggctgaggtgggaggattgcttgagctcaggagacagttgcagtgagccgagattgcaccactgcactgcagtctgaatgacagtgcaagaccctgacccctaacccctacaaaaagaggaaagaaagggcacagtggctcatgcctataatcccagcaatttgggaggccaaggtgggaggattgcttgagatcacgagttcaagaccagcttgggcaacatagcaagatactgcctcaacagaatattaaaagaaacaagggaatgaagaaactgatccatgctacaacgtcagtgaacctggaaagcattatgctgagtgaaggaagccaggtgcagaaggccacgtagcatatatttccatttacatgaaatatccagaacatgcaaatccacagagacagaaactagattagtggttgctaggggctgggggatgggcaaaggggagtgaccatttatattagcctcttctcacactgctatgaagaactgcctgagactaattgataaaggaaagaggtttaattgactcacagttcagcgtggctggggaggtctcaggaaacttacaatcgtggcagaaggccaaggggaagcaggacaccttcttcacaaggcagccgagcgattgggggccggagggggttggggggggagggaaatccccttataaaaccatcagctctcgtgagaactcactcactatcacgagaacagcatgggggaaaccgcccccatgattcaattacctccacctggtcatttccgtcctccaaccacctaaccaattgatttccatccaacagtgattagttcaacttgttctatcccttgggattttggagattacaattcaagatgagattcaggtggagacacaaagcctaaccatatcaccaattaatggatatggggtctccttttggaatgatgaaaacattttggaaggagacgctggtgatggctgcagagcattgtgaatgtactaaatgccactttgttgttcactttaaaatagttaattttatgtgatgtgaatttcacctcaatggaaaacaaccaaccaacctcagcagcacgaggaaactctttgccgaggggctttcctctgtgtacattttcctgacctttccagagcgcaggagctggcctggcagttccaggcaggcctctgtgccccactgagctgtggctgctgttgtgcttgtcccctagcaccatcctgctgtatcacatcatggcgtggggcctggccaccctgctctgtgtggagggagccgccatgctctactacccttccgtgtccaggtaagttgggactccagcgccccaggcagccccatccttggctcataatgtgttgtcttgcagggaatacatgagccccgacccacagagtgggtgccttggaggttaggccgttgtctcagggccacatgaggccatgctcacggcccagccccagagggctgactacaatagcttggagaatgaccctggaatcattctccctggctctgcctttctcgtttgtgtgcataggcacccatgcacacaagcatgtaggcaaagctttccgcatatttccctccacgtaaggtgtattcccagcccctgtattggtacagttttctcatgcccactcttaagtatttggtcttcaagcttcctctggatgagcaggtgagcttaacattctaggaatgagtgtaggataatgtggaagaggccataaggatccctgggcagagcttattctctagctttgcttcctacgctttctcacttctcttctatcctccacacagagggagatgtggccgctggaactgtctcaagcatttcctcaagtttacattcctgtccatgcaaccctcagttgcaaagccaaggtctttccaaggatatatactctaacttccaatggaaaactggaaaatggaagtggacagtgtctttgtctgtgatttttataccagggatcaacacagtgtagccctcaggacaaatccggcgttcttccgtttttgtaaataaagttttattggaatatagtcacactcatttctttatgtactgtctgactgcttttgcatgacaacatcagagttgagtagttgcctcagagaccacagtgtggcccatgaagctgaaaatatttactatctgttcttttacagaaaaaaaatcgacagaaaaaaattggtgtagataatttatctccctcttctcttgcttcttgcggctactcagtgaggatgtctccaaattggtgttgccttgtcaaccatgaatacaagcagggagctctgtatagatccatccatacattctgcttttctggggaactttaaaaggacagatgcactgtcagcagctgttataacggaatgcacttagttggaaagggagtttctgtgactctccctcgcctgtgggaccccggagactcctggcaaagttgcatctgagccttagggtgccattgctgcagggcgcacagggagccttgaggtgctcccagggtctttaggagctgtaccttttaagcatcttatccttaatcatctcttcattttcacaacgcctgacccagggcgctcggtgttcttcatgctcacagtctcactctcttatttgtcatttcctttctgtctttgcatcggagtcacttctctttctcctcttgtttctctttctcctttcaagcctttccagattgaattttagcctctacagctaaagataaaaccgcctgttaaaagaaagtggcagcgttgagaggtggtatagtaattcttcctatggcaagaggagacgggtattgcatttttcccacctgatttttttttttttttttttttttttttttacattttctgccactttcccctctggtttgacaactccgtcaatattaagggtgtttaatttattttttgtcattcccccttccgtggccatgaggctgtttggttagccccttttccacctccctctttggttgagctggagcagacctccctcccctttgccttcagtttcctcttcctctgtgccattttgcttctctcctacattaagcatttcgcagctgagagttgttaccttggtaacatatgtttgtgaggccctccagcacattctgtggtgaccagtgactcctatgacccctcagtagaaatctttgtccttttctctgacaagaacctctgaaactattgttatccataaccatgagaacacatttcctctgaaatatgcagctggcatattttgagttgttcaagcccagggacaagattttattcatgttattgcccaaaaccatgtagtaagtactcaaaacctcactatttaatggagtgcctttgtctctacttgaattgcgttttttccttgagacccagtgcagggaatcccccatcccagggtgtttttctttccgatcttttcccagcaggaacctttaaaagcttcctccagtggaatgccttaggggtcctcccatttctgagacagaaacatggttgatctcccttactctcctgcaatttatggcttgttccagacatgagaaatgactcacatttcctttgggcagtcagcagcagatttatgcatttccctttttgttctcatcctcttatcttgacttccagataagtagatgtcttttagccaaaactttgcttttgagaagaatgactttggttttcctctctcaggtgtgagcggggcctggaccacgccatcccccactatgtcaccatgtacctgcccctgctgctggttctcgtggcgaaccccatcctgttccaaaagacagtgactgcaggtaaatactagggaagctctctgggtacacggccactgggagcggccccatgcctcgggctcagacagtgacacatgttgtcctggaattctccaggacagttgacctcatttgtcatcctccagagacatcagcagaacacagctgcagaaagtaagcaggttcaataaatgaaaatgtgcaggcctctgcccgcacaagttctgtaccatcgtttgttagctcagtgccaggactagttgacttttcacttctgtactgggcttctcctgggtcggctgcaggagtgcccttggacgactgtggaggtgtgagaggaacagaaggagaagagaagggagggggaagggactgagtctgtactgaggcggctccagccccataatgcacttggctgatgttttttctcagatgggcaggaaacaggaagtggagcacaggaaatgagtcaaggtcaatggttagaaaaggataagagtaatgaagtcgttggcaacatgtctgggaaagacttctaggctggggctggagacctgcagtccagcccctactttcccctcaaggaagtgtgtcctggagtgagcctcccacctcctcaggctgccagagatctctcaaggggagaatgggaataaggaaatttgccttaactgagaggtcctttgaagatcacctgttgattgttgaactttttaaaaacattgttgagagtactctatcattggtaataggaaattattgtgattcttcggaccattctcttcatatctacactttttgttttcattgagacggagtctcgctctgtcaccccaggctggagtgcagtggcgtgatctcggctcactgcaacctctgctgcccatgttcaagtgattctcctgcctcagcctcctgagtagctgggactacaggcaagcgccaccacgcccggctacttttttttgtatttttagtagagacggggtttcactatgttggccaggctggtcttaaactcctgacctcgggtgatccacccaccttggcctcccaaagtgccgggattacaggcgtgagccaccacgcctggcgcatatctacatttaaatatagtgtgttaaatatagcattttaagacaaaatctcatcaaaaatagtgatttgagctgatggaaatgacttatagaaaaaagactgaaaagaaatacactaagatgttaacagtggttacctctgggtggacggaccatgggtcattcatacttctctaaacttttaaatattttctaacttgtctataagaagaaattaaatttttttcaatattttaacaagcgtgcactatttttatttttttgagatggggtttcgctcttttgcccaggctggagtgaattgacgtgatctcggctcactgaaacctccgcctcccaggttcaagcgattctcctgcctcagcctcccgagtagctgggattataggcatctgccaccacagccagctaatttttgcatttttagtagagatggggtttcaccatgttggccaggctggcctcgaactcctgacctcaggtgatccacctgcctcagcctcccaaagtgctaagattacagttgtgagccactgcacctctatttttataacagagaaaatgagcttttaaaaatatagtttctgaactaggagcattcaaataaaattgggaatttatttatttagttattttgagacggagtcttgctctgtcacccaggctggagtgcagtgatcttgcctcactgcaatctctgcctcctgagtccaagggattctcgtgcaccagcctcccggatagctgggattacagacgtgcaccaccatgcctggataatttttgtatttttagtaaagacagagtttcaccatgttggccaggctggtctcgaactcctgacctcaaatgatccacccaccttggcctcccaagtgctgagattacaggtgtgagccactgcacccagccaaaattgggagttaacatagtaatgtacctgtgttaatttcatagttgtgaagaacatccccatggttgcataagatgcttacattgaggggaatctgggtaaagggtagggatatacagggactctctgtgctatcttttatctttgcaacttttatgtaaatctaaaattatttcaaagcagaagtttaaaaatatgtatattccttagggtctatgaggactccaacctggaagttgtgaggaatgaatgtcagtgacttgctttgcttcctgcccctctggccttgcttgtgggctcacacctgcttccattgccttctctgtcactccgtaaacatgaataatgaacaccatacatagttccttctgttcttcacagtggcctctttacttaaaggaagacaaggcatttacacggagaacgagaggaggatgggagccgtgatcaagatccgatttttcaaaatcatgctggttttaattatttggtaacctttcttctatatatgtgtatttttattgccagtgggaagggctatggaaacaacttgccatgttgcatgcgtgaccagaagttccaaagggaagagcctttgggaaggaaatctttgagactgtgctaggtgccctttgaggaaaggcacagaggacaggggagcaagtccaaaattcatgaatttctggaaaaacattcaaatctactcaaattatatataaagcccttagaaaacgaacacccaagtttagttttgaaatgtcccaaccatgtgcattgctggggttaaccaaaacaaaggggttgcgtatgctttttttttttttttttttttttttgagacagggtctttctctgtcacccaggctggagtgctggagtgcagtggctcaatcacagctcactgcaaccttgatctttagggctcaagtgatcttctcacctcagcctcccaagtagtcttactctgtcacccaggctggagtgcaatggcacgatctcagctcgctgcaacctccgcctctcaggttcaagtgattcttctgcctcagcctcccgagtagctgggattacaggtgtgtgccaccacactcagctcatttttgtatttttagtagagttgaggtttcaccatgttggccaggctggtctcaaactcctgacctcaagtgatccacccgtctaggcctcccaaagtactgggattacaggcgtgagccaccacactcagctggtcatgctttataaactcacccatttgcctcactcctgacaccagaattcctgtgcctgacagaggggcaagggcacgtctttggtcaagaaggttggagaacggcctgagcagtttgtctctcctcatttttccccaccactggtatcctgtccaaacctttcaggtggatactttgaaaacagacctgtaaccaatgcaaaaaataaaactggaatcagaacatgctgcactgtggtgaatcagtaccttgcaggcagggcaagtacttatgatgttaaaaattcacctgcgcgggtcgtggtagctcacactttggtagttggaggcaggagtattccttgaggtcaggagttcaaaaccatcctgggcgatacaacaacaacaattagccaggaatggtggcacatgcctatagtcccagctactcgggaggctgaggcaggaggatcacttgagcctaggagttcgaggctacagtgagctatgatcatgccactgctctccagcctgtgtgacagagcgagaccttgtctctaaaacataatagtaataataattcacctgatatgagctttgtttggacacctttcttggagatacataaatcatctcctactaaaaatacactcagttcaacatttcatatttcactgagccacctaaaataacattgaaaaatactattataaaatggcaagaaaaaattgttttgatctccatgaaaactgtacgttgctcttcaaacaaaaaatgaattctgggttatttgatacagtgctagaaccttacaccctgatgtggtgttgagtggtaccattggaaggatttgctgatctgtgctttagactgagaaaacgaattatgttttttaaattaaattcttagtgtgctggttcctcttagtctcatttcttttctttttctttctgagacagggtctcactttgtcccccaggctggagtgcagtggcacattcatagctcactgcaggctcgatttcctgggctcaagcgatcctcccaccccagcctcccaattagctgggactacaggtgcacaccaccacacctggttaatttttttattttttatttttagtagagacaaatttcactgtgttgcccaggctggtctcagactcctgggctcaagcaatcctcctgcctcagcctcccaaagtgctgggattacaggagggagccattgcacctggccctcttagtttcttactgcagaagtggccatgtctataccgggagttggtacttttaggtcttggtagaaattcttctctgactctccagcatttaaaaacgagtttcattgcatgttctctttacctgctgccattttctttctaacagttggttgtcgaatatcatcaatgaaagccttttattctatcttgagatgcaaacagatatcaatggaggttctttgaaacctgtcagaactgcagccaagaccacatggtttattatggtaggtcaatctatattttattttaattagttaattatttaattaatttgcttcagagacaaggtctcactctgtcacccaggctggaaagcggtggcatgatcatagctcactgcagccttaaactcctgggctcaagcaatcctctgtcttggcctcctgagtaactgggactacaggtgtatgcctccaccctgggcaatgtagggagaccccatctctttttttaattatctatatttaacactttctgcttgaaaaaaaatcagaagaaaaagaagcagtcagaagtacaatatattatatttaaatacaggatgagcaaaataggctcctggccttagtgtgctagctggctgttttgtttgttgtcgggatccttattaaatgcttcaactctggtcaaacagtttggtgcagtgtatcaaagctcctggcagtctcacaatatcagagcatggatcttgaaggaatgcttcagaccatgaaaaagccacacagatgaagatattcctggtagcattatccttcataattgtaaagcattataggcaacctggagttccaaaaaaaaaaaaaaaaaagaaagaaagaaatgtttaagtaaattatggtctttcatcttgatggactattactcagatgttaaaaatgatgattatgaaatctctggtattaactgggaaatcaaatatatacaattataccaattacaagtacagaaaaacatgtttatcttttttcaacggggaaacaatgaaaaaacacaagaaatgaaacagaaaaaaaattcatgtattggatggacatacatgaagagaatgatggggtagaagccccatgggcaagttgccccagtgctgccattctctcacctttataagaagaaatgcacacgtgttgttggcagggaggtgcatattgtactatacagaatccatatttatattgcttttgaaatggggaaagtctcatttacaaagactttcaaatggagccagcaccggtccttccatccctgcacgtggtttggagcttggctgggttcctctggtgaactttatgtgtccttagcacacaagagtggagggatgtttcccagactccgtctgagcctcaggaacctttattacatcaagtgctcccttggcagcacagggtggcaaactggggagaacagaggcccccaggctgcaggaggagctggctgttcagtccctgtgctacagcgctccctctccccttctcccactgctgccctcttctcctcccccaccctctcctcccactttctccttctcctgtcttccctcctctctcttgtcctctgtcccctttcttcccttctctactccagctcctccccgtcccctcctctccccactcccctctgctttcaggcacccttgaaggtacagcacctactgtggccaatcttcatcttgccccaaaccaacccaccaaccagtcaaccagccaccagccaacccatggtcccttccaagcgagtccagccctgtgggcatcctggggggagtgtgtcactctgtgacagcccagggctctgacttctgctacgctgcactgactgccatgtgtctttctgtcctctctccagggaatcctgaatccagcccagggatttctcttgtctttggccttctacggctggacaggatgcagcctgggttttcagtctcccaggaaggagatccagtgggaatcactgaccacctcggctgctgagggggctcacccatccccactgatgccccatgaaaaccctgcttccgggaaggtgtctcaagtgggtgggcagacttctgacgaagccctgagcatgctgtctgaaggtaatgccctgtctgccacagcaggtagacttcggggtcccagggctccccttggaaagccttagaggattctttgtcccgggggctgtcctgtgcatggcggggtgttcagcagcacctctcatgtgaactcactagcttccagttgcacctccccaattgtgacaaccaaaactctttctagacattgacaaatgtctcctggggagccacagtggcccccagttcacaaccagtgtctcagaataattaggcttggatctaaaaatgtgatttttttccagatgttgtctgagctaaatgcacacaaacacaaaaccaaagacaaacaccacacaatcccgtgatggggtgtaccaaaataatgttgaaatttggagtaagaaaaataatatgcagaaagatgtttggaaatggcttaaggagttccgttttcttttccattcctactattcaaatacactgaagggaggccaaggcaggtggatcacttgaggtcaggagttagagacgagcttgaccaacatggtgaaactccatctctactaaaaatacaaaaatagctgggtgtggaggctcatgcctgtaatgccagcaggtttgggaggccaaggtgggcggatcacctgaggtcaggaattcgagaccagcctgaccaacatggtgaaaacccgtcgctacgaaaaatacaaaattagccggcatggaggcacacacctgtaatcacagctacttgggaggctgaggcaggagaatcacttgtacctgggaggaggaggttgcagtcagctgagatcgcgccattgcactccagctggggcaacaagagtgaagccccgtctaaaaaacaaaacaaaaacaaaaacaaacaaatacattgaaggaagtttcactttcaggtgacaagcttggtttactttgaagaccaaaaaatatggtgatgaactgatgaattgattccatgataccgtactgtctggttgaaattgggagccatgaagagaaagagatagttctggctgaagctaaaagacacagagagaagatttatttacagactttccgtctggtacaaatagttcacgaagcatgagggacccaccagctggaactgctgttagtctgtagagttactgataccatctagggaatgaagcaaaaaatgttatcttgaattatttggctttgcattcccatcctgctgttttaaagtggctgagcagatatttgacagtcaaataaaacactagaaataacagtaaaagtcccctgcaccccaccccaatcaccaccaccaaacaaaatccatcagcatttccttacttccactccctccggcaagctgttgcatagatcttctgctcaaaggttggatgttttcacatagaggttttagaaaaagcaaatacagatccaatagaaaaataagcagggcagccatccctggaggctgctctctgtgagggctccctgtttttgttttttgagacagggtctccctctgtcatccaggctagagtgtagcggaaggaacacgtctcactgcagcctccaccttctgggctcaagcaatcctcccacctgagtctcctgagtagctgggactacaggtgcacaccaccatgcctagtttattttattttttagtgtttggagacacgaggtcccattatgttgcccaggctagtctcaagtggtcctcctgcatcggcctcccaaagtgctgggataataggcttgagccactgcacctggtcccttggctttttaaaaaatttcagatataattaacgtaccataaaggtcacccctttaaatggcacatttcagtggttgtgcacacgtcaccactatctaagtcagaacatgttcatcgttgcagaaagaaaccctgtgcccccagggagtcatttcccttctcttctccccagcccctggcaaccatgaatctcctttctgtctctatggctttgctgttccagaccttacatggaaagggcattgtgtaatattcgtcctgttgtgtctggtttcttgtacttcggatagtgttttctagattcgcccatgttgtagcaggtgtcagaacttcattctttttatggattgataatatttcgttgtatggatacacctattctttgttttatttatttatttttgagacagggtctcactctgttgtccaggctgaagtgcagtggaatgaacatggctcactgcagccttgatctcctgggctcaagctatctttccacctcagcctcctgagtagctaggacaacaagcaggtgccaacacaccctgctaattttctttggttttgtgtgtgtgtttttaaaatttattttatagagctggggtctccctatgttgcccagattggtcttaaactcttgtaaatgatcctcccaccttggcctcccaaagtgctaggattataggcctgagccactgcacctggcccactcttattctgttaataactacttatgactgccccaaactctaccaggctgtgtactaggagctgagtggggtggagatactggagatgtgtaaacctggccctcaaggatctcacagtctattggagaaaattaaaatattttaaaaaatcattctattctaacaatagaacactcaatggaaataccaattggagaaaacactggaggaaaaggaaagaacaaaaggaaagccttttgagaaaaatgagaaatacaatcggtatttttttattgtgggaagaattcctgtaaaaatggcagctgccaatttagaactccaagtgacatattattaggtaacatctgtcagggtttttgaggatagagcttgaagcatagagtgagttttcagaattaacaacaaacatctgcaaaagtataaagtggcctggcctggtagtatgaacctgtatccccagctactcaggaggctgaggaaggaggatcgtttgaggccaggagttggagtccagactgggcaacatagtgagaccccatctctttaaaaaaaagtataaagtggcggtgctactgaggtggtggttagggtcataagtttacatctagtcaccctttgaatatcttaaaattgcccataacatgcagtcatcaccattttgtatggtaaccctatgcaggaatttgcatacattaatctaaaaagaattgaaaaggcttttattcagaaattaatttgctgcctaggacacctcacattttttaatatttccacatcggacttttggctctcatcaccattgtattgtttggggacaattttaggatcccttctaaatctttcctggtcggtatgtctctggggccacttgcctgtcaccccagaatgtgcttcccttctgtcagtggcgggggaaacgcaggtgtcattccgattttcctaccagagctttaccagcttgcaggcagcaggatccctgggactatgtaaatcctcacctactctccctgccatacctccccagcccctcactaagtagaggtgaatttgggtaagttaagtgtgcatcggatactacttctgtgcgtaaagtcaaggaaaaccccttaccagggctgctttcctattggctgcacctgattactacgatggcagatacagaaaaaacttagccatgggcttctccctatgtagacagtggatataaagctcaacttgttcatcatacccttcagaccctactgcttcgggtttcactacaagaccaataggctggcatggagctttattaagtatctgatatggtgtctggaacttactaggtacttcacacaagttaactgaattttgtcttaagcaaatattcaacaccattttagccgggatgggtgagtgttcctgagaagtataatttgtgaaactcccaagtaagtaaggacaatactgtttttttttttaaacctgtgaagggttaaaggaacacaggcaatgcaggactaagttggttttggaacactggtgagagttcctggagaaggtgatgtgcgggctgggtcttagatgatagaacagcataggcaaagaggagacagaaaatctagatgaggaagacgcggtgttgagagttagcatagaaagtctgcgtcttgtttggggacggttgtggctcagcgtggtatggaggcgttgggggaagctggagaagtggtgaagggtttataaagattctgctagggcgtttgggctttatccggtggccagcgaaaggccagttaaggtttttaagtggagagacactgcaatttgcttgtaggaccagcccagtgcatgggcgtggaagaaaacacgtaatgcatcgcgttttgtgattgtggcagcagtttccattgaggggatctgtgtctccgcttagggaggcggagagccgctggatggagctcggttccacgccccgtcaccattgtgcctccttgctgaacactctctgctcatcaagtcgaggtgttgggatctgggacaatcctgaagagagtcattactaggggaggattgtgcacctgaaccgcttttgactccctagatgtgcaggcacccaactcccgggcctgcgctggctctcaggagacccagccccttggtacctcccggtttccctccagggagcgagccaggggggcatggcctggcaggaggggtggggactgggtggagcttatagagcctggccggggctgtgttttggggtagggcctggtgagagcgaaggggcagagtctggcaggagggatgtggctactaagagcagggcatttctgatgggagcaggagtatagatctttcctggaagacgagtgtgctagtacacaaacttgcaagatttaaggatcatcccggggagaagcccaggccggtgaggctgaggcttagggcttgttgggagtggaggggtcgtggttaggatagaacagaggggctgtgttcccacacaggtggggtgaggcccattcagagcccagaaacatggccagaaaggagcgtagctgtatctcccacaatgccttttatctcccccaattccatatgacacccaccccgccattcttggtttgaccatcaatcctctctactctccacaattctgtttctcccataattctctgtctctcccacaattccgtgtatctcccacaataccctgtattttccccgattctgtatttctcccagagttccatggctctcccataatttggcattcttccccacagtcccctgtctctcccacaattcttttttctctcataattccctatttctctcacaataacattctcctaacaattgttttctcccacaattctccattctattttttcttgaaaatctgttttcttctataatctattttattcttcttctttttttttttttttttgagacagagtttcgctgttgttgcccagactggagtgcaatggcgcgatctaagctcaccacaacctctgcctcctgggttcaaatgattctcctgcctcagcctcctgagtagctgggattataggcacccaccactacgcccagctaatttttgtatttttagtagagacggagtttcaccaggttggccaggctggtctggaactcctgactttgtgatctgcccgcctcggcctcccaaagtgttgggattacaggcgtgagccactgcatcaggcctcttctataatctattttctaccacaatctgtctctcctacagttctccattctccactctaatttgttctctcccacaagtctccattctctaccacaattccctgcctgtccctcaattcctcttctttcccataattctccattcttcccaataatcctttctttttttccacagttctctttctcacactaccttgagtcccccacaatcccaatctttcccacaattccttgtttctcccacaatccctttttacaatttttcataatgccgtgaatcttccataatacctggaatctcgcacaagccttgtctttcccacaattctgttacacagtaccttgagtctcccacaatccccatctttcccacaattactattttctcccacaatatggcttcatggttttccataaatgccttgcatctcccataatacctggaatctcccacaagccttgtctttcccgcaattctgtgtttctcccatagtaccttcagtctcccacaacctccatctttcccatgattccttttttctcccacaatacggcttcacaattttctataatgccttgcatttcccataataccttgcgtctcccacaattcctttcgtctgccacaatccttgcctttctccagcaatttcctgtttctttctcccacaatttctttctcccacaatccccatctttcccacgattccttttttctcccacgataaagcttcagaattttccataatgccttgtgtctcccatgatatcttgagtctcccataattccttttgtctcccacaatccttgtctttctccaggaatttcctgtttctcccactgtaccatatttctctaacaatttcttctttcccactcgtctcttctttctctcagaatttgccattctttttttttttttttttttttgagatggagtttcattcactctgtcgccaaggctgagtgcagcggcacgatctcggctcactgcaacctccacctcttgggctcaagtgattcttgtgcctcagcctccggagtagctgggactacaggtgcacaccaccatgcctggctaatttttgtatttttagtagagatggggtttcaccatgttggccaggctagtttcaaactcccgacctcaagtgatctgcccacttcggcttcccaaagtgctgggattataggtgtgagtcaccgtgcccagccaattctccatttttctatttcagaaatctttcttttgtaattgtattctctctataccatattctctctgccctgtaattccatttctcctacaactaattctgcaccataattccttttctcccaagatacagtattctctcccgccatttcctgcttttcccacaattgcagctctttcccacaattctctattcccacccatagtcctgtatgtttcttaccggtctgtctttcccacaatgccttgttttcccatacttctttgtttctcccacaactctgttctccacagttcctgtccttcacacaattccctgctctcccagaattccttatttctcccacaattttggtcattcctacaatcctctgtttcctcccataattccctattcatctcacaatctctgtctttcccatggttctctggtctctcccacagttccgtttctctcttaagtccccatttatccaataatctttgtctttgccacaaattctctatttctcctacaattttttattcttatctttcacagatctctttttctataattctactctctattaaattgtctcacatgcagttctttttcaatttttcattttctgccataatttctctccccaaattcaacattttcctccacaattcctgacctttctcacaatttcatcactttcccataactctctagtctttcccattaatcctttgtgcctggcacagttctcttttccacagtatcttgccttccacaattccttccccccccccccaattccttatattgcccacaattccctattctctctcacaattctctgttctctgttctctctcacaaatctctgttccctcctacaattccattttctcccatgatgttttgtattcctcacacttccctggctctccccaaattccctttctgtcccatagtgcctcattctcactaaaattcttatttttttctacatttttctgttctctcccacaataccctatctttcccataattctttttctcttgtaagtcccagttttccaccattttttccccatgagtctgtcctttcccataattcttggctctccctccaaattctgttcccttccgcacttttccattatcttccatatttctccatcattcttgtacatctccactgtttctcttctaagattctccttccctttttttttttgagacagagtcttgctctgttgcccaggctggagtgcagtagcatgatttcagctcactgcaacctctgcctcctgggctcaagcgattctcctgcctcaggctccctaagttccagctactttttttgtatttttcgtagagatgtggtttccccattttggctaggctagtcttgaattcctgacctcaagcttttttattttttaaattccatatcccaacaggcctctgttttagtaggttattaaaatccagcttttgaaatataaataagtattctctcagagcacttctttcaagacagcaaacacccaaagccccagcccttccccttcccgtgcctgttaccctctcatagtttcagtggaaccctgctgattcattcaaatactgacagcaacaagtgagtgggagagagtggggtgctttggaccagttggggcttgtttccacaagtaagctgtagagataaatgtgggcatatggaggaaggtagggaaggcaggagtacctgtgagggacagacccttttctggaacaggaggagtcatgcttcaaacaagagcctttggggcactcagtggctgcctttcaaggctgcttcttttcactgcctctgaaaagccatcatgttagcctggacttctcttcccctccataatttgcaaaatttctagtaagctgttagaccagccacctcccaatggcaaggccccttacctagcaccatgcatacacagaattttttcagcagcctgttctccaagtagcaccctgagacactgcccaagaattggacattattccactcctctgcaaaacccacccagctcaggtgaagtctcagcttgggctctgggagatcagctttcccctcagtggtctgctgttaccttcccctctccctaaaagtaacacgtggtgtcttcatcaactgtagttgctttgagggtgtggaagagaaaataccctagggccttggactttgttgagctggcgagatcaaatttaacaccttgaagtggagttgggccaggtgtcatgttttctatggttcatgctcagtgcccactggttggggtttcagttctaggacttcaaagatttcaggggatctgagaaaggcagttgagggcacaagggacatccaatatacagtcatgcaacacttaacgatgaggatacattctgagaaatgcatgttaggcaatttcattgctgtgtgaacaccatagagtttaaacaaacctagagggtatacccaactacacacctgggctagatggtacagcctcttgctcctaagctacagacctgtaaagcatgttactgcactgaatactgtaggcaactgtagcacagtaatacttgtatatataaacatggctaaatataaaaaagggacagtaaaaatgcagtattataatcttatgggaccactgtcatatatgtggaatgttgttgaccaaaaggttattatgtggtgcatggctgtatgtccaaatctcagatctgcatggggctgagagaatccaaacaacctacctggacttgcaaggctcattaaagagggccagttggaagggggttggcccttgggtaccatgaggtcactgggacgtgcatttcctgcagggacgttagatcttcacagattttgcaacaattgggaattagtcaacatcttccaacagcctggttgaattatcttctcagagacttgctcagccagcacgttccctgctcacagagacctttaagaccagcagagaaacccttggaaattcaaggctgctggaaagcactcattgagctgagcacaggcaggctgaacttgggcagctccctcccagcagaatttacttcaagaaagttgtcatgcataaatattctcttccatggagccctagggagaggatgaaagcactagaaattcttcaaagccacaggacccagaacatgtcccagagtgtgaggtcacgggggagtgtcctcagtccagaccttgatcacaagccaccatgtgacatcccagcccagagtctatttgaaaagaaccacagaaatcacaaaggagttcccatgaatccagatgtcctcataaacagtgtgtgaccctgttagaatcaagtatttttgaagtgccaccagcccccttccagcaagaatgttgctccggaactggaaggctcctttagaagttttcccagctggtgtctgggctccagaaaaagcagattcaccacactgacaaaaccaccctctccaccatccttgtcggctacccagactctcctcaggatctggctgggcgatctacggccagatccatcctccccacatccttgaatccctttacctgcccttcaagcagctcatcacacttgatctgagttactcagaccaagattatccaggactcatcttaatccaaacctgggaggaagatctgagtgtcgtgtcctcccacagcccacagtgcttgtgtgtgtgtgggcaggtgcatgtgtatgtgttggaggaacaccacaatattgcacttgcctttttttttgaggtgggatctcactctgttgcccaggctggagtgcagtggcatgatcatggctcactgcagcttcaaactcctgggcttaagagatccttccacctcagcctcccaagtagctggaaccacaggcacacgcaatcatgcctttttttttttttttttttttttttttttttaagagatagggtctatgttgcccaggctggtctcacactcaagcactcctcctgactcggtctcccaaagtgctagggttacagctggagccatcgtgcccagcccacacttgccttcttggtaatattgtcatctcttgctgtagctcaggcttccctaatcctttccaagtacatctctcctgatgtcacagtttctcacttcctcttttctatataactctaattttttttttttttgttccttaacatgtcctctcaaactctgcatgtatctcttttaaaattgtgcttgttcctgcccttttctttatactcatgtcttaatgagtgctccaaggtactagtgctgcatcccgttgctgtcaaggcacctatgtgactgtactgacccattccccatgtttattgggcaccctctacatgccaggtgttgtctggggcattaggtacactatggtgaccaagacacattccctgtccactgagactccactctagtggcagagacagaaagaaaaacacaaataatgacatcatattccagccaggtagtgggacgtgccatgaagaaaaatcagggaggaggtaggagcatggttttagagagggtgtcctgagagtcttcctgagcatgacgtaatattagaattgagaccttaatgaactgtaggagccatgagaaaatcagaagagctttacaggcagaaaaagagaggcaccaatgccctgtggcaggaccaagcctggagtgagagggagagaggcagtgtgcttaagggtgtgagggagctgagaggaacacagagtaagctgcagttgtcagcaaggcccatgggtggagggctttggaggctttttggagtgcagtcacttgccccatctgttgttaggaaggccactctctgttgtgtcttccacctgtgtattccccatgtgaaagcccataacctgtgttgcggctggagcaagtactctaggatatttggggattggaagaataattctgacattggttccaaagggtctcacagattctgaaggaagacatgttgctggaattgatgcaggattttattcttggtcactttgcaagctggggacctctggctggtgatgccccgcccaggcctcgctcggccatgctacctgttgcaggagatggcctgcccacccagcttgcatgggccaagtctggcttgcacaccagttctcaagttcttgtcccatgcccaagaagaatgaggatgcactgactatagaagagtgagcaaggcagggagttttgagtgatgaaactgctttcagcagaaaggggacacaggggtggtccccctaccagaaggtgggaaagtttccctaatatggctgagtctggggcttttatgggctcagaatcggggaggagcaggccttaggtagtactggaaaaggcaatgttcgattggttaaaaggcattattcagaaagaatcaattgagaaagggcaggaacagaggttctccctttgggttgtggatttcatccgttaccagcagtccagtctttcagacttcaggctgtttttggcttgaaggtggggtcgaaaccccaaaccagggacccactcctatctgcctaggcatttggctgcctcctgtcactatcagaatgatgactgacatccaggattactctttcgatgggagtgatgttaactttcatactgctgattgctgcctacgtttttctccctctttgtattgtgtctgctttttgtaaatcttgtcacattctggaaggacaggagaaaggggaagattgattaacaaataaagaaaacaggaccaaaggaaataatgaaatcaaaagaaagccaggtagaattagccccacatagttaaaatggattagtagtttggctttgggctttctaaatggggagtaaagagaaaaatgtgaccagttacaagattcttcatgatttaaaagaaaacattgggcacggaagcaaactgccatgaaatccaggcctgagaaaaatgtctccagcgatttctcatgaagggaatgctgagcatatttggacaaatatattctggtatttacaaaaatatcattcatcactttatcatcatatctagggtcacaatcagaaaaaatgagcccaatttgacagagttaccaggcatgtactactgtgtatttagttgggcattgagagatgagttttccatgagtagagttagatgctgacagggaggagctacttgctgaaaccatatggcatcgtccatgaaaagacaattgggagatggcatagttttacagagcggtggtctccctccctttgggcacttcctagaattgagtgtaggtagccaggcaaccatagggtccctgttgtgttagttaccatcctcagtagaagctgcaccagtggtcacaagagtgtgttctgctcctgcatcagacagcacgtgtcctggggctctgaaatcttcctaaaccaacagttgtgtcacctgcagcatctgtgccgcagtcacctatcaatcaactggcctagatgattctgtagggcttgtgtcatccgttgtaatgatttaataaaatgtagatggaaagttgatgtagatttccacccctcccacctttttttttttttttttttttttttgcagatgagatgaatgctaggactttgaccaaagttggtccatgaaaaactccatgcactgaatactgagcattttctgaagctgatgacaaacctgctaggacacagacacagtcagtcttttgtcttttcctctccaggttctgatgccagcacaattgaaattcacactgcaagtgaatcctgcaacaaaaatgagggtgaccctgctctcccaacccatggagacctatgaaggggatgtgctgggggtccagaccccatattcctcagactcaacaattcttgttctttagaactgtgttctcaccttcccaacactgcactgccgaagtgtagcggcccccaaaccttgctctcatcaccagctagagcttcttcccgaagggcctttaggataggagaaagggttcatgcacacacgtgtgagaatggaagagccccctccagaccactctacagctgctctagccttagttgccactaggaagttttctgaggctggctgtaaagtaagtgtaaggtccacatccttggggaagtagttaaataaaatagttatgact

SEQ ID NO: 4233 - DNA, 46745 bp, human; identical to SEQ ID NO: 4229

SEQ ID NO: 4234 - DNA, 162987 bp, human; identical to SEQ ID NO: 2960

SEQ ID NO: 4235 - DNA, 162987 bp, human; identical to SEQ ID NO: 2960

SEQ ID NO: 4236 - DNA, 162987 bp, human; identical to SEQ ID NO: 2960

SEQ ID NO: 4237 - DNA, 742 bp, human
ccaccatggtctggttctgcaacagtgccgactgccaattttcagtcttcgcccttaccaccataggatggatcctctcctctacgtccacgggcctcgtggagtggcgaatatggtacatgaaagacacctcgctctacccccctggaatcgcctgcgtgggaatatttagagtctgcatttaccggcgtcgcaccaacagcaccacaaccaaattttgttaccgatacagctaccaggacacctttctcccttttgaaatttccatggctcaacgcttcctactgactgccagcattttcggattcttcgggagagcctttaacatgtttgcacttagaaacatgtccatgagaatgtttgaggaggacacctacaattcattcgttgtttcaggaattctcaacattgctgctggtgtctttaacttaattgctgtgctccagaactacgatgccgtcataaactcacaggggatcaccttcctgccatctctccaaatgcccttcaagccagatgtgcaggaagttggcactgccattcaagtggcagggataggtgtcttgccgatgctgttaactgggatgttttctctgttttacaaatgtcccccgtacggccaagtgcatcctggtatttcagaaatgtgaatttcctggttgcattggctttgcaaatctaagatttctgggagtttatggaaaatgttattagcatgctctaccaaatatttccaacgact

SEQ ID NO: 4238 - DNA, 54642 bp, human; identical to SEQ ID NO: 2980

SEQ ID NO: 4239 - DNA, 74367 bp, human; identical to SEQ ID NO: 2981

SEQ ID NO: 4240 - DNA, 128916 bp, human; identical to SEQ ID NO: 2982

SEQ ID NO: 4241 - DNA, 78159 bp, human; identical to SEQ ID NO: 2983

SEQ ID NO: 4242 - DNA, 53630 bp, human; identical to SEQ ID NO: 2991

SEQ ID NO: 4243 - DNA, 232429 bp, human; identical to SEQ ID NO: 2992

SEQ ID NO: 4244 - DNA, 174863 bp, human; identical to SEQ ID NO: 2993

SEQ ID NO: 4245 - DNA, 438177 bp, human; identical to SEQ ID NO: 2994
  misc_feature (63100)..(113099): n is a, c, g, or t

SEQ ID NO: 4246 - DNA, 438166 bp, human; identical to SEQ ID NO: 2995
  misc_feature (63089)..(113088): n is a, c, g, or t

SEQ ID NO: 4247 - DNA, 175324 bp, human; identical to SEQ ID NO: 2996

SEQ ID NO: 4248 - DNA, 222612 bp, human; identical to SEQ ID NO: 2997

SEQ ID NO: 4249 - DNA, 147298 bp, human
ctttttcaaaatgtggcggtggcagggaaggttgtctgctccagaggcttccctagagtgaagagctctactatgtatgctttatgcggcagaaggagtgctttggaggagtttttaaatttgttttttttttaaatcttatcggttttaattgtagcaatgattcaagaaacgttagtaggtgcccataacttcggtggtggagatccaaaagtgaacaagacagtgttctggctgctaaattcttcttaactgggtatgtgattttgaatgtctgtattttcatttacctccaacagaaatttagcattttcttccatcagggatgtaggcaataaatcctagtactattagctgtatgtggcactaatacacattacagataaattatgtcacatatggttgttgtgcctgtctcaaaatatcatccatccactactttgaaattaaggtaatttgatcttgttacttaaagtgttaataaagaaacatatatctttctatataactatagtggctctgtgaaatacgtccagatgtcccctggtgcagaaagtgttgggggctcacagctttcagctgagtctccaggaattgtcctctgcctaagagaattgcctcacacaaaatcacttcccctccttggggacgatctgcatcctatgagggtctctgcaagggcacataagtccaggcccctagccccaaaggggacaactcagaagggccatcccagcatcagaactgcctacaggatagcccaaggattccatttcaactatcacagctcaacttctctctttacccacaattcttttgtccctcccacaattccttttcactcccgcaattctgttttgttacccacagttctgtctcccacaattctcagttctttccacaatcttctgtctctcccacaattccttatttctcccacaatcccatgtcactcccaaaattctattccttcccacaattcatttttctgtcccacaattccttgtcttgctcacaattctcttgtttctcccatgattccttgtgtctcccacaattcacttttctgtcccacaattccctgtcttgcccgtaattctgttgtttttcccaaaatttgctgggtttcccagcaagcctttattctttcctacaaattcttgtatctctcaaaattctgtttcccacagttccattcctcccacagttctctgtcttttccatcattccctatgactctgtctgtcacaattcctcaaaattattcatttccacaatgttctgttcattcacaatactctgttcttattccccagtctctcccataattccccattatctctcataattctgttctttcacaatattctttttcatgatttcctttctcccacaattctcccttcattctcataattattccgtctctcccacaacactgtattctctcccatggttccctgtatctcccagaactctctgttctctcccccaatttcctgtctctccctgagttctctgttctcccacaattccctgtgtctcccataattccatgtttctccccacaatttttggtttcctctcacaattctctgttctctcccacaattccttatctcaaccataattctgtattctatgctacaatttcctatctttcctataattccccatctcccccacaattctttgttctttcgcagaattctccactcttacaattctccattccctcaaaatactccatgattgttcacaattccccagtctctcccctaactcccattctctctcataattctgttttctcacaatattctcgttcacaattttctatcccacaagtgtcccttttctcccacaattttgtgtctcttccacaattttttgttctctcccacaatcctgtgtctctcccacaattctttgtgctgtcctctccacaaatctatgtctctcccacaattctgctctctcccacaattctgtgtcatatgctacaatttcctgtctttctcataattccacatctctctcctaattctttcttctctctgataattcttcactttcactcacagtcctccattctcttaaaattctccatcctcatttgcaattctgtagtctctcccctaactccttagtctccctcatcattctgttctctcacaatactctattctcttacacaatttcccatctctcccacaataatctcttctctttcataattctcccttctctcccacaattccccgtgtgtccacaattttgtgtcactcccacaattctctgttttttcctacaattcctgatgtcttccccctttctttattatctcccacaattccctgtctcacctacaagtctctgttctttcccataattccttgtctttcccataattcctcgtatctcctacaattctttgctctgtctcacaattctccactcttgcacttctcccttattacacaatattctgttctctttcacagctgcctagtctgtctcccaattccacattgtctctcacaattctctgttctctcatgatactttattctctcccgcaattctcccttctcccacaattccctatctctcctatcattttctgttctctaccacaattctcagttccctttcacaatttctcagaagacccaagcctggtcctgtaacttcagtgtttcagggcccaaggggaagaacatgcccagatgagtggtatgtgatcaggaggaaggggtatggtgggagggtttgtggttataatgagagcaggtgtcaggaaaggtgtgactaagggggagcacaaaagaccaattatttgtttttttctacaattcctgagttcttccacttaattccgtattatagcacttgacaaaagatttgcagttatgtatttgaatgtgtaattctcttacctatgtatggattttctgaagttaaaaaatagatcttatttggctttatatccgctatatcagcacaactcaaaatgtgtcttgccagtggggaccagttcacacactgttacccttctaatatgagatgaggagctttcaccacaaggcaaggcaaagcattgcttgcctcatccagaaagtcttactatgaaaaatgtctcatctcagataaaattgtgcttagtggcatagcagatttatattatagtacaagattcttaattcagtgttggccaataactagcagtttctggactggcacttgggtagcactgccctatcattacagtgtagtttctgttgtataattgagtgctcactgaagcagtcagaagcagacactggaagggatcacagagtcaatgaatcttgaatgagtgatgtttcactcattcagcaatatttatggagcacctatgatgtgtcaggtactgtgggaagtgctgagaatttaaaagtgctagacagactccttgctctcagggaatttacattctagtaaatgaatagattggacaacaaacaatccaacacaaacagataaataaataatttaagatcctgataaaagccaccaattaaatgacacaggtagtgtgacaaagattgaggcatgggggtctacccacccctgtgggtagatgatctgtggagcagaaaatttgtattcctcgggagcttgttagaaatgcagaatttcaagtccctccccagaaccactgagtcaaagtctgtcttgtaacatgatccccagatgatcagtgtgcacgatacagattgagagctcaggataccttctcagatatggttgtcagcaaagacctctctgagaagggtgacgttttagctgagacctgaatgttgagaaggacccagccatgtgaagatcaatgcaaagagtggtccagacaatgagaatgccatggtaaaatgttctgagatcagaaagaacagggaaagaccagtgtggcccacacagaatgagttgggggcagaatagtaggaggtgatgttggggctggatcatgccataggccatgaggaggaagtgacattttcttttaattgaaatgtgaagccatggaagggtttttaaaaagaagaattatttgatctgacaatagagatagcttgtttttctcaactttgctcttcaccactttctagttatgcctggagaccttcacttggttctgtgccagcactgcccatgaacttcatagactgtgatctttgctaaggcctaaatgaatgaaggtaagttcctaagacatagccagtagaccccccaccaataggtctgtgttccatggagtctgccagcattcatcacatgtgtactcagagggaccgtgtctacatcaaaggccagggttacctcttgctcttggaaataaacactacttttccttaaagggatttattgccaataaaattagagatggccagaggttatcattctgtttaatattctcacaaccattgtaataactttagaggatatattattattagttggtaagtcccaagcttttttgtgttttgatgagagtcgagggtttcttcacatagacctctaaaaattgaattaattggccaggcgcagtggctcatgcctataatcccagcactttgggaggccaaggcggacagatcacgaggtcaggagttcaagaccagcctggccaacatagtgaaaccccatctctactaaaaatacaacaattagctgggtgtggtggcacacacctgtagccccagctacttgggaggctgaggcgggaacatctcttgaactcgggaggcagaggtttcagtgagccgagaccatgccattgcactccagcttgggtgacagagtgaaaatctgtctcaaaagaaaaattgaattaattaattcactgattgtggatgactaccttatatgaggaatcactcccggtttcttataggaacccttgtttcatgtctccagatgtacactcccagtttcttatggaacctttgtttcatgtctccagatgcatgcagggcattgctttttgagaaagtttctttaatttatagctgtacttatttaagactggactttccttgatacctgccaaggtggtctgagtgggcactaatgggcctgcaattaggtcaattcagaaaacttaaggctattctttggtgaatgccaacagggaggttgcccagcctcttctcatgctgggaaattcagcaggtatgagatttgataggagacagggccctgattccctctatggcggtgcttctcaactaaagctgattttgctgtccctatcctgggggtatttgacaatatctggagacatttttgattgtcacactgagggtagtggttgctactgaaatcaagtggatagaagtctggcattctgctaagcatcctacaaggcaaaggccaactctagtaacaaagaattatctggccccaaatgtcaataatattaaagtggagggaccctattcttggaaaaccaaaggccagaaacttcctctgcttgatacctggcagctagagcatgggcttctactttctcagcttgctcaatatatgtatatatacacacatgcaaacatactggcatgtagtgtgcattatgtaactacactgggactatttaactcattgccccttctttctacctaccccaaaccaacacacacaatcattcagaagcagaaatgggggcggggactcgctattttcgagtggtgaaaactgttattattattgaagttattatgattaagttgctgatccagttgttgccacaagtgggcctttatgagtcactagatttaacatgatgtgccaaaaaagatgggaatagcactggtaagaatgggtgaagtgaacattgctttggggaggagctctggagagccatgtgaatcaccacccacacaggcaggagagatatcagtatagtcttgcctagaggagtgaggaatttcatgttttcttccctatggaaataattagtagtggatttggttaccaatggtagagagaaatggggaaaccacggggttatgttaatgaaatttccagtgggtattggatttgccctccaatttttaaagcataaactgtaaccaaagaccttctgacatattattcttttaaaaaggaggagcatggtagattacagttgtttgaaattaccaccttactgcataaagagaaagctaaggtgaagtaaataagaagacaggagtaaaaaaatggctgctgattttgagaaatatttagggttaggggcaagatgagttcaggttagacacattgcacttgagatgataatggttatctaggcagtgaaatcccagaagcggttcagaacacagaattagaactcaggaaagagctggttgcagataaagaaatgtaaattatcaggtttggttggatgttaagacataagaatggatggtaaaatccttcaaggctttggttttctttgctctcattccaaatttaccaaagaactttgcgactttagtttggctttcctattaggaagagaatgcatcactagccaacctaaatttcttcctccttggcagtcttatttttttattctaaacattgtgaattaatgacttggagaaaataggagtaatggaaggaaaatcaataaggcaaggcatgagtagctttaaaggaaggaagggaaggctctttgagtggtttggactcattgtaaagtgggattgaaagattaaacccgcaaaagacaagttgacaaaccatcctctaccaccaccacatgaaatgcagttttccaagaaatgtgctttgagggaccccatttttaaaacacaagtagtagcatactttatatagggatttaactgttgttcttcacctaaaatatcttggaggttttccatatccatctttctttttatttaacagattcaagaattaaaatgtaaattttcatatcagtacatacagtgttccattttgtttttatttaggacatgtacactattccatcatatagattaatacagtttatgtaactggtcccttactaatcaactaaattgatgttatatccaatactttcctattacgacaatactacaatgagtaatattgtgcttacatcatttctcacactgtgtgagcatatctttgtaatacctagaattaaaatgactgggtcaaagggaatgtgcttttaaaactttgatagtcacttctaaatgacccgagataggtggttgtaccccttgtagcttccctcaggagtggatgagagtgcctgtttttccacaccttcatcaacacagtgtattgctttttttaaaaattgatttgtagacattctttataaggaaattaacctttcttctacactatgaggttggaatattttctaaaattatctttttttgtttttgcttctgctaagttttgctttgagtagtttttatggatcttaattttataatcttctatgatttctggatgttgtggcataattaaaaatattttaagtcctaaattctcccaagtttcttcaattaaaaaaattacactttttcctttaaaccatttatatatttgaaacttatcctggtgaaaggaataaggtatagctgtgctatggtatgaatatgacttgtttgtccccatcaaagctaattttgaaatttgatctgcagtgtggcagtgctgggagctggggcctaatggaagatgtctgggtcatggggtaaatccttcatgaatgacttggtgactttctaatggtagtgggttctcactctcacaagactggattaattctcgggaatggattggttccggcaagagcaggattgttacaaagtgaggatccccctcatgtttactctctcttcacatgtgcctggtttgcctttgactttctctgctgactcaacatgaaagccctcaccagaagctgagaagatgccggttccatgcttcttgaacagcctatagaactctaagccaaacaaacctcttttctttataaactacccagcctcaggtattttgttgtagtaacacaaaatggactaaagacaagctccaatgactacatccattttatactctcctatgttttggattctcttgtctttagtcttaatgtttgtgtgtttattttggattttccagggattatttcatataatctcaactaataatgattttacttcctcccgtccaactttaatgcctctaatttcttttgtttttttttttttttttttgagacgaagtctcgctcttgttgcccaggctggagtgcaatggcatgatctcggctcgctgcaacctccacctcccaagttcaagtgatcctcctacctcagcctcccaagtaggtaggattacaggcacctgccaccatgcccggctaatttttgtattttttttttttttttcagtagagatggggtttcaccatgttggccaggctggtctcaaactcctgacctcaggcgatccgcccacctcggcctctcaaagtgctgggattacaggcgtgagcccctgcgcctggcctcatgcctctaatttctttctcctgcataggctaagactttccagcaaaacgttaaataaaagtggcagtagacattcctaatttttgtggaaaagtgtctagtgtctatccattaagcattttgcgaacttttagattggcataaagttttttgtcatgtttaagaagtatccatatatctctattttgttatgagtgttttacaaaatcagcaagtaatttagtgaatgggttttcatagaagatgataaaggggcagagtttcccctctaggtcaatgtaaactgagccagcacaagcagagagaggagtccagaggcagaagtgaccataggagcctaagtccctgaggagtaacatataactcagggaaacttgatattccatggaccatggactgggagattcaagtgaataagaccttggggtccaggagatggggaggccaggcctaactgacagaggcttatactttaagggtgaatttattaaacaaatattatacaaaatacaatgagctgataataaaacattctttgttcttaaatttatatatgtgtgcttgtgtgtactaatactgaggcccttaaaccactaagatttaggattcttaaacaaaacagattaggtaaagtttgccttccaaagccaaggggagaggggtggccagggaaggagaatgttctggctggaaaggagacaaattctgagtaaaggaagctgaaggacaaacacttctactcaggatttagcattggcaggactgtttggtgtgtaggaatttagaactgggtcagtattatttaaaggactacaaacctggttttaaatttaaaaggggtgtgggggtggagcatggcaggtggtgaaccaaaggaatttactatgatctgaaaaataagcttaagtactaactccactgtgggcagggaggcaagaaccttcccttttttgagttgaagataagcctcttcagtctaaactttcctaaattccacttcttctttttctataaaacaaggtgaagtactttatgctagctatcaaaaatcattgactgtatgttgcatgaatttatgaatttattatgctagaaaagtgtttcttggctacttcatatgtatataagctttctccctcaacacagtttctgctttttatttttggaatctcacatagcctatatcttgttttcagagtagatactatcactgtgggtggctgagttctcatctatatgcaaccaaggctaactggctctctaggttaccttgatgccacccactgagagtcctttctggatttagtgatttagtgctgcttattttcaccttctctcaggatggagcctcagaatagagaccaggttgaaaatcagtcttttacttagaaccatgaaagcagatactacatcttatccgtctatgacctggtgacccagaagccattaatttgacattaccaacatacctccacacaaagactttataatcttcagtgtgagaattaaacaaacaaacaaacaaaaacttaaaacaactttggaggggagaacgataacctaaattttaagcataagaaaatccctaacaaaaagatccaactaattgccactggggggcgatggaagttcgtgaactgctctgctaatccctgaggcaactgagcactttagttggtttatttattcaaagctggaatttggacgtgtgacccatcaagctcagggaaattcctggatgaggaacacagtcctgggagaaacctaccaaagatggaattagcaccttggcgaaccgccttcagcgcaaagaactttctttccttgtgtgtcttaagaatttacttcagttcccttctgtctgaagcagaggaagccaagttaaactgtgaataagcacgacaacaaagaagagttcttatttatcactacctgcaaacacatgtaagtgcacagtttaaacagcattcagacatctcacagccactaggatcagagttttggtgtgagtaggcctcagttggtaactttcctgaggaaaggagggaggttatagaatttatgttaggaaattctgagtcatagataacactttaagtgacagttaaggaatctagtgagagggactttggacaggtttagaaaagtaccctatggaaacaaaggaggaaaaaaaaagtatcttcactgcaagagtaatattgcagccacttggtggcgtgttgtgggctttatttctccttccagattccctcggtggtgtctggaaccactggtaggataggggtcctggcaccagactttggccagcccagtcatcaggcaatatcaatgttaggggtcccgttgctacttctacttggtcttttttcccttcccaagattgccaataaagtgtcatcagcagccgggtgtggtggctcatgcccgcaatcccagcactttgggaggctgaggtgggcagatcacctgaggtcaggagttcaagatcagcctgggcaaaatggtgaaatcccatctctactaaaaaaaaaaaaaaaaaaattagccaggcgtggtggcatgcacctgtaatcccagctactcgggaggctgaggtaggagactcgcttgaacccaggaggtggaggttgcagtgagctgagatagcacctctgtactccagcctgggtgacagagcgagactccatctcaaaaaaaaaagtgtcatcagcacaagaatttgtcctgcttccactccaggaagggccaaaggggacaaagagatatggaacttaaaaagcaagtctagaatgcacttttgtgcataagacataaatatatccatgaaatcatgttgcatcccctgtgtaacaggctctccatttcaaaagccctccaacttggcatagggatgacctaagggctctaagattgcagctaagataaggacccatggatcccaatgctcagtgccctatgtcctctggaagttgctgacacatgtttctgagggacactcagaaaacctggaagcatgttatattagtgagcacattttggattttgagtgagaagtccagcttgagttaacttaagcagaaaaagaaattttgggatcacactcttaggaagtctggggtgggtaaagcctcaggaagggctggatccagtcattctgcctctatctcttggcctgatgccacttagtttgaaggcctctctcctaacttctttaacatttgggggaatttgctctgactgggtcacattctttcccctgaatcaattactgtgtctggggaggtgaggcaatatgattggctaggtctggtgtgttgtgattgacagcccacctgggaccacctgaaatgggggagaggatgttcctcagaggaaatgatgctgaacagacaaaagcagcatgaatctccaggcaaatcatttgtctgtatggacaggaagatcaacaagctggaaacaggaagtaatccattagccaatagtaaaattaatcccaattgctgttttgcttccttagattctaacataggcctaatgaaaaagctctggattcttgtgtaaataatttgggaaatgcctctactaattcaaagaggatcttggaactgttttctattgacaaatgtccataaagaggaacctgagttgtattcacttgcttcttttattcctacaataaggaaagcaccaggagttcaatattgaatgctgaaatgaaaaggaaacattctgtttaataatgaaaagtaccaacaattgcatttggggctaaaagtcccaaaattatccctagaaacctcttaaggtctacatattatttgcaaggctccctaatgcaaatgatctgctttctaagtcaatcttagtcatataaaacacatgccgcaacataaaacataaaccaaaacaaaataaaatttcaagaaaccgagggccaaaaatagctatagtcaactgctgataaggtgtgaatggaaaccatgggacattctggtctgaatgacaattgttcttgatcttcgaggctgagaggattgtaggaagccattgtgcagatgggatgacttacctaggccacaggctggcagccatatccacacaccattccgagcctaggagaaaagccctgggcccagagatgaggtgccctggaaagggcaccctttggagtcgtagagctccaactctgggctctctgactgtcagctgtgtgatgtggatatcacgtcatctctcagagcctccactgcttcattggtgaagtgacaggaacactgactttatggcattatgtcatggagaaaatgaacactcatatattgatctaactcaggagtcagaacatttattctgtgaagggccagagagtaaatattttgggctttgtaggccatagactccatggcaactactgaactctacatgaaagcagccacagacaatgtgtaaatgaatggatgtggctgtgctccaatgaaagtttatttacaacctgaaggtggccctcaactttggcccaaaggccatagttttctgacccctggtttaatggttagttcctccctgttccataagtgttagctcctccttgctcatcctggtaacccttctgcctgttgtcagagaacattctggtgataggctggattgtgttcccccaaattcatatgttgaaaggcctcacccttaatgtgactgtattggagatagggcctttaaagaggtaattaaggtcaaatcaggtcattaagagtggggccctaatctgataggactggtgaggactggtgtccttataagaggaatagacaccagggcttgtaactcgctctctccatacccaaaggaccatggagagcacagtgatctgaggaaagagggctcaccagaaaccaaaaccacttgcaccttgatcttggactttcagcctccagaactgtgagagaattcaagtctgttttttaaatcactgtctgtgggattttttttatggcagccccggaagaataatataatcccctgtgaattagctgggtaaacgatgatgccaccttaaattccttccttcttttaaaaaacatctttttataaaaataatcttttcatataaaaattttatatctcttttatataaagctttatattttatatctcttgttatagtggaggtaaaagcatctgccctgcttatgtaacaaaatttttgtgaggcttaaattgactagaaaacacgaggtgtgatatagcacaagtaattaccaagacatttctgtttcagccatgtcacccatatttgcaaatgtaagctagaacgtaagagagcaaatctggacccaaatgttgaagtcttttctttccctaaagtaaattacttggtcagtagagtggggttggtatttgtttgcttttctttttttgaaaggtggggagctacgaggaagctaggagaagaaaacatgtataaaaaggactctggatccagtccagagtgtttgcctctgccctttgatgtccaatggaatcgtttcattcagtgtagtaaattcagataaaatttccatgctatgttaggtgctgtgttgggtatggtggataaagaagtgacaaagacaaagtctctgcctccaaggagcttatattctggggcagagataggagacgttgggctcaaagcagagaacagatgaatgaataaaataagtacagaatttgaataatgccagaaagaaagccaatcagaagtaacatggttgagggtcttcatgcccattcatcttgccttttgtcctcttctctcaactctgatgtccaagtgtttcaagctcatagttcctcctaaagatgttgaatcaagatgatgttcttcttgttagcatcatttctaatgtacaattcacaaaattagtaacaacaattgttaactgtgtacttctggcctggacactactatgctagacacttttttgggggtagtaagcttttaaattcagaatagttttagatttatagaaaagtcacagagatatacagagagtttccattcaccctacccccattttgttcttttattgacaccttatattagtatggtacatttgtcacaagaaataaaccaattttgatacaataatattaaccaacacccaagatttattcagatttccttagtttttatctaatatacattttctggttcaggatctcatctaggattccacattacatttgattatcatgtctctttgggctcttcttggctgtgacaatttctcagactttccctctttttgatgaccttgacagctttgaagagtgctggtcaggtatgttgtagaatgtccctcagctgggattcatctgatgtagtgcattatttctcattctcatccttagccttcagtgtaagtataaattattcatcttttatagatgaaaacactgagatccagagaggttgaggaacttcctgaaagttacacagctagcaaatggcagaagctgtgattcaaactcagtgttgacatgacttcaagccacatacttactttgcctccctggtctcaatctgctaaatttctgacaatggaattgttctcatcaaggctatcagggtgatctctttatagttctttcatacactttaaagcaatttgatgacatgcttaattatattagaacaatttccacaatcagttgtttgctgaactggttatttgtataacttcgttggttgtgttcctaggacagttggttaatccagaaagagtatcactgaaaaagtatttgagagcctgtgtttctagaagtagttctcaaactgtgctcagaagtaacacctggactgcttgttagtaatgcacttccctgggttagggtgatccactgcccctctttgcccaggaccgagcaattcccagaaaagtcccaggcaaatcaggacacttggtcaccctaccacagaactcctgtgactcactaaggcccagcaatctgcttttgaacaaactatcaaggagattattctaaatgcacagaagtctaagatccactacattagatatagaaatgaactgctgaaataactggtggccagtttctgaagatattaaagaacattgattttcatctggttgggtatatttaactctgcctgaagttgaaggagaataatatcacccaaacttccagccttttgatcttaagaaatggtactactttcccagctctatattttagttgaagaatgatgggagttcccaaaagatataaagactttatgaggccattatttattagtcagaattaatgaatctgttattaatccagggtggtggttctcaaactttggaagctcaatggaatcaccaggaagagtttaaaaatcccaatgctcagttcaaccccagaccaattttaccagaatatctgggagtgggagccaggcactaattttacatttgagaaccatggatcgaaaggaatgctgtccagtagaaatagaatgtgagctgcagtttcctagtagtcacatttgaaaagtaaaagacaagcacatgaattttaagaacatatttaatgtaacccaacatatctgaaattttatcattttaacctgtaatcataaaattttcaatgacatgttttacgtaaatgtttttatactaagtctttgaaatctggtgtgtattttatgcttacttcttaatttggatgctatattttcaccagaaatacttatctatatttagattcgtgtacctaagttgtttcaaacgtattgaaaagtattccaataactgaattgagtatgagtttttaaattttaattcattaaatttttacaatgcaatctctcagtctcaataagtacatttcaatagctgaacagatacatgtggctagtaactttggtaatggacagcacatatccagggcagcacttctcaaactttaatttggacacataaattaggcaatctggtaaaaacttgggttctgttctgagaggtgtggggtggttctaactaggtgccagatgatactgttgctgctgagccagagacaacattttgagtggcaaggatctgggagtaatgttgaatgatggctacttccactctgatttctccacttgctcagtgctaatgtcttatttcaaaggctcaacatgaaaacaataagcctttcctttttggttaggaaatgtgtgtgtgtgtgaatatatatacatatattacacatatgtataaatgcatgcgcatatacacaagtatgtgtgtatccatgtacatgtatgtctgaacttgtctggaagcataagctagctctgcaaatgtaaagagcacttcagtacctcatatattatgtgtcttcattttattttaaattcagtgtacacttctttggttcactggaactgaacaacagctgaatgtttaaccttgatgtaagtctctatattcatttatttgctttttaaaatgaattaagtaggttcctgcattgtgtttcaatatttgaaggtatttaaaaagtatttgatgacccaggctctggttttgtgtacagtgcagagtaaatcccagtttcatttgtatgtggaaatttttagctccagtacttgtatttctttctatagatgctttttcattgttctttagacatcagtatggataggaattgcttctggagtgctgtttcaatgtttattcaattattcagttgattcaattcaattggttcctctgagccaaagctgatttaactcctgggccagtatctaaaaaataaagaaacccccaaaacctaaaattgactgagttctttttgaggatttataatctgagaaagttattcgagcataaacaggaaccaaaatcataatgaaattggagaaattgatcatgcagccctcttattttttactttcttttaggggacaatttttttggagggaagtcaccactgtatttagcagttgttgaaatcacacgaaggagtgaaggatatagctattcaaaacttttggaaaggccaggcacggaggctcacacctataatcccagcgttttgggaggctgagacgggcagatcacctgaggtgaggagttcaagaccagcctggccaacatggtgaaaccgtctctactaaaaatacaaaaattagttgggtgtggtggcggcctcctgtaatcccagctactcgggaggttgaggcaggagaatggcttgagcctgggaggtggaggtttcagtgagccgagatcacgccactgcactctagcctgggtgactgagcaggactctgtctccaaaaaaaaaaaaaaaacaacaacaatggaaaaaaacaaacaaaaaaacttttggaaaaaaatcgggataactcattaaaattaaaggaaataaaatgaaagatagcagttgggtgtatcaaggcaggatttaaaggaaaaatattaatttttactttaatcaatttttagctattttatctattatcagtcatgtgaagtgggaaaattatatttctttttctttatgagacaatatttattctgtttatgattatgtatcccaataaatataagtcccagcatcatccatgaaaatggctactgattcaaaagcttgattccttgggctagacactggaagactcaaaagtcccaaaggaaatcaatattctctttgttttatttattttgttttaacctcatgggtatctataggtgaagtttggcatataatatattttttatttcttgtgaaccaaacttcatttaataatagataataacaatagctaacattcattgattaaaatgtgttagggccttattaattactttatattaatttttatttaattatcgtaacaacctgatgatataggtacggttaaagtataatttttaacaagttaaaaacatgaatgtcatatacatacggaatgaaaacattccaaacagtcatttaactcattaatgattggaaccattacaaaattaaactaattccaagagcattttgaggaatctggtatttatagacattttgagggaaaaaaaagtgttgaataagattttgaggctacatttaaaactggttaatatccttcaaagcaataaaaccacagtatttgatgttatcttttctattggatagaaatttatgaattaacgtaacttcagtcatctaaattctaaccaaatagaaaatagaaagtcaaacacaggtacattccctagataatgaagtaacttttagcaccagtcagtgctctggtaaaattttgaaaggtcatgccgcacccttttaaccttattcaacttttagataatttttcttgataaaattataattgtgtacattttaccaatgaggaaattgatgcttagagatattaaataacatgataagggaatcacagtaagggtagagcaaaagtggaacccaggtccttctgatactttaatccactgtcttataccagttgaaagccatttttatctgtcctataaaattctttgtgtgtgtgtgtgtattcaacattacttaaaataaatggaatcaatatttgagattgaaaaacctgtattatatgaaaatttttattatgatggtatcagttgcagtgagatttgtcctatcaaggattttgttctgttttgtttacatgtacatacatgcttacaatggtggaatgatgcattctttgcaagcaaaccagaccccaactaatggtgggtaaaggactcagagttagaagttatgccgaagatagactataacaggatatagttatgccgaagatagactataacagggctaaaaaatgaaggagggagacagactttgacagcaatgatctgaagagccttgatggaagaaagctgagaaggaaaaaactacaaacactgaaatgtacttaactctcaccttttcagtttgaagctgttcatagtgaactcagcctgtgttctaaataaacagacaccaaaaaaatcatgtgggagctagaatgttgactctggggattctgaatattgagctgatttatagtattccaactctttgataaatgtctaaaatgtttcaatacttaggctatctatgatttatttgtatttgatattagctttatgatgatattgtttataaatcagcatggattttgtgtgagttattacaagaaaagtttactcttctgattaattaaggaaagaaccacctaactttgtgaaacttctgactaatcaacatttgaaatgtgtttgttggcatggttttctaaaatagggagtataataaagtaggttaaaagaatgttgtatagtgaaggtccccaagagattgacctaatttatttattgtttaaaacaaaacaaacagaacaaaactaaaaatgatggacttgtacttcagactagtatagaataacaaggtccagatttaccctcttacctgaaataacacaaaaaaaactacacaaaatatatgaagtagtgattttcaagacactaatatcagctaatgaaggacagtggtccttgagagatgataaatgaagtgaactctatgatttcccaagcttactgccttgggagaatttccagaccatcatgctggggaagggggtcggtggagcttgatgaactccatgatatgaggaggtggagctgagagtccagggagaacaacaaggctagaattcacagaaaagagtaccagggaggagagagctgcccagagataggactctggatacctgcagaatatccatcacagtactgacagtgtattcatgtgaggatgctacccagaaccagagaaataatgacctgaaaggattacaggcagtgatatgcagcactctcactggcatgggaatagtgcctattccaccagcaagacttagaaaacctcataattcatgaagcattagatggtaaactctgaaggatcttgcctcaataatggaagaataattcgttctaaacacaactctggccccgcctaacaaatcttaagagcaagacccaaatggatcaaaaagttaggtagagacatggaagatatagaaaagacccaattcaaacttctagagaccaaaactgcaatgttggagacaaagtagaccacatgggaatagtgacagagtagacattgtagaagaaaaggttagtgaatgtgaagatatgtcaataaaagctatccaaaataaaacatacagaaaaattgtttaaatgaacagcacatcagtgatctgtgtgataacttcacacagcctaagatatatgtgcaattggattccctgaagggggaagagggattataggaaaaaatttcaatacaatagccaaaaatataaaactataaactcacatatctaagtaggtcaataaacctaaagcataaaaaagaagaaaatgacactaagacacatcatagtcaaatttaactaaacctctgatgaagaaaaagtcataaaagcatccagagaaataaagacactaaagatacattgcatacagaggaacaaagataaagatgacagcagatttctcactggaaacaatgcaatcaagaagacagtggatttgcatcttcgaaataccaggggtgggtgggacaaaacaaacaagcaaacaaacaaaaaaaaaacctgtcaacctagaattctatacccaatgaggctatttttcaaaaataaaggtgaaagacttttagacatcaaagtctgaaagaatttaccaccagcagccccacactatgagaaaagttaaaaaaaaatcaggcacaaggaaactgataacaaatggaattatatctacacaaagagaaagaatgcattcaaaatggtcactatatgtgataagtatacaagagtttttttcttactattaaatttctttaagagataattgaatgcttaaataaaaataataaccctggaaaccatcagtctcagcaaattaacacaggaacagaaaaccaaacaccacatgttctcattcataagtgggagttgaacaatgagaacatgtgggcacagggaggggaacgtcacacaccggggccagtcagttagtatttaggacaaggggagggatagcattaggagaaatacctaatgtagatgatgagttgatgggtgcagcaaaccaccatggtacatgtatacctatgtaacaaacctgcacgttctgcacatgtatctcagaccttaaagtataattaaaaaaaattaatcctgtcatatgtgtattataacataggtagaagtaaatgtatggtaacagcagcacaaagattgggagggggagaaatagaaatatactattggaagcttcttctgctatataagaaatggtgtaataatcaccattttgcccactttttaatggggttgtttgtttttcttttaaaaatttaagttccttatagatgctggatattagaccttggtcacatgcatagtttgcaaatattttctcccactctgtagattgtttcattactctgttgttagtttattttgctgtacagaagctcttaagtttaattagatcccacttgtcaatttttgcttttgttatgattgcttttggtgtctttgtcatgaaatctttgcctgttcttatgtccaggatggtattgcctaggttattttccagaggttttaaagttttgggttttacatttaagtctttaatccatcttgagttgatttttgtatgtggtataaggaaggagtccagcttcaatcttctgcatatggctagtcagttactccagcaccatttattgaatagagtcttttccccattgcttgtttttgtcagctttgtcaaagatcagatggtagtaggtgtgtggccttatttctggtttctctattctgttccattggtctgtgtgcttgttttttaccagtaccatgcatgctgttttggttattgtgaccctgtagtatagtttgaagtcaggtaacgtgatgcctccagctttgttctttttgcttatgattgccttggatattcgggctctttttcggttccatatgaattttaaaatagttttttctagttctgtgaagaatgtcattggcagcttgacaagaatagcattgaatctgtaaactgctttgggcagtatggccattttaatgacattgattgttcctatccatgagcatgggatgtttttccatttgcttgtgtcatctctgatttctttgagtagtgttttatagttctcattgtagacacctttcacctccctggttagctgtattcttaggtgttttattctttctgtgatacttttctaaagaagacatccatgcagccaacatgcatatgaaaaaaagctcagtgttactgatcattagagaaatgcaataaaaaccacaatgagataccatcttacaccagtcagaatggctattattaaaaagtcaaaaaataacagaggctggtgaggttgcagagaacagggaacatttataaactgttggtgggagtgtaaattagttcaaccattgtggaaagcagcatggtgatttctcaaggagctaaaagcagaactaccattcaacatagcaatcccattactgggtatatactcagtgtaatataaatcattctaccatgaagacacatgcacgttaatgttcattgcagcaatattcgcaatagtgaagacatgaaatcaacataaatgccaatcaatgacagattggaaaaagaaaatgtggtacatatacaccatggaatactatgcagccataaaaaatgagattatgtcttttgcaggaacatgcatggagctggaggctactatccttagcaaactaatgcaggaacagaaaaccaaattccatatattctcacttataagtggtagctaaatggtgaaaacttatgagcacaaagaaggaaacatcagatactgaggcctacttgagggtggagggtgggaggagggagaggagcagaaaagataactattgggtactgggcttaatacctgggtgatgaaataataagtacaataaaccccatgacatgagtttacctatgtaagaaacctttacatgtaccccgaacctaaaataaaagtttctaaaaaaaaaataaaaacacttgaagttagactgtgataagttaaagatgtacactatgaaacctaaatcagtgaccaaaataacaaaacaaaggattttaatgagtatgttaacagaggagataaaatagaaccacagtaaataattaattgaaaagttggcaaaggaagaggaaaaagagaacaaagaacagatgagacaaatagaaaacagagagcaagatgatatgcttaagtctaatcatattaataatcactttcaatataaatggcctaaacgttccaatttaaatgcagagattatcagattggatagaaaagcaagattcaactacatgctgcctacaattatctaactttaaatataaagatggaaataggtaaaagtggatggaaagaaacaagactaatcaaaagaaagctggagtggctatcttaatatcaaacacagtagacttcatagcagagtattaccaaggagtaataagctaatttgtgataggcggaatactaagatgacctccaagattccctctcctggtgtactaaatgcaataggtaatcctttattggatcttggatgattttttgaaagcagtcatgaagtacatgattcggtgaatatgaagaataaatatggattgtatattaaataatgttattttaagtaacatttaaatgtttaacatttaaataacataaaatacttaaaataacattaagtaatgttattttatcaatattaaatttctcagtgtggtatcagtgttgtggtttagtaggataataagataatatcttgttcataagagtgtatgctgaagaatttagggatgaagtactgtgagatcagcttcatcttacactcaaatagagagagagagaacaaagcaaatgtggcaaaatatgagcaattggtgaatttaggtatatggttgtttattttgctattattgaacattttctgaaatttgaaaaacttaaaatgtcaagagaaaaacggcatatgtcttttttaaaattgaaagtgacatcttgaggagaaggaaataatttgctgattgattagagggaagtgtttaaagccttatttaactgctcaaatgttcaaataggactgcagccagattggagaaaggcagaggagatttttttttttttttaaataaaaaaagcaaggagagtgaaccttggtgggccaatgcattttctccgtctttctacttcatggtaatttcctgtttgctcagaaacacacatcaaccttcccttgagattgactctggctttaagactctttgcttaagaatcttattcttagaatctgggtcgggtgctgtggctcacgcctgtaatcccagcactttgggaggctgaggcgggcggatcacctgaggtcaggagttcaagactagcctgtccaaaacatggtgaaaccccgtctctactaaaaaatacaaaaaattagacaggtgtagtggtgcgtgcctatagtcccagctactcgggaggctgaggcaggagaattgcttgaacttgggaggcagaggttgtcgcgagccaagatctcgccactgcactctagcctgggcgacaagagcaaaaccctgtctcaagcaaaacaaaacaaaacaaaaacaaaacaacaaaacaacaacaacaacaacaaaaaaccttagtcttagaatctgacaatcagtcctaaaatcttgactatttctcctagcaaaccccaaagctgactaatttttgtttaatatcccaaggaactttttacaaccacagtttcctgggcccattcctagaaattcaggttcagtgtgtttgggttggggacctagaaatctgtattttttctaaagctttcccagggacggagcatagctcccttccactgagttagaatttccaggagaggcacttgagaagctgtatttttaacaagtgtcattgatgcttcttatcattaagagagttagaggaacactgacctctagaaagtcctcatgcaaacaagaattctggtgccttactctgacattccaaagatcttgatactcaatatccccagatctttattgcattgaggttaagaaaaaagtgtgtgtgtgtgtgtgtgtgtgtgtgtgtgtgtacacctgcatgtgggatagggagataatttcgaaatgggcattctagcctgggtatttggggagttttattgactaagcttattcagatgatactaacattttgaccatttttttaaataaagaagaatctcattatctcttgcccagtaagtctatcattaagggaaaatttttctgttttggtttcttaggaatgagggagggattgcactgaaacatcacacaaactatccttgcccttgaccaccagcacacattgagaactggctggccaggaggagttagactttgaagtcctgaaataggctttttcttggtacaaagcaaaatgtgttcatgcagaatctaaatccatgaaccccagcctgtaatcaactccactatccagcttagatcaaagagagttaatacatgccttttaggtgtaatttgaatgaagatattctctgtaaaatctattggatttcacagtgagtgggagagacagagttagactttataccactcaagtggaccagggaccagatttaaaggttaaaaaatgagagtcacaggtgggaggagtgtatatgagaatacagaagcatgggtggatctcttcccctccttggaacttccgactgtaggctgtttgcctcctttgagccaggaaactgcccagaagtgggtgacttgagcaggtgaggcgttgggctctcttaggtaccccggcagttagggagacctgaactggactatcacacatcacctggtgatgactggagaattgcaaatcccaacttggccttcaggatggacaatgacctcatttgactcttctgggtgtctaagatccccatgagtagtagaaaaataaaattgtagatactaacaagggccatgtgatcagatgtagaaatgcagattgtaataggtatattttcttccttatttgatatgaatatatctgtacatattaatgatatttgtcctgtattcctctgtctgtcacagaatataaggggtgagttaagcccatatttcaatatttaaattgcaggataaacagctattgtgaccgacctagaaggcaaataaagatcaaccagttatggataaaataacaaataggactttgtggcttcactttgggggaaagtgtgagtgggttttggatgtatgaagaatagttgcatcaagtaggacagaaacattatgtggtttactttatatggaagttaaaaatgggtaagaagggtgtgtatggctgctgcattgacaaaggggcaaactgtggtggattgtccattgccaagtagatatcactaccattttcttctaagagctcttctgcattgcaggagagaagtagagtgctatatattttctgtccctttccctgtgcattcttgagttagtttgccagagagagtaacataatctattttttggagggttgaaagataaacaaaagctattatgcttggggtggttgcagctacatggtaggcaggcaggagacttagattggctttgcagggagtacatgagaacaagatactctgctggtgcaaactgaaacagttagtcaaaggtttctcagatattcttgcaagtgggagcagttttctgtcaagtttttgctaaccacccactttggtgtgtcaggctaaaatattcagtgtctgatgctctgatggttggtcaaaactttcttgaccctaataccccaggtattccaatatccatgtgactaatacttgtagtaatttctttattcctggaatgcttaaaatgattttcttttctttttttttttttttttttttttactgaattcaagcttatgcagacaatttgataaaagacatgcacatctaaaagatgaatttaaggaaaattctattggaaggcaaacaccataagatctatacaagaagtaaaggtactgctaagcacattttaaaatacaaggaacttaaaaacactataattttcaacttgaccttgagatctgcgtcttttcttaggcttcagtctgttttggagagccatctacataatattctaggagtcagcaaactatgtcctgtgaagcaaatccagcttgcccacttgcttttataaacaaaattttattgggacacaactttgcccattaatttgcatgttgtccatggatgcattcactacaatggcaaagttgagtgattgtgacagagaccaaatggtacacaaagccaaaaaaaatattttctatatggcccttcacagaaaacctctgctgacacttgtattatccgaattcccacctccttcaaaaattgagtctttttctgtcttcatcaacttggctaacttggtgggattagactaaataagattattaattttttggcaaagaggttttggatgcctgaaagaaccttttaacaggctcagagcactcacacttccaatctggacaacaatgtgccatttttaagtagctgagttcctccataatcatctgattacctttgcagtgtttcccttcctgcattgcctaaggttgatatgtatattgttgttgccttgtatggctcccagcagtccaatcaatttaggacttttctgaagaatagttctgctctctaattggacttgggcatgttacaaatgcagagaggattattcatttctcttgtaatcattaaataataaaaagaaaggtttcgatgtaaaagtgaagcattttgcatcttaaattcaatgttttggaagtagttaaaaagcaatttaagagtttactggaaatacagagaaatgtttattaaaatgttttatgagcaataccctttagtgaatctagtcaaatttttattttttattaataaaattaataaaaaagaaactctctggaaaggtataatttagaacacatagcagccatgttatgacattcagaagggattcttgaactttcagttacgatgctgcttctgctataattcagttaggctgcaaatatagtatataagataatgaatccattaataaatattatccatccatgtgcatatgtcattagttaagtccaacccatgttaatttaatccatgtttaaatgcatgcattatatatttattatctatgtatctatctatctatctatctatctatctatctatctatctatctatctacttatctatgcagttcctactatgggccaggccctgctttgattcagggcctgcgcttatgaggacaggatgaaaataaggagagaaaggaaatttctagagtcctttcttttgctcagctatagagaagtagtatttgtggccctcactctaacagcgtgagtgtggctcagtccggtaccctcctccacacttacctctggctcatgtcctcttgctgcacagagtaactgaaaaaacacatgggagaatcattggaaaaggatttttgtttgtgtgaagagtcagctctaaagtttgtattggaccaaagttaatatggagcagaggaagctgcttgcacttcttccaactccatagtctgatatttattcttcttgacaggaagatagactgccaactttgtttttaattatttgaataaaatcacatacatcattctcccttttctcgtgctttcctctgaaatcccatcttctgtgtaactgatgctgatgaaattgccggttttggcattaatgcttctgtcagccaagtgagattgactgagttaatctccacaccctgaaatgaagccaggaacattgagccccacttccctctctcccctagctctctacctcccctcagctttttacctgccaccctccagacatactgtatgtctctgtggcatctaacctggcacctgaataaacattttcaagtacttttttaattccctaccttcccacatccccctttttctttattttttctttctttctttttctctttttctttctttttctttctttcttttttacaaaatagttgaatcctctttttttgtattctagtgtaaacatggaacaaatgtgtaactcatcataatggacatctgttacataaatagtggtgagcccatatctcccagattaatcattgtttctattcatttggaattagcaacctgtgacttcaagtaactccctgatgagatggaacacacattcttttcacagatgcatagaaataggaataaatctacaatttggcaaatgcaccagatgcagaaaacagtgcatgcttataataagaaaatataataactgtcttggactaatatgtggttactctgacaaagaggaatttgtatagtcgaaacttcttgaaaacagtctcacctgcgtaagtgttttctaaactctggccccaggggcctgcagtttcctgacaaagttttctcatgttattttttctccttggagacttgaaattcctcatcacttagaagcaagatagaaatttggaggctatgaagcgtaacagaattgtcgtctgtaggagccagggtcttactggctacccttccttgttgaggcatgttttcagaaagagtatgtttctgtgtgctaggactgtgtatccaagacatctatcatatatggaccattgagtgagtcagcataagctaatgattccacagttgtgtcccactgcacatttagagagaatattttactcataccggaataaggagtgtccatcataaaaggtttgctgaacttatttatgctataaaataatgccagcttttataacgaagtcatttgttcattcagcaattgtctattgttctgctcctggcactgttctcatttgggatataaagacttgtatattttccttaaaagtgaatagtctaataaaggaaaaagatttgcctatgcatgaggacaatactgcatacgagatcctttctgataagtacctgcacaatgaaatggtcagtctttcctcagtgagctggaagccgtaaaaagaaatacagaaatgacttgagggtgaaggtggcatttcagcggagttttgaaggagggcgatttactgggaccttggatgtagggtgggacagaatgggaatgtgactatcttccttagattacatcctgtttatattctgcttctaaaggcaatcttagagtgtataagatgtaagtaggaaaattatatagtgaggttccaggtttgagagaaagaggtaacagcttaggccacatgaaatgattataatctgatggtaggagaaacaccaaatagtaaggaacctgtggttccttacacttgactatgctgagtatagacaagttataagaaaactttgaccaaaaaattatcaaaaattgtatttccataaagttcaacctaacaggtataacatgcatgtacatggcacaaaatcccagaagacaaaaaggagggaaaagtatgtctcaatcccatccctctcccccagccactcattttcctacttagagacctctgctagagttcttccaaaaggtattcttgccatattcaaacatttccataatgtaacatgttaaaaggggggactcgtccagggtcagttttggctggggaatgaagacaatgaacatcacactccaagagaccaccaggacaataattctaagtagaccatggaaaacctgaatagaagactcaatgacctgacagataaaagggtcaaggggacagaggaaagaggtgtttggtagagggatttccttggaagaagtagcactgagagtcccatttcttactcccaagaatgaaggcaaggagactcctacctctagccccagtcctagtgaggggagcatctgtgcaacctacactgaaatgtgaggtctgtgccttgaaactggagagcccagagcgctggtgcctgactcatctgaggaacgctgagtggcctatggtagaggggaggggactccatttggaagggaactgccttcccaccaaagtgcatggattccagagaccagctgtggagctcgtgatgggaatattggcccagggttgttttaacaggaatcttatagcaaggtgttacaagttggtttctctagtaagtacaccatgagaaggagtttagtgtgcacatgtccaatagtttagtgtgcacatgacccttggggtcaacacctgggaaaaggaggggaagaaagcgggatttgcagagggaagctgagcttcaatgcaggcccagagtcagctttggccatttccatggagagttctggagtaaaatggcccatcataatggtcgcacttgggccaaatgacaggaattttatacctttgctttgaccagtggccattgggtataggccaccctgggaaggatgtgaccttggccgtggcagccttctgctgccaagttgctgccagctgagagctgtctgcctgcagcactctcagcacaacaaggctttccttgaaaagggatcaagatgacatatccgaatgtccatcaccctaggcaaggggacctcagcattaggaggcaattgtgtgcaatgctgggacagatgctaagaggggactgggaacagtgagtgagacaaaaggccatgtcacgttacaggtgttgtggtcagggtggcccaaagggaccccgtgaaagcttgcatacctgcctcaagaaggcagctgtcctagagagtacaaatccatctcacaacggtatgagttagaagttttttttttttttttttttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccatgagttagaagtttttaaactgcttgtataaccaatggcacattcatgttgagtaatctgaaaagactttagtaaagggtctagttacaaaggtgtgaaaacctcaagtgtaggtacgctacctgtaagctagtgagtggacactgttggcatcccatgccagaagggtggagggaagagatcagcttccaggacccagacacaaagagagctgagtgaagagggctacctgactaggctgtgaccttcagctaacagaacctgaccaagatcactttgcagctacaacactgggggaattcctacttcaaactgaatctcttcactttctctgatactatcctgagactccccattggaaggctcattcacaaagtccatttaggtcagcccccaggggcacagagccagacctacaagagaggagtgtgcaaatcttctcttcccccactggatcgagagagagagagagagagagagagagagagagagagagagagagagagagagagagacagagagagagagacccgagacccactgcttgcccttcccaagcagcaagcaactggacactggacagcagcctgtgatggctggggataggtgtggagaatgttttcagatgatggctgagaccaacttgcatgtctgtactctataccaccctgaggtcacaatacatcagtgcaacttcctagttttcaagatgagacacaaaataaagtgcagttcttgggtctaattgaatcatagaatgggtgggggtaggtggaggagtaacctgtcccttggtgtttgctctggaaaggcgaggggtatcatgtttggttcctatctttaccttacctccccccagtatcaaggctgatcttttcatctcaggtcacatgcttggccacagctttcctttcactgaaatttctgaatctggatgaaaggaatccctggaattttaaccctgggccttaattgaagaaattaatcctgcgatatttgagtcttgggagaaaaagacaccctagtgttgaagtttctgtggtttattttgttgctagaaatggatctttgattctccattgaggatgggggctctttagttgtaggggaaaagagacaaccacagtaactcttttggttatgccaaagggaagtcatagctctaagccatctgcataataattcttcattgtaggtcagagatgtacactcacaggaagcatacctgacgctggtaatcaaggataaactttggttgcctctctctaggtcccaggagagtgtggatatgggagaggcaaccgtcaaaagcctttccaggaagagtagatgggggtgggggaggtgggctcaattctgcaacgtagtgggcactgggagctacgctatttcatatccatttttacgttttctcttctgcattacagttctctccttttaggctcctgtagtcagtaaagtcttattaaaccctgtagcctggtcttagcggtgctttctgaaatcaaaggagtggtcaatgtctctgtaggggacaaagttgtgagaacagttattgcagcctgctgggaaagcttgtgagatattaaggtggtaaattccaaggctggctgtagcctcaagggcaccagagtgaatgaacttaaggaatagtcaacaactatctttaggaatctccatgtcaaagatacctgggcagggaaatatattgtgacatgggatgggaatttgaccacttctcctgggatattaaagggaagtgccacaatgaagcaggagcacttgggacatctggatattaattccaaggagggaccttcgtggtttctctaaaaggccatcttatccagctgctgcttggatatttgtaatcatccttttgtcttgtcggatgggactatttactagaaaattcttccagtgaaagataaatttgggctcttgacctgccttttcctagctacctctttgtattctcttccgttctgcacttttctcttcagttaaacattgctcgagaagcgtggtgtatggtagaaacattgatttggagtcacagaaactcatattcaacattgactgtacttaaagactgcatttccttggaaaaataactgaatttccccagcttgaatttctatagctattacttttaaaatgaggacacttaactacagttactctttttgatgctcatgttttcatcatagattagtaggagcctctttaagctggttctagtttccttctgaaataaccctatttatctttgaaatcttccttgatttctggcactacatggtgtcacaggctcatcttgtatcttctcttccactatatcagactttgagttggccatctctccaaggaacactagtacctttcagtgggggaatgaaattagaggccaaaatctagggacttgggcacttatttctaccagaatgctgttgctcctaggtcattttagttgacagagccagaaagtacatatttttaaacttgtgagctcatattaacatttccaactcaagtgaacagtacttttttttttgcttcttttgttttataatcataactttgttctcttatatggaaaatctttttacataaaactattagcatgattacttcttgtctctatatttaaaaatgaagaaaatatttcaaagtaacaatgtaagtattaccacaaaaaataaaacagtgggatgaatgctaacaagaacaacagcaaattactaattgaaaactaccaagctcacacagttgtaatgaggagtaaatgacctcctatgtcaatttcccggaacctaagacacagtcagtactcaataaatgtgagtcttctactcctcccattcccaactctctgtctcaatcaaatctttccttagtgttcctttcactattggataaagcctaaacacaagctggcattttagccttctccaaagatactcctgtctgctttccctaatcccaaactgctccctgtgctcttgttcaaatgccttcaatcctttcaaaatgctgtatgcactttggcttttgagtttggcttgtagtgttctatttacctcctttcttctctcccttccaaatgcatcatctattcctttccttttgaattggtatgactgctttaacagacattaaattcatatatatatgtgtgtgtttgtgtgtgtgtgtgtgcatgtgcataagtgtgtgtatatacacatactatatatatttggatctgttttctggattttctattctgttatactgatctctttatctgttgtcatgttaatgccacactttcattatagtaactttattatatgttttaaaacattattaagcaaatcttcattattacattttaaaattttcttgcaattttcatgaaactttacaatcagttttgatctgattcaacctcccaaccctccatcaagaaaaaaaaaaaagtcccacattctaaataactttgcttggacttttatggaaatagtattaaaccagtagattggcttttttgtgaccttaagtcttctcagaaaggaattcttcctgtagaaaatcttgttttaattcttttaatataatttaatggttttattcatgtaggctctgtacctgcttttaaaaatgtattttgaagtattttgttgctattatatttttctttaaatttccacgttagttgctgtttttaaaactactgttatttaaaataataaaactattattttataatacttttacatttacagaaaggttacaaagatagtacagagagagtttccatatactctgcacccagttgcccctaatattaacatctgacattagcatggtattcttttcgaaagtaacaaatcagtattgaagcattaaaactaaaacccattgtttattacatttatttaatctttacctaatgtcctttttatgacccaagatctcatccaagatgccccattgtatttagttatcatgtctctttggcctcctcttggctgtgatggtttttcagacttctcttgtttttgatgaccttgacaggtattttgtagaatttccctcaattaggattcatctggaggtttctcataattagctggggctgtgggttattggaagaaagaccacggaagtgacatacccttctcatcacgttatatcagtggcacgtactaccaatgtgactttgtaatgtggatattgagcttgatcacctggctgagtagtgtttgtcaggtttctccactgctaagttattcttttttttttttttttggccctttccatactactttctttggaaggaagtcaccatgcatagatcatatttaagaagtaggaaattatcttctaccccccgggggcagaagatctatgagaattatttggaattcttctacatgtaagatttgtctgttctcccatgtatttatttattcaattatttatttatatcaatatggactcatggatatttattttatactttgggttataatccaatactgcttggattgtattcaattatttattcataacagtttggactcatggatatttattttgtacttgggttataatccagtgctgctttatttattttgttgctcaaattgtcctagctgtggccatttggagctccttcacttggctcctgtgtccctttggcatactctcatgattgtgattgtttgtttttttagtacttctttacttctagcactacaagatgcgccaggctcattttgtgtgtttcctgcaccagctttaggcttagccatctctccaaaactccctggtttcttttatttgagaatgatattaaaaaccaagatctgggtgctaaattggctttttactagtaggctctttcatctggcagagctaggaaatatatgtttgcaaagtaagccatgtatgtgcacatatctataaatatttccatatgtgaacatttgtatccacattaagccaagcataaatcgctattgatttttggcagtatctattaattttaaaatggacatacacttttacccaatactcctaatttggagacttatttatccagaaataaaattacaaatagatgtatatatagagcaagggatgtttactgtagcattgtttatggaagaaattactagaaattattgttcatagaagtttattactagaaatagccaaagtgcctataaaagtatgaacattttaataaattactatatattcatactgtgaagcattaggtaaccattaaaatataattaatcctttcatgtattaatcagaaatatatcaaagattttttggtaaatgatagaagcaaattgtagagtaatagagtcctatttttttaaagtttgtaaaaagtttttttttttttaatgtaggtacatgttacagtgggcctgagaaagatgtagagagagatgtagaaaaatgtataccagactgttaacaaaattgtgggattttggaggaatcagaatattatttaaaaatgcatataccttaatattatatgcttcctatgatgatcacactttacctcattttatgttcttaagatctaataagatcatttcaatcatacacaagaaaatatggagggatggatttggacttacatgggaaaggtgcttgaatattattccactttaatttgcatactgtaagctctatatgttgttacaaattatcttttggggctatcatttggggaaacatacaagatagaacagaacttcattattagaattgtgaaaatcacaatggcatttgagaaccttgtttcaaatatgtgttactgtctgctaaaaagataccacattgtagtctggtgatagttaatatttcaatcacataaaaatgtttatttatagatatatttataactccctattcaataaaaagaaatataccttttttcagattcttaagttggtgaacaagtcctcctctttttttcccaggtctgatctaaggacaccttgttttcacttttctcctctgtgaaataccagaaagagagatgaggtagctaattcagcatttatgagttggagatacaatttcaccacattaggcagtgcatctgaaatattcccagcacctctcctggacaccagcagggctgctggacagtggtggcaggagtgtgctgatttattctcaggttaaacacaactgcttctcctcctctgtttctcaatattgttctgttataaattaccagatcttctcagaagtaaagagaaaaacaggcataaggatgatgacaagaccatgttcgatttcttgtaggaaatattcttcaggtccaatataagtattttattgaaaacttaaagtttgcttatactttcaatttttattaattttattaagtagtaaatactatatttctaaaaatgctaataagcacttaattaggatattaaaaattaaacctccaatagtttaaatgtagataaactaatattagtgatttaggattaaggggggttacagttctagaatgttttttaaagctcttgttggtaaaattttagaaaaaatctttaatctgatatagcttgttctgttcatcctcaatgaacatttagttggtagtttcacatagtcctctttatgatggcattgccaacttctttcacttggagatagcatagcacagtgaaaattgcgtgcagtgagaactgtggtggtaccagttctgggtttgaatctagcctcagtcaagtttttcaatacctcagaaacttgtttttttcctctgaaatgacaatgaaaacactgccttgaggattaaattaggtaatatacaaagcagctagaatgcctgtttaacaaatgatagtcattgatgtacatatgaaacaatttcatcgctctctgcttctaaatagtgagccaatgaatagaagcagtaacctatctgcttaaatgaagagaaaatgaggtgatgatgcaaggtaggtgagcccccaaattggggcttagcctaggaggattcttgcctatgtccaggaaagaattcaagggttaaccagtcgtgttagacagtaacttttattgaagcagcagaggtactgcttcttgcagagcagggccatcccataggtagtgtgcccagagtagcagcttggaggcagttctgtagtcatatttatacccacttttaattatatgcaaaataaggggcagattatgcagaaatttctagaaaaggggtggtaacttccaggtcattgggttattgccatggaagggggtggtaacaactgggtgttgccatggcaatggtaagctgatgtggcacactgtgggcatgtcatgtggaaagctgcttccaccccatccctgttttagctagtcctcaatttcgtctggggtctgagagccccatctccaaagtcaagtcccgcctcctacctcaattcagagctgtgcaaaggaaattaagaccatgactttgaattaaaataaatgttagataaggaatccaactccctgaaacacatttaattattatagcctaatattacaagggaaaatgtcagtatttaaaggagccctcaaatgtatcatagaactaccttggaggatgaatcatttatgactgtggttcatattttattttaccaaaccagaataggttttcctccagaagtttcagagcaaatatatccttctcaacattaattgcattgtctccaattaaactttgattgttgccaattcacaggaaatttggtttgaagaaagcatttacagttttgggataacattcattgcaatgccacagaagtagaacacagattaaagaaacactttccaaaccaatgtctggattttgtttggaattatcctcaaaaccccaattctgaagcttaactgggaatatcaaatgactttccatgtcatttatccctcctatcccctacttgtccctcctttctgctgaataattttttcctctaactatggcattattcattcaactgaactaactaccatgaaggtgaagcatactgaaaacccacacaatgtcagacgtggaaaaatcagctaatattttcaattgtgttataaaaagatatggactatacattgtagtccattcatgttgcttccttttggaaggtcttacctagcactgacacatgaagccagctgtgcctgcccagagttggaaatgttacaggtttcaagaggcagttccttgtgcttgtatttggaaggcaagctcctttgtgtggtgtcccaccccaccctgttattggtatgaagctacatatttcaaaatgtcttgcttatgaataccaggcagaaaaagcacccatgtaagcatttaaagagagggaaaaaggactaaactggatgaagagaagcataaatgaattttggaaaccctgtttgtttttcaatgagatcccctgcttcctttttcctcccccttctttcaatccttatggaactatttcagagccaaaaaaaaagaaattcaggggaaaaataatgtttcaactttcataatgttgcagtatttcttctctttgcatttttcttttcatgttgaacaaataattcgtttttattgtattttacccaatttccttttgaatttgcatttctgaaacctggccattgtggaaacacttataaaaaaaatgtgacctattatttactatcagattttgcctattggagtcactagcatctgccagtttgcatctctctccctactgcatacacacaaatccattctctctttcttgcctgtcctgaagactgttgcatttctgcgatttttataacactcaattattttgggatctcttacaactttgttgtgcaccactcatatttaagtccttaaggaaattctacaataaataatacttttaaggctacagcttatctctttgcaaatttatttattttattttttgcttcattctgtcatatcatgaccaagattacaagccagtctaccagttgctgtatgtgtaatttctgaaaagaagaaactgttagattcaaagtataattgtttttgttttcaataattcattcaaagcaaaaattacctatctagttttgtgaatccttaattattttgttctatctatatttatgttgtctgttgctatacttatgtgaagacagaaacgtcaaactaaaggaaaataaaaatcaaggaggtgttctcttccttccttccttcctttccttgccccttcttctttttttttccactgaggccttgtcaatttctttactataaaggacaggtgaaatcaggagaataatgattagttgcctttataaaaaaggaggagactcctggtatcttctaaaagagatggtgacttttgaaaagggagcacccactctccaggtcaatacaaatgcttaaaatatgagaattatttttgccttagaattttggatcatttcattttctgtttggtagcagaataaaataatcacttttactcttcatcttctcatccttgtggactctcttctcctttatccccttcagtttgtcacttaattctttttagcccattaaccagaggagaaatgtatctggaaaaactatggttgggctagacccgtaacaagcagctaaatgaacttatgaaatcatgtttatccgagctattaccagcttctgctaacacgcacacacacacacacacacacacacacacacacacacatacatgactagactagaataagatttggttgattttctgctaatatcaggggtttatataaaatttttagaacctaaacagatgtcaagatatatccttttccttcctaactgtacactattatgcctgaaataacaggatccagaattatttaagtttctagtgccagccaattcaaaatagatttaaaagtaaaatgtattggtttatgtaactgaaagttaaaagaattagtgcagacttcaggcatggtatgatccagggagtcaaatgatgtggtaaggagatatacatatgtgtctttctgtttgtctgtatatctatctatccatctaatcttttttcctttttaaattttcagtagtcttgtgcctttttaaatgttttattgtgataaaatatatacatataacatgaaatgctattttaatcatttttaagtgtataatccaatggcattaattatattagcaatgttatgaaaccatcgtgactatttgtttccaaatcttttccatcataccaaacagaaactgcatacccattaagcattaacttcccaactcccccctccccaagccccagcaacctctaatgtactttctgtcattatgcatttgcctattctagatatttcatataagtggaattatacaatatttgtccttttgagtatggcttatttcacttagcataatgtttttaaggttcatccatgttgtagcatgaatcagtactttatttcattttgtggtggagtaatatttcattatatgtctataccgcattttgtttattcatccattggtagatagatatttgggttgtttccatcttttggctactgtgaataatgctgaagtggacattggtgtacaaataactgtttgagtttctgttttcaattcaattgggcatataccaaggggtggaatttctataatcttgattcctttttcctctccatggcttcatccttaggtgagcaaaaacaacttggtcctcactcctacagttctttaaagaaggcagatattttctctcccattgcacatattaaccccaaaagagaaagtctgattggccatgttctgataccaacccttggatcaatcactgtacatagagagaaactccttcatagcttcatgactaataaccctactgtgtgggaaagcagttttctacacaaaagagacactctgtttctatgctgggggtggggagcagaggaagagacatttgcttgcagtgtcatcccaggtgtgggtagaaaactcaccttggttgtttaccagggacccttgggtgaatggaatactttaagaaagatatagttagggttttgacaagaattagggaaaacagaaactgtcagtgctgccaattggaataccaattgctatcacctctctggagaacattttgataatatctagcacagctgaaaatatgcagatgttccgatcaagcagttctgtccttaatatagtcccaagaaaacctcttcccctagtgcctaggaaacacggacaatactgttcattgtagtactgtttgtaatggtgaaaaatggaaaacagctgaaggtttcattagctgactaaaagataaactgtagtgtagtcatagaatggaatgttatgctatcattaaaaataacctagatttatatgtatcaaaaaagatggactcaaaagtataacactgaatgaaaaaaataaagtttcagtatcataaatactatttgcaatagcatttatgtagatactagaaaacatacaagactatattatgtattgttttgggatatattatgggattaagatgtatatgaaataaaattaaaaacctgtgtactggaagagtacccaacaagttaaataatgaaaaggcaaatggggcacaaaaaaaaatcaagggtttttaaaaattaaactgctcttttttattttaaaaatagctaagttatattgaatagatgtgagtagttgctaattttggctggttgatactgtattattttcttttcttcactgttccatatttttcaagcttttcacaattaaaagaagtagcacacagttggagttcaaatagaaattcaatttttttctttaatattaaaattttgggatatgtaataggtatccagtttatcctaagcaaattaatgcaggagcagaaaactaaatagcatgtgttttcacttataagtgggagctaaacatggggtattcatggacataaagatggcagcaatacaaactgggaattactagagaggggagggagggaatagggaaagggttgaaaaactaactactgtatactgtattagtcctttctcacactgctgtgaagaaatacccaagactgggtaatttacaaaggaaagagtttaattgactcacagttccggatggctggggaggccttaagaaacttacaatcatggtggaaggtacctcttcacagggtggcaggagagagaataagtgcaagcaggggaaatgccaggcacctataaaaccatcagatgtgagactcactcattatcatgagaacagcatggggaaaccacccccatgattcaattacctctacctggtcctgcttttgacacatggagattatggggactacaattcaaggtgagatttgggtggggacacagaaccaaaccatatcaggtactatgcttagtacctggggtgacagaatcatttgtaccctgagcctcagcatcacacagtatacccaggtaacaaacctgcacatgtattctctgagtctaaaataaaactcgaaaaaaataggcaggcaggcaggtttgttggggggcgggggagagagagagagagaatattgtgttttttttaacttggtatctttcatgtaatcatatgaacaagctcttgccaaaatctccctgccatgctatgctacttcacgccattttatatcatttatgtgttagaatgcattttgtctttaatcttccctgtgccagagtatttcccctaagaaaatgcccagtgtgtttcccattaacctcaaaattcctgccagggttcagccttacaaccctgaaatgcctcctatcatttcagcaaacagtgagactgctccctgaacattaaaagctggcaaaagtaaactatccaaatcagtattcgtatcagaagaaagtcctgggaggtgaagatggatttcagaaatcctattcataccaagaggaaaaagtgattaaataattgtgcgtgaggcagttggtgacagccttgtctcttttggttttgtaaaaacgataacagaaagatttgcaatatcatgcatgattctgaagtggtaaaaattttataatagaaacttaaaggcaagaaatagaattgcagagagagcattgcttgctgagcactgacatcattgcgtgggaatgaatgagtattgtcttacacaatggaatgcattctatctctcctctgagagggaatttggcttggtatgcaaattaaaatattgttttgaaaaatctgttgcatcaaattacagaaagaattttttcgctaatccagttctttggtccattgttggcaaagcaattgagagcaggctcgtctagccagtttgtctggggctccagtcttggattttgtgcggagcccaatcaaggagaactgtcctttggcaaagaagcaaaagagccctaaattcttggggtctctgcttaaatgtttttttcaggcataaaagaaggaaggataatttgcttgaaatacttgtaaacccttaaaggcatttagaatttgagtgtttgttattttgttctccctttgttgggaagttggcaggtgagcgactatgtagctggcttgtgttggtaggtggccttcctcttctttcaaacttacctgaaggggcctatccccaaataaagtctttcagtctgaagttttgcagcctggaaataatctgaaactattcagaaatgtcatacgtttcacagctctgctccccagtgtccttggctggcgtggccctgagttcgctgatggggattcagagaacaactgacgccaacattcatgctcatggctcatggctcatggctcatgcctcgctacagggcagtggcttgtgaagagttgtcctgaacaacatcatcaacatcacctgggatcttgttagaaatgcagattctcagagtccaccctagacctactggggatggggcccaggaatctgtgatttaacaggttcaccaggtgttggggtctacaatcaagtttgagaaccactgctccaggataatctgtctgtttgggtgtagaaaatcccagttctgagctccttcactcttcctcctcctgttgtaataattgttccttattgaaatagtgttagaattattgaggaagaaggtggagagagaaaactggcattcatcagacagctagtataagtcaagtgctttacatatgcaatctcagtgtttcaagcaattatgagaataggtcatttggcccaatttacagatgaacaaactgaatatttaattacttattgtagcaaatgtggttgtttgggtgttcaatgatgatttctttttttttttcttcttttgttaacagaggaatccagatttactgcaggtatcacgtagttctgtgttcaggaaagagggcccagccccagggtatggaatatgattgggtttaagtcaaacatggtattcctcctcttttccagtgattgatttgaatgtggccatgtgacctggttctggccaactaaatgtaaggggaaatttgtggatgctgttggaaaaatgtgttctctctgattaagtaaagacttgcataaataaaaatcctcattcctttttacattggactgctgtcttgtgaggatgcagtatttgtttggaaccacagcagccaccttgcaaccatgaagaaaaagtcaagggagagcggttgagattgccctgcctggcactgttctgtttctggatttttggttgtgtgagttaacaaatctctgttgtttaagccatattttattaggtgtcctattattttctactaaaagcgtacattctgagggtacacatgtttaccaggcaccagaataaagattagaatccaagtttgactgatggtaaacatcatccgagtttgttctctctctaacctatctgccctcctgccttttcttccaataaaaatacattttgcaggggtatatggataatctctgtgtcttcctcttaattttgctgtgaacctagaactactctaaaataagtctttaaaaaattatagttacttttcagtgaccccctccaccactagataattaaataaataaataaactttgtctacaatcagtctacagaatttaaactcctagaaaaatgactagcaatgatatgaaagtttttgaaaacattatattaagtgcagtttattctaggccagattgtcccaaggaatgttttatcagtgcttttcaggtagcccgatgtatttcaggtgcacatatgataagtacattcttctggtaaaaatccaagtattatacaaaaccaaagctttccatgactcaactcaattccacttttctctccagaagtaatcatccatctcctgttaataacatgttttactagttattttctgtgcatttatatatttatatgctcagatcaagataaattttttaaaaatagcatttttgcatatattgtactgattttttaacttcacagcatgtcttgcacattttttcacatctgttaagtgtacttttatattattttcttttctatataaattattttctttttttctatataaatattttcttattatattcagcctagtgctctatcataggtgcataccaaagttttatttaattatccctttggctaaagcaatacttggtacataataggcacttgataaacatttgttaaatgaatttgtcttcgaaattacttagggagtttgcagtttttccttgttttaaacaatatttctatgtaaactttagagtccgtttgccaatttgcccaaaataaatcatatttggactttcactggacttttattggcaaggattgacattttataatattaagcttttgcatgctttttttgcatgtgtatttcttcaggatagatattttggagagaaattgctgactcaaatggtatatgaattgtaaagatttaatagttattaccaaaattatttttaattcaacttctcccatttattgtactatcaattgtatatgatggtagcaataatggtgatgatgacagtgatgatggtaatgatactatattgcaaaagaacccagtgcttttctataataatttatctctgcttatcctcaaatgtctgatgaccttcagcttttattactgctcattttgagtgtggagaaaagttctgattctttagctaaacccatgttaggaaaatttgccttgcctgagagtatgcattttatgatcaccaccaacatattggactagtcccagttaaatgttgagtaatgccttgaaccactgtcataaaatgccctaggatggcaaaggaagacttctagaagggatgacaagcagtgaaaataaaataaatacttgactattggttcatgtttatgtaactgtcttgctgagtactaggtatcccagctgagcaccttgaagtccctatttcctaataaatctccagatctctgtgaatggacagatccctgtaccttaatggaagcacttacctggctgccttcacttagaatttatttttacattttaagcaggctatgcaaagtttgcaactcctaatcttcatcataccatgactagttcatcttgttaaactagcaaaactgtgaacaatttgaagagttcttcttttgctgtcatttatgtgcctatgagttttagttgtttgtgtttctttggcaaagtatttgcatgcctgaggattaatgccactgacccaattaacagtaaacctgatcaactgaaataactcgtgtgtatcacaccacattaagcactgatatttcctgttttaaatataaagtttcgttctaaataatagattaaatccttaagaaaatggttgggggatttatgaatattcagaattgcttagattcaatgattcaagtacatttttaaaaaataaagtctggaactcttgcttagagataacatttttatcatcgtaaatatttatttaaagatttaagactttcaaaatatgtccctatgggatgtcagatataatactgtcactgtaatcttaccatctcttgtaatgctattgcccaaaggtcactttggggcaaaatctgttttcctttatgtttgcctgaggagcaacgttgcatccagcagaaccactgggaaaagaagcccttccccccgacctgattattgaagcagactctggcccatcccagagagggactccctgacctacattcctccttccctggctatcagacagggtgctcctgctgaagcaggagctgaagtgttggtgaggctcctgcatgtggcccactgctctggtcttagatgattctgaaagatctgctacctgtcctgcaggagctgctggtcaatgaaaatcctccagattgatgatgggagtgcattgggggagatgaattcattgtgagtgaatacatgaaaactagaatgcctgtccaaatgtttattttgaaatccaaaagctatcctctgtccactgctggaaccctcgcttgcacgtttgagcttaaagctgtcgaatatcaaagcctggattgcaaatccacacatggagagaggcgatttctagaaacagaggacataaccatagagaaaagaatacttggtcctcacaactcaaaatgtggcccatggaacagcattgccccgttacctgtgagcttgttggaaatgcagaaccttgggctccactctggacctattgaatcaggattttaattttaacaagattccttggtgatttgtatgcgcattaaagtgtgagaagtgctattttaggcagtgttaagactaggagatgttcttgttctcacttacagtcacctgtagtcagtttggagtatgtcaaaggaccctcacaggaaagtgtttgcatagacttatatagagaacttgagatcagaagtggcaataatgaaacagtccagcagttaatggtagagctctcaccagccatacagtcgataagctctgcgtggttagagtaggaatccccaatgaattaaaggctgaccctaaacaattataggctgacactgaaagattatagcagtgacacatcagcaggttttgggtgaatcaacatgagataacactggctagagacagctaaaaggaaaagatcactcattaagtatgggattgtgccctttttatagcaagccctgtcttgtctgtagctgtccattaaatgctatgaataagaaaagtagtatgattttaaaaatattgaccttgggtggcttgcaggacctggcttttaactcttgtatcatggactgaatttggagctgactcattctcaatattctgaaatagcgatatttgaccatgtacagttaaaaaccgaggtataattatacttcaataaattgcacaaaactttgtttcagttaagttttgaaaactgtatgtactaaccatccgaaaccagataacatttctaccacaccagaagtgtctcttggccccttttgggtcacttcaattactgttttaatttctatcatcatatattattttggcagttctagaacttcatataaatggattcatacatatatactcttctgtttgacttctttcactcagcatgtttctgagaaacgtccatctttgggggtgtatgagtaatttatattttttattgctgaatagtattcaattgtatgaacaaagttttatccacttacacataggtgagcatataggtaatctccagttttgagctattatgcataagacagtttcgatcattagtaaataagtcttttcatgaacatgcattttcattcagctacagtagttgtctaggagtggaattgctgggtcttagggaagatgtttgtttaactattagaaactgccaaacagttcttcaaattggttgtactatttcatactctgacttagaattttaacatttttaattagtgggtttttaaaattatttttttagagaaggatcttgctgtgttgccctggaactgcagcctcgaactcctaggctcaagtgttcctcctgtctcagcctcccaaagtgctaggattataggcattagccactgtgcccagcctacactgtaaatagaaatgcacaagagttctagttgcttcctattctcaccaatatttgatgttgtcggtcttttacattttggtttaatttgcatttatctggtaactaaagatattggccactattttgtgtacttatttgtctttcatacaatcttgttttgtgatgtatctgtttgagtaactcttttgcccatttttattgggttgtctttctgttgttgacttgtgggagtatcacagatagatttctctcaacttacctatgccttcagtacctcagagcctagagtgcctcagatgtgctttctggagttttcagttctgtttttggacatggctgccttgcacttaggaaagtcctcatttatctcacgggtgtatcttttttctacctatcccagcttgatatagtttggatgttgtccccacccaaatcacatgttgaactgtaatctccaatgttggagatggggcctggtgggaggtgattggatcatgggggcggattgctcatgaatggtttatcaccatcttcttggtactgtcctcacaatagtgagtgacttcttgtgagatctggtcgtttacaagtgtgtggcatctctctcatcactctcttgcttctgctctggccatgtgatgtgcctgctccccctttgccttttgccatgattataaacttcctgaggccacctcagaagcagataccattatgtttcctatatagcctgcagaaccatgagccaattaacccctttttcttataaattattcagtctcaggtatttctttatagcaatgcaaaaacagtccaaaacacagcctttggcacaataccctgagcatttggtgacagcctatgggaatgatttgatgggtcagtgcagaccctgtggctgagctccttagcattctcatctgtcacaccagatcacatgtgaccattaaacttttgttaaaattttgcctagtttctccttgttctcttccatggtggatttcttctccacccatcattttgctcagattgagaacaattagggccgtcttctcacctatgagaggctcactgttttccggaaccatgttgatttatgtttctttgcctcctccactctctggtgaattttataaaacttagattttgtagctcatcaggcttgttttggtggttagggtgagaatgatgctgtcttgtgactttctacattctagccagaagtggaagtactgcacatttttacccagtccattccttcttgaaatgtgccagaaatgttgtctactgaagcctggagaaagacattgctttaaaaataacaagccaagatgttcacaatgacccagtgtagagtggagttatcagaagaaccaaccacattatacatttatgctgataatttaagggttaaattagcaaccagtaaaccatgagagctgttgaccctgagcacattactaaacatcactgtgacttagtttccttgtttataaaacaagaatcaaaagagtacttacatcatgggattgctggatgattaaatgagttaatatatataaagtgcttaaaagtatacttggtgcatagcaaatgcctgataaatgtaacgttagctgtcattattaatatattgctacaaatgactgttgttgttccaggagaagtttttctaggaagaatttatttcttctcagtcaatccctcttatgtcctaattaaacattaagttaaagctttctttgggttttcatgagagctaacagatctaagcagccaatactgtggtctatttcagttccatgaacaaaaggttggaaaattttggcttaaaaattggtgcctgtggtggtgtcagaggcgttcaaaccagagtggctccatcttgaataggggctgggtaaaataaggctgagacccactgggctgcattctcaggaccttaggcattcttagtcacaggacgagataggaggttggcaggactggtatcactagatacaggtcacaaagaccctgctgataaaacaggatacagtaaagaagccagccaaaacccaccaaaaccaagatggcaatgaaagtggcctctggtcatcctcactgctcattatatgttaattatattgcattaacatgctacaagacactcctaccagcaccatgacagttcacaaatgccatagcaatgcttggaagttaccttatgtagtctaaaaaggggaggaactcttagttccaggaattccccacccctttcctggaaaactcatgaataatccaccccttgtttagcatacaatcaagaaataaccataaaaatagctaaccagcaaccctcagggctgctctgcctaagaagtaagcattctgttgtttctttatttctctaataaacttgctttcactttactctatggattcaccccaaatcctttcttgcacaagatccaagaaccctctcttggggtctagatcaggacccctttctggtaacagtagaagttaatattattcagcaatatctttggttctcctgtctttgagtgggatcttctgtgcgtcctgacatgaagcatgcctatgtgatgcattggccaattaattgtgactggaaatgtatcacttctgggcaagtctttaagaactggtttgcaatgcaatttgcttccgggcaagtctttaagaactggtttgcagtacaatatactttcttcctcatgttaatgtgaccagtgaagttccaagaagaggagcctctaagtgagggtgatttggagcagagtcacagctggctcatggtgggcccatagaataagtcaaatgtaaacctttgctttagactgcagaagactttggagctgttggtcacagaagcatccccaagcctctcctgattgactgataaagtaccttcacaggacagagggcagactgtttgttctgctctgtctgggcagggttgagtctgatggatacactagtcaggcagagaactcctggagaccagagtttgagtggaggggtagccagattcatgggtaccagagtgagttcaaaccatatctaagacaaggtgccaaaaatctaagtgtccacatctcccaaagtgcaggtgcaggaccggaagcagaagacagaaagtggagaccagatgtttgaagctgggtaaaggcagggatggagcaggaaccgaggaacaaaccttggaactaggtaagaagttctctctatgacatttcattgagtagtaaagggagagccaaagcgctgtgttattgggacagctgtttgttgtatggtgggctgtttgactgaaaggtcaagtcacaaggtcaagttcaccacatctcagggcgatttctgcttttatgaaccagtcttcacaccagcaagattccttggcacctcaaggtttgaagaacaactacacaacaaaattcactctattctggatgatgatggtctcccaactcaggtttaaagggcaatcactttcaaattaactggacaatcactctcactctgccccagagaatcacttttgaaacatcaaaacacctattttggctcccttttatggtaccttgtcatttaaatcatacaaaatgttacaaatacagaactgtccatgtatgtttttaatagggtcagcgatattaatgcagcagcagtgtaagcagagcattttaagaaattcttccggtccttttggaattcagcttaacagacatgtattgacataactaacttgttcaatatgtctttctgtaagttataagtgaggagaaagtaaagctttccattaaactaacagatgaaatttttgtattagggataatgtactaatatgatacacactaataggatatatattccaaagtgctgttacatcatttaatgcaaagttacctcctactgggaactaaatattattttacagaaaatataaataatgtaaagactttctgggcactcagtaataacctgggatgtgaaataacttgatttgtggcactggccatgtacaatatctttttgttgaagatgattatcagaattctatggaaaatgtattgtcagggttgtagaatggacgattcctgttatgattcactagggaacaagctttttttttaaaattttttttattatactttaagttttagggtacatgtgcacaacgtgcaggttagttacatatgcatacatgtgccatgttggtgtgctgcacccattaactcgtcatttaacattaggtatatctcccaatgctatccctccccctccccccaccccacaacaggccccggtgtgtgatgttccccttcctgtgtccatgtgttctcattcttcaattcccacctatgagtgagaacatgcagtgttcggttttttgtccttgcgatagtgtgctgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcagcatggtttataatcctctggatatatacccagtaatgggatggctgggtcaaatggtatttctagttctagatccctgaggaatcgccacactgacctccacaatggttgaactagtttacagtccccccaacagtgtaaaagtgttcctatttctccatatcctcgccagcacctgttgtttcctgactttttaatgatcgccattctaactggtgtgggaacaagctttgtaaatgattgtttttgttcttagttgtcctctaaataaactagaaaggtagaaagtgttcacctaagtctgtttccatttgtggccatgaggttgtttaatattattatttgtcagttaagttgtctgatttttttgacaattgacttattatggtaatgatacacattgacatacactagcgcatccacctatatagagtaggtgtttaacaaatgtttgttgaaaatgattctataaatacatctataaagtttgaaatctacattgtcagaaagctgaagaaaactcttctgtgagaaaaaaacagcaaattttagacatttccatcgttttctaatatatatgttatatatatacacacataatacatatataaatataggaaatatcttgaaataaatattatcaaatctttaggtgtttagatggagatttgtatgaggaaggtatattcaaaaagaaagctgccttcacttaatttattgcctatttgctaaaggtatttactcagtagatcaggagtaaaactttaaactcaaatgtctggaggaatttaaatatatgtgaatgtgtatgtttaaattgaagaagaatgttgacagaaataaatcacttttagagagaattcccaggacctggtcccttttaagaaagctctcctggtccttgtgcaaatacatagttctttaaagtaccagcccacatactttatgggtttatgtcagtatgcctctgtttatttttggaataaaaatccttgcttataaaaaaggtagttaagtatggtacaacatagctgtgatccctttggcctgacttaagagtttgtacttaaggaacataaactaaagtcagagataattcaattagcattttgaacacacaaaggcatgcttgcttcctagctttcaaggcacaaagcagccccattaaattataacagtaattacaccacttgcacacattcttcaaaatttcatgaagtgcaatgctgagctctactttgagatgtttgtctgtctctggagaatcaactgaaataggaatatacaagtcaaatagcttaactccttgtccaacttcacacaacaaaaattgccactttcccttctaggacacatatccagtactccctgttttcttcccactcctactaatccgtcactaaacttcgtggatgttaactctgaaatggctctcgaatctgtccacttcttcccattttccttgccactgccctggtgtggggtgccaccttcccttgcccatactcatggcagtagtcttatacctgttcttcctgccctgacattgtctcctctcatctctcctcccctctgcacagagctatcctttcactaaaatgaaatctcaacaataataccctgagtctcagcttcatcaccttaatcacttcccaggtcacccctgattcatctcctttactctgcactaccaaagcccctgtaatcactctgctgtagtaactgccacattttattgtgcttcctcgcatggtggtctgtttcagtagatcataagttctgagaaggtaggaaccatgcttgtcttgtttaccccagaattcttggattcaagcctagggtatactctgaaattgcgaaggaatttatcacaactcttcaatatcagagcaattcctgagccaaggcacataccaatgctctctaacatattaaaatactattttttttttcgcatgttggagcctttatggttctaaaggaaaattccctaaggcagtgtgtcccaacggactttattttactagtgagaatagtgaaatcatataaatttctccttgaactaaaggtaccaacttaaattccttctctcaactttgactaaaatgctagtaattagattttaaaatatttttattttatgtatcctttatgatgtatgaaaatggcatgacatgtaatgatggtgatataataacaaacaaactgtgatataaaaatctgcacgtgtggggtgggatgtggcctaagttcctttaactattaataggttagatgacttttttgtatttttcttatttctttctctaatgccttttttacagacttttacccataattgaagactctagttcagtttaggctagagaagtgagatacaggaagaaaaattacatgtgtctttctgtgtgatttgtatgtatatatgtgtgatgattgattaacgactattattagccataaaaataaaacacatgggggttcatggaacagaagtttattcacagcttattgtgaaaaaaaaggtcattgtcagttcaaatgaaatctcatctttattgtatatgtgctgtcaaagtgagcactcatctttattgtaaatgttaaaagtgagtagtgttgaatagatttggttcctgttatgaaaatagtagaaataaatataattcttgtaaaagtcaaaacattcattttaattatggccactgatagatttggcataaaaccccatataagaaatataaacctaaacatgtatgtacagaaataattgtaggtgaaatgtaagtgtagggtttgtttcaaaataattgtggtgtggggagggaagagaagagtggacagggtcatggaggaaataggaagggccctgagatgatagttgttgaaactgagtaataagtatatggtgagtaattatatatcatcatgacttctgtatatgtttgaaaatttccataatacaaagtttttataaggaaataaagaaaacccatatgtagaagtaggaacaccctgaagctgatgaagcttaagcctgaggacccactactggatgagttccttccagaatgctgagaggagccctggggatgtcttcatatttttttctgtaaaacttgaaaaagtgagataatttaaccacagttgactaagactgttgtcccttcccgtttcaaaagcccctccatcacacttcccttcaaaatgagagatgtttgagcagctgtgggcttttgggggatctaactaagggaaagttaagttggggatataaaataactttcaattatctttactcatagatgaaagatacagatttaaaattcccagcaggaacatgcactttgacacccgcacagttcattggtggaatatacttattgattaccagtcacttctgtgtatgttatgactagttgctctggtgtaggaaaggcttccaggaatactgtccacggtgctgagccaccctgtgttgtgacccaatgcacgagaccagagattgtattgtgacctgagtgtgccccatgttacttgtcaccaaagtatgcaagtagtgggggaaaagcaagatttgaaatgtatgtagccagaagcctgtctgtggacaatctttctaatcgttagatgtgtaaaattgtatgcattggatttggttctcattgatacctacttagagtcatcttcagtcagaaatatacttgacgatgctgcagttataaatgcatcatattttttgcatttttatataaatcaagagaaatagaatttatcaacacgttttatttacagggcataaatatatactaccagaaatataaacttaagtttatatgtatagctgcttgaatatccattcattgtgtcttagcctatctagtgcattttttgccctgaggcagtgtaggattccaaataaaaagacacataaaagaggaaacagagcaagatggctgaatagaagcctccactgattgtccttcctgtaggaacacaaaattggacaactatccacacaaaaaatgcaccttcataagaaccaaaaatcaagtgagtgatcacagtacctagttttaacttcaaatcactgaaagaggcacagaagagggtaggagagacagtcttgaattgctaacaccactcctcccgcatccctcagcagcaactgcgtggcatggaaagagaatctgtgcacttgggggaaggagaacatagtgatcatgggactttgcattggaattctgtgctgccctaccacagtggctcatagattgagcatttagaccagccctagccagaggggaactacccatcccagcaactgggaccttagttgtggcaagcctcaccactgcaggctaaagtgctctggggttttaaataaacttgaaaggcaatctaggccacaggaagtcaattcctgggcaagtcctggtggtgtgctgggctcagagccagtggccttggagggggacacatggcttagtgagacaccagctggggtggccaagggagtgcttgtaccacctcatccccaaacccaggcagtgcagcttgcaaatctggaaggcattccttccttctacttgaagagaggagagggaagagtaaagatgactttatcttgcaacttggataccagcacagccacagtaggatagagcaccaggcagagtcatgaagccctcattccaggacctacctccaagacaacacttctagatacaccctgggccttgaagagaaggacccagtccaggcaggattaatcacctgctgactaaagagccattgggcctcaaataatcagcagcagtacccaggtagtatttgctgtcggctttgggagggactcagagaagtactggctttagatgtaaccaggcacattaccagctgaattgactgtgtagagggactccttctttttgagaaaaggagagggaatagtaaaggagactttgttttgcagcctaggtacaagcttggacacagtgggagctcgtggagtcaccagttccaggccttggcttttggatggcatttctagatctgtcctgggccagaggtgagcccactgccttgaagggagagtcccaggccagcagcattcaccacaagctgactgaagggcccttggaccttgaatgaacattggcagtagtcaggcagtatttgtcacaggcctggggcagtgacagccacagggagagattgggaagagtgggaaaagcagtgcaaacaaaacccacaattagtagaagaaaaggaaataataaagagcagagcagagataagtgaaattgaaatgaagtaacaatgcaaaagatcaaaggaataaaaagttggttttttgtaaagataaacaaaattgacaaacctttagccagactaagaaaaaaatggataataccaaaagaaataaaatcagagatgaaaaaggagacattacaacttatcccacagaaatttaaggttaaatttctcatagaggttgctataagcaagtatatgtcgataaattggataacctaggagaactgcataaattcctagacacatagaacctagcaacattgaaccatgaaaaaatctaaaacctgaaaggccaataatgagtaatgagaactcagagggggtggagcaagatggcagaatcgtagtctacatggtttgtaccccaccagaaacatcaaattttaacaactatctgcacacagaaaagaaccattgcaagaaccaaaaaatcaagtgggcaatcacagtacctggttttgacttcatatcattgaaagaggcattgaagagggtcagagagacagtcttggatcaccaacaccaccactctcccatcttctgccagtggctgtgcagtgcagagagtctgtgatcttcggggagggagagcacagtgtctgggggactttgcattgaactcagtgctgccttgtcatagcagagagcaaagccatgttgggctcagccattgcctgtgcatggagggagcatttggactagacctagccagaggggaatttcccattctattggtctgaactcaagtttctcggcaagtcttgccacatcaggccaaagtgctctggggtcctaggtaaacttgatagcagtctagggcaaaaggcctgcaattcctaggcaactcttagccctgggctggactcagagctggaggactagggtggcacatgacctagggagataccagctgggatagctaaaggattgcttataccacttttcctcaaaccccaggcagtgaaacttgcagcaatgaaagtgtccccttccttttgcttaaggggaggagagtgaagagtaaagagaactttgtcttacatcttagataccggttcagccacagtaggatagggcactgggcagagtcatgaggaccccattccaggccctggtacacagacaacatttctagacacacttggggccaaaagtgaaccagctgccttgaagggaaggacaaagtgctggcaggatttattacctgctgactaaagagacttgggccatgaataacccaaagcaaccatcaggtagtacactgtgggccttgggcactgcaatgtgctgactgtaggtgtgacctagcatgttcccagctgtggtggctacaaggaaagactccaagtaaaggggactttgttttgcaccttaggtaccagcttggtcaccttgcagtagagcaacaagcaggctcttggagtccctgagtccaggccttagctcttggacagcattactggaactgccctgggcaggatgaagaaacaagatcccattatctgttgcctataagaaacatacttcacctgtaaagatacacatagactgaaaataaagggatggaaaaagatattccatgtcagtgaaaaccaaaaaagagcaggaggagctatacttatattggacaatacagatttcaagaaaaaactataaaaagagacaaagaaggtcctcatataatgataaaggggtcaatctagcaacaagatataaagattataaatatatgtgcacccaactctggagcatccagatatataaagcaaatattattagaactaaagacagaggtagaacccaataaaagatccagaaacatcaacaccccattttcagcattggacttatcatccagacagaaactaaacaaagaaataccagacttaatctgcactatagcccaaatggacctaacagatatttacagaacttttcatccaaaggctgcagaataaacattcttttccttggcacatggatcattctcaaggataaaccatatgttaggtcacaaaacaagtcttaaaacattcaacagaactgaagtaatatcaagcatcttctctgacctcagtggaataaaactagaaatcaacaaaaagaggaattttggaaactatacaaacacatgggaattaaacaatatgctcctgaatgactagtgggtcaatgaagcaattaagaagaaaattgaaaagatttttgaaacaagtgataatggaaagacaacatggcaaaacctatagtatagagcaaaaccagtagtaagagggaaatttatagctataaatgcctacatcaaaaaagaagaaaaacttcaaataaataacctagcaaggcattttaaagaactaaaaaagcaaaaacaaaccagaccccaaattagtacaagaaaaggaataataaaaatcagaacagaaataaatgaattcaaaatgaagaaaacaatataaaataacgacaaactacaaagttgattttttgaaaggataaacaaaattgacagacttttagccagactagtgaacaaaaaaagggagaaaataaaatcagagatgaaaaaagagatattacaactgataccacagaaattcaaaggatcatcagtggctactgtgagcaactatatgccaataaattggaaaatctagaggaaatgggtaagttcgtagacacatacaaactaccaaagtggaaccatgatgaaataaaacacctgaacagaccaataacaagtaactacattgaagccataacaaaatgtctcccagtaaaggaaagtccaagactcaatagcttcactgccaaattccacaaaacatttaaagaagaactattaccaaccctacacaaactatttcaaaaaatagaggaggaatatgtccaaactcattatatcagaccaatattactctgatactaaagtcagacaaggacccatcaaaaagagaaaactacaggccagtatctctgatgaatattgatgcaaaaatcctcaacaaaatactagcaaatcaaattcaaccataccttaaaaagatcattcatcatgaccaggtggtatttaccccagggatgcaaggatggctcaacatattcaaatcaatcaatgtgatacattgtatcaacagaatgaaggacaaaaaccgtatgactgtttcaattgatgctgaaaaaatttgataaaattcagtatcccttcatgactctcaaaaaactaagtatagaatgaacatacctcaatataataaaagcccatagctagtatcatacttaatggagaaaaactaaaagtctttcatctaagatctggaacatgacaaggatacccagttcactgctgttattcaacatagtactggaagttctcgctggggcaattagagaagtgaaagaaataaagggcatcaaaactggaaaggaaaaagtcaaattatcattgtttgctgataatatgaccttatatttggaaaaacctaaagacttgaccaaaaattattagaactgataaattcagtaaagctacagaatacaagatcaacatacaaaaatcaatagcatttctaaatgccaacagtgaacaatctgaaaaagaaattgaaaagtaatcccatttacaatagtcactaataacgtaaaatacttaggaattaacttaaccaaagaagtgaaagatatctacaatgaaaactataaaatactcatgaaagaaatggaaaaggacacaaaaaaattgaaagatactccatgttcatggattagaagaatcaatattgttagaatgtccatattatccaaagcaatctacagattcaatgcaatctctatcaaaataccaatgacattcttcacagaaataggagaaacaatcctaaaatttatgtggaaccacaaaagacccagaatagccaaagctatcctgagcaaaaagaacaaaactggaggaatcacattacctgacttcaaattatactacagagctatagtaaccaaaacagtatggtactggcataaaaacagacacataggccaattgaacagattagagaacacagaaccaaatacatacacctacagtgcactcatttttgaaaaaggtgctaagaatatgccttggagaaagggcagtctcttcaataaatggtgttgggaaaactggatatccatatgcaagagaatgaaacttgattcctatctttcatcatatacaaaaatcaaatcaaattggattaaagacttaaatctaagatttcaaactatgaaactactacaagaaaatgttgggggccatcctgcatgtagaattcttaaaagaaaaaagcaaataagaataaaaaagaaaacactggggaaactctccaggacattggtctggctaaaaatttcttgattaatacaccacaagcacaagcaaccaaagcaaaaatggacaatgagatcacatcaagtcaaaaaccttctgcacagcaaaggaaacaactggtaaattggagcgacaacccacagaatgggagaaaatatttgcaaatgatccatctaacaagggattaataaccagaatatataaggagctcacacaactctatatggtcaaaatatttaaagaaccatttctcaaaatatgacacacaaatggcaaacaggtatatgaaaaggtgcccaacatcattgatcatcacagaaatgcaaatcaaaactacaatgagatattctctcaccccatgtaaaatggtttttatccaaaagtaaggtagtaacaaatgctggtgagaatgtggagaaaggggaaccctcatacactgttggtgagaatgtaaattagtacaaccactatggagaacagtttgtaggttcctcagaaaactaaaaatagagctaccatatgatccagcaatcccactactgggtatatacccccaaagaagggaaatcagtatatcaaagagatacctatgctcccatgtttattgcagcactgtttacaatagccaagatttggaagcaacctaagtgtccatcaacagtcgagtaaataaagaaaatgtggcacatatacacaatagactactcttcagctatgaaaatgaatgagatcctgtcatttgcaacaatgtggttggaattgaaggtcattatgttaagtgaaataagccaggcacagaaagacaaactcatgctctcaattacttatgaaagctggaaattaaaaccattgaagtcatgaagatagagagtagaatgatggttaccagaggctgggaagggtagtgggtgggtgggtggaggggcaagtaggggaagattaataggtataaaagtatggttagatagaaggaataagatctagtatttgataacacaacagggtgactacagtcaacaagaatatattatacatttaaaaataactaaaatagtataattggactgtttgtaacacaaagaaaggataaatgtttgaggtgatgcatactccatttacccagatgtaattattatacgttgtatgactatatcaaaatgactaatgtaccccataaatatatatacctactatgtatgcaaaaaaattaaaaattaaaaattggaggcataaaactgcctccaatgcagcaaaatgatgagaaacacatacacacacacacacacacacacacacacacacacatgaacacacagtggattgaatcactaatgagtgtaggaggtgctcagatattagtgagtggctgaaagtgttgctgtttagcaaattctcctatgaacagaaagattttttggaaacctccttccagaatgacttaaaatatgcaatgtgctccttgataataaaatttagaatagaataaaattagttgcatttataggtttgaaaccaaagttttctactacttcaaatttgagccctttgtgaagatagtttcaagtataacaatataaattgtttttttttaaatagagtccctccagagaattgaagcatagctaaatccttccacagaaaagaataattgcttaaaagagaaaagcaagtcatcctgttttcacttggctattttcttttccaagtatggactatagacatctagaaagcatggtaatagtgagttaatatatatcatgctttgtttattttgacctttaaaataacacacttcttaaatgtctagttcgtgtaatttctatatttatccaaccaaccttatatcttttcctatttttcacttttcagggaaaatcttggttcattttcctcaagttttctcttttcaggcattgttcattaattttgctaagaatctgtttactcagagcatcacagtaggatattttgtttttgaaacaaaatttaagcacattaacacacaagcaatggtgtgtaatatgtatgggtgaatataattacatgatccatttatatcttccatagctaaatataggatgccagttgtttgttggtttgtaagtgattatgcctttgattacattatctccacttgctatacctataatggcaaagaagtcttttctttttcttgaattttctaggatccaggtgacatgaaaatatctctggcatagcccaagcatggttgttatggtgtagagaaaggctctattgcattcagccattcaggggctcaggctccattcatgttatggctccatgccctgagaccttaggattcaactggattaactacaaacaaatggtagaaaaagtaaaaaggagcatgaagaattgtgtatggggggtcgggggtggggacgcggtaagggaacaggcctagaagtggcaggcatcacttctacccacattatgtgggtctcggaattcagtcgtatggcctagttgcatcacagagaaggctgggaaatctataacattgaggacatgttttgttctcctaggaggacaaaaaagaaaatggggtttggtgagttcatagcatcgtctctgataccatgtagttcactgtggtatggcaccataaaggtccctcatgttccccaagtagtctctaatggcaagctgattcttttatccagtttgaatcaaggttgaatgacaaccttaattcctgttaggtgagaataaagtatcatgagtcatttagcccccatgatgaaggctttcagagaaggtcttgttaaagggtgggtggggaaaattcctagggatatgaggggtcagtggggagtgaagtgagatactgtagagtaagcgaaaaggttgaccagttactccttacctacttacaatggcctgaactgctgagtgtgcaagagggacagttttaaaagctgtcaggccacaagctttctaactgccatcagcataggttgtttttcccatcctgtggcctttggttgggttctctaggaaacagactctaaaatggaaatttgcatgcaagtaatttattggagaatgctcaatggatggaaggatgagaaagagggaggagttaaaatggtcatgggtcaggaagctttagcactgggatggctcttcaaagttgtcctgccttgaggcaagggggccaggcttttggatccctctctatttgacagtcactggatttgagctccttccagggagggagtgtgatctagggtaatggatgacatctgggcttctaccactgcttttctgtatgctcccccttcttggaatactatgtgagaagtacaaaagaggaccccatgaacatgcttttagatgccatggttctatgtggcaaaattcttctacaaagacaagctttgcttatgctctactttccaccctcatctcaccaggctggaatggcctccccacatttcctagcttatacaaagcatcctcatcctttcaagtatatttcagttttcgattcgatgaggcactctctgcttccctgcattctaagggaactcacactcaccagaaatcttttatagtaattattgtctgaattatacatctgttactcattaagcactgttttacagtgctagctatcttttctggtgtgtaccttcacccaaaaatgtaagtacttgaaggaaatggttatgttttatgttatgtgagtcatcatcagtgtttggtacaatgcaagtcttatttcattagtttgacaagtattcattgagcacctgttatgtttgaggcaccatgatggatgctggggagactaaggtaagagttctcacactcaagaagattattcttgtgtgagagagggacagacaattctatggcaaataatctgaatagaggtttcagatgataaagaaggatcaaaactgccggatggacagggttaggtcaaggatcggggtgaggatatgggtcaagagaggtatcaaaaagatcagtcaccattaatatggtgatatgaaaaactctgaagcttcagatgattagggtagaaagtcaggaagcaggaactgacagacctaaaaatttatggaaataggcactaatttatggaactctgagttcagcccagggtttctcaaccttggcactattgacattttggactttaaatttctttgtcgtgggaggctgtcctgtgctttgtaggatgtttagcagcatccctgggctctacccactagatgtcagtagctttcccaagatgtgacaattaaacataaacctagatactacaaaatgtcacctgggggctcaaaacacccccagttgagaaccactgagctagacacttgtgcaaaaagcaacactggccatgatagcaacttcactatgagcaggggacattcctttcatgaggtgaaaagttaggagtgtgtttagtgctaacggaaggaagtccaaatgctgacactctttcttgggaataatacacttgtggtgggtgtttttctatctactcttgatggtctgtctacctaacaaaatatccctgcagttgagatctggtatatggaccctattttccctaaagttaatagctccactttttcaagtgcttcttataaagtacatgatcatagaataaaaatatcaagagttaataatcatttgtttattattttttggaaacttttagcagcagggaagtatgcggatttctagaaatcaccagggtacagtgaaagttgccaataaaaatgtaaaataatacacatgttgttatgaagcagaaacatgttgtgtttcaaataaatcagtatccttaacaattagcaagagaacttgagttttgaaaaaagaacaatagtatcataattttattatctttttcctacatatctggaattttaaaaactttttcaattaaaaaaacattagattatttaggtcactcttgagtttaacagtagttttgaaaatgtatggaaaagttctgcttcaaatatcttctccttttacagaatcttcttaattatttaaaagaacttatctgtgagttattctctgatatatatagtgaaaatccagagagagactagaaactttaaaattactcattattttttctgatataactataaagtttgaaaactagagacaagtataaaaaatgtaatttatcatattttgatgtaattgaccttttctcttgcttattttttagtggcgtttaagctttaatgtacataagaatcatagggataacttgttttaaaaggatgtcccagggcactacaaaagaagagtacaggatgaaacctgggaaacagcattttaacagctaccccagatgattctgattcagaaggtccataaaaaccacctggaaaaatggatttatgttcttatgttgccatcatatcattaccatccattgactgattaggggagggaagaaacttttgctctgtctgtttttaaaagagccctgttatttgtaaagatcattctttctacaacaattagcttctatttaagacacaacattcgttttagtctttcagtacacttttgggtgactttccttggattggtaatcattcagtgttttttgccttttatcatctggaacagatacatgaatggtccatttaagaattaataatctcctctggactcccagtacatttggcctgtatttctcttgggatgtgttagctccaggcatgatgtaatgttaacacagagcgtctatggaaggatcagatgaatggcacagacctagatgattttggcgggcagaatctgtagtaattagcacctcttaaggtaagagggtgaaagacaaggcaacgtcccaggtgattccaagtttgggaacctgggcaacttgagtgagaggagctgtgttggggaatttgggagcatgggttagagaatataagaagagtggcggtgatatggtttggatttgtattcttgctcaaatctcatgtcgaattggaggaggggcctcgtgggaggtgattggatcatgaggaagtttccccccttgctattcttatgacagtgactgagttctcacgagatatgatggtttaaaaatgtgtggcacttctccctttgctctctctcctgcctccatgtgaagaaggtgtttgcttcccttgtcttctcttctcaggtaagtttcctgaggccttcccagaagtagaagcctgcacagtccacagaactgtgagtcaattaaaccttttttctttataaattacccagtcttaggtagttctttataacagtatgagaaccaactaatacaggcaggatgcaaagtttcaggagccagtgggacatctgttagagatgtgtataaggagtttagaaatttcaaccatgcttcagagttaacatttgaaatagaaaagtagcagccaaaggtgtaaatgtactaactaaaagctagtaaatattaataaaagagagccaaaaactaagctgtgagatgtgccctcatttagaaacctgaagaggtgaaaagaagggaataaaacaagtaagaaagggacaaaaaaggaagtgggaacttacagtaaaaacttgtcgtagaatcaagggaatgcttctgaaggaagacgtgtctagcagaggcaagccccgctgaattgagagaggaaaagtattgaaacgaagcttttgagtttggtgaccaaggtttcactggtgacctttgacaaaacctcagttacttgagtagacttaaatgaagtgaaaagtcatgagcttgagggagaacttaaaactcaaaattactgtaagaacttgagtcttccaggtcgacttgtcatcaggttccttgtttttgttgtggatttccgcttgcaggataaattttcccctgcagtcttcccttggtgacctcttcaatgtaatcagttcagtatttctgctatacctccattacccacatctgaggctctgaattaggtggagttaattggttcaattggagattcacacccatggcaacttgtcatctcctaacctcttgatggagtataccagcaaatgagagatgacttgaactaatctgaccctttcatttcacatccacagcacaattactctcccttttgctcgcctaacacgatctcaaatactaaaatgacccaatccagcttattagatccccaaataacttaatataataacataatacaaaatttagacatttggaaaaggcacacggtagggtccgtatgtacctgctcccatttttttctatggttcaaagcacagttttaagaaaccagttaactttcttcagtgaggcctatttgccagcttctctactgggaattatttatagtatggcaataaggtcattaacttgtacttggttctgaaaagctaaaaactttcgaagttgcaaacttgaatttttgccctgatctctctgactccattgacaataatattttccaccatgccatggtaccttgacagatcatctttctcttcaaattttttttgtgagaatggctaattgacatgttttctttctgctgccttccatgatatataaatacaattaagcaataaaaccaaggaaacacaatatcaaattgattatatatgacccacatgttgaggaataaaacatttagccttataccttttcatactccatgtgcagctaagaacaagtcctagttttctaaagcacctcttgatgagctaaaaaaaaaaaggaccttaatgagtctatcttctataccacatctctgatgtttataaatatttcatataaagtcaattcatgaagttaaacttctgaaacaaaattatgggatccgacagaccccatctgtttaaggcaaaagttgaaaatgtctaattcaaaggcatcataaattatttatatgtaaatttaaaaatttaaagtttcattttggctttttttattttcagagaaggaaagggtcatgttagatctgataacaagtaagtatagttatatatcaacatattccagatattcgggtgtgaaatacccccataaagcatccttgtggagcagcgtaacttatttctgaatttgagtgctctgaggcattgggctagtgtgaggttgaggatgtcaagtctaaaaaagatgtgggtttggttctggaccatggttgtggccagaggaatgtagtctggctgcagggtcagagtgttagacactagaaggacagactttgtggtggtagatgatgagtcccttagagaaggaccccaggcagtagttatgggattatgggaaatgacacccaccactcagggacaaagttggcaagaggtgtcaatggctaggacaatgccagccaagtgtggatcacagaagagctccaggcagtcccagtggagaattcaaaggataaggatgattgccacaatggtaattatgggaattgtaatggccaacaattgagtagcacttttggtaagacttggtggtaccacttgatactgtatggccactttgtctcagaaatttggtagcattgtgtctatagtaactccagctacaaaggtctgagaaagagggaagctgacaacctctagacttttggtcattgatcctacagttcaatgattttatatattttatttttgttcttctcgacatgctgatttaattttatatagtttatttttatgtatgtgtgattaagtctcttaaaagtcaaccaaatacagactctggagccacattgcctgggttcagctgcgggcccttggacaagttacttgacctctctgtggtttagctttgtcatctgtagactgggaacaatatccctacattattagttagttatgaggatttaatgagttaatacttgctttacatagagtaagagttttctattaaattgctaaaaactaaaaataaaattttatgtaggttagtaggtccagttgtatccgtttcacatgggggcattgtttaaaatgcagattctggagtgtcaccccagacttactcaaattcttaaaggtagccctgggaatctatatttctaacaagtctctcaggaaattccatttttcaaagtaagatctgggaattaattgagccatgcttcttgttcacaatatatttaaagttattagcaaattattttctgactcatttcttaagaaaaatccttagtagattgtacaaagcttgcttacttagtttaaatgttatttggaacaagaaaggatataactaaatcaagctttctctaaactattcttcatgcaagatttgctcttacatcttcctctaccaactccagatgcaaatatatcacctatgaattttagaaactagccatttgttgggcatgtcttttactaagactaacctggaatttggtttgaattatcaagtatttgtaacacaatataaaggaaatgcagttctgtgtgtcagaaatccccagttcccaaaggaaaagttcactgtgataggcaattgctaaccgttcacgagcacatttttaaaaagtatagcaatgatagaaaaccaaacaatagagcctccataaagatttatccaaatgtagttgccaagacaaataatgttgcattttaacagtaacatggtttgttcctcattaaacaaaaacaaaacaaaacaaaacaaaaacgcgatcttgttttctataaatgagttcaatagagtggtaatgtgcaaatgatttatttgaaaagaaaaaagaaaataatttccttctcctatcactgtaaatgtttatgggctgcccatttttaggcacagaagatgtctctttagtagatcatttgccagtagtaaaggatttacaccgagacattctatttggcggggtgtgagggatgtctggttgtccttgttcgcagtatcatttgttttcaaggtgactgactcgatgtagggacctaatccatgaccttgaagcaaagcagagttaattgatgtaccaaaggattcattagcatttgtctctcaaccatgaaaccagatgggcagggtagcctaattgagaaattaactgtatattttcttgcctatgggcttttaatgcacaaaaacaaaggaaacattttttcttcctcttctgtttttccagcttttattttagtttcatggggtacatgtacagttttgttacctgggtatactgcataatgctgagggttggagtacaaatgatcccgtcacccaggtagtgagcacagtacccaatagttagtttttcaacccttgatccctcccttcctccccacctagtagtccccagtttctattgttaccatctttatgttcatgagtacccaatgtttagctcccactgataagtgagaacatgcagtatatggttttctgttcctgcattaattcgcttaagataatggcctcagcttcatccacgttgctgcaaaggagataattttgttctttttatggctgtatagtattctgtgacatatatgtgttggggaaccagccccacaccacccagggggtaccccgagtcctgcggagacaaaggagttagaaagagacagaataagcgtttaaaaggcaggtccaggggaccggaccctcggaggcttgctcatggcccagagctctcgggctccgcccaatttattggtttacaagctctttgttcttagggcagatgggagggggaggaagggatgaggaaaaggattaatcagtgaaggagaactcgtgagtcattcaataagatgtatagcagtggcggtttctttgaatttccttgagcaaaggcgtgtgtctaaactacttaagatctttaacttatggggactgaaatgggtgggagcgggtttcaggaggagccaagatgtttgattgtactccactgcttcaagggagtgttatctccccgagcaacctgtggaatgccactgagcggttatgctcttggggcataaagacatgaaggcagtaaggagacttttctcctcagaggccacccatggcttcccatgggtgtctcacacaggagagaccaactcaactggcaccccagaaactctttcccacaatatgtaccacattctctttatccagtccaccattaatggacacctagattgattccatatctttgatgttgtgaatagtactgtgataaacatgcgagtgcaagtgtctttttggtagaacaatttgtcttcttttggatatatgtccaataatgggattcctgggttgaaaggcagttctgtcataagttatttgagaaatctccaaactgctttccacagtggctgaactaacttacattcccatcaacagtctataagtgttcccttttctctgcagccttgccagcattggttgtttttttgactttttagtaatagccattgtgacttgtgtgagatggtatctcattgtggttttgacttgcatttctctaatgatcagtgatatgcagcctttctttatatgtatgttggcagctggtatgtcttataagtgtttgttcatgtgttgcacccatttttgatgggttatttgttttttgcatgttcaattgcttaagttccttatagattctggatattagacttttgtcagatgcatactttgcaaatattttctcccattctgtaggttgtctgtttactctgttggtagtttatcttcatgtgctgaagctctttagtttaattaggtcccacttgtcaattcttgtttttgttgtaattgtttttgaggacctagtcataaattctttcccaacgcccatgtccagaatggtgtttcctaggttttcttctaggattcttatagtttgaggtcttatatttaaatctttaacccgtcttgagttagtttttgtatatagtgaaaagtacagatccagtttcattcatctgcacgtggctagccagctatcccagcactatttattaagtagggagtccttttcccattccttatttttcttgactttgtcaaagattggatggctctaggtgtgttataactggattcactattctgttccattggtctgtgtccatttttgtagagtactatgctgtttgggttactgtagccttatagtacagtttgaagtcgcgtaatctgatgctggtcattttgcttaggattgctttggctgttcaggctttttgtggttccatatgaattttagaatagtttttttctagttctgtgaaaaatgacattgctagcttcataggaatagtgttgaatctacagtatgctttgggcagtatggccatttaagtgatattgattcttccaatccatgagtgtgaaatgtttttccatttgtttctgtcatctgtgatttcttttagcagtgttttgtagttctccttgtagagatctttcacttccttggttagatgtattcctaggtattttatttttgtgtggctattgtaagtaagattgcattcttgatctggcttttagcttgaacattattggtatatagaaatgttactgatttttgtacattaattttatatcttgaagctttactgaagttgtttatcagttccaggagccttttgacagagtcattcgagttttctaggtatcgaatcatatcatctgtgaagagagatagcttgcttcttttcctgtttagatgccttttatttctttctcttgcctaattgctctgcatagcattttcagtattatgttgaatagatgtggtgggaatgggcattctcatcttgctccagttctcaaggggaatatttccatttctgcccattcagtatgatgttagctgtgcacttgtcatagatagctcttattattttgagttatgttgcttctatgcctagtttcttgaagatttttatcatgaaggtgtgttggattttataaaaagcttttaccacatttattgagatgatcatatgggttttgtttttaaatctgttatgtggtgactcacatttgttaatttgcatatgttgaaccaaccttgcatcccagggattttgcctacttgatcatggtgaattaattttttcatgcactgttggattcagtttgctagtattttgttgaggatttttgcacctatgttcatcagggatattggccgtttgttttctttttttgttgtgtccttgccaggtttcggtatcagtgtgatgctggctttgtagaatgagttagtgatcggtaactatttttggaatagtttcagtagaattagtaccagctcttctttgtacatctgatagaattcagctttgaatccatctggtctggggctttttttggttaatatgcttttttatgattgattcaattttggaacttgatatagatatatttagggtttcactttcttcctgattcaaatttgggaggttgtgtttttccaggaatttatcagtttcctctagcttttctagtttgtgtgcatagaagtcttcataatagtctctgaggatcttttgtatttctgtggggtcagttataatgttacctttgtcatttctgatgtgcttatttggattttcttttcttctttgttaatcatctagctagtagtctatcaatcttgtttatcctttcaaaaaacaaacttttggtttcgttgattctttctatagattttttttctcaattttgttcagtttcttcctcttctttttaatatagtgagccaggtgtggcagatgatattttctaaaaatggctgcagcaatctatccagtcctacatgttcctccagaaccatgccaccctcccatcaagaggtggaatctatttgttctcccttgaacctgagtggaactttgagactggtcaacaaatagattagagtggaagtgatgctgcatgacttccaaagctaggtcctataaagcaatatggctctacctggctctccctctttggcatgctcacccttgagacccaggctccatgctataagtaagcctcaactgcatgaggagaccatgtgtgctctgactaacagcactagctgagacccccagctggcaaccagcgttagccaccagaaatgttagtgaactagcctctagatgattttatatcctagtcctcggcctttgagcagccccaaattgcaaattcttgagcaaaaaaaaaaaaatgtcattgcttaaggtggaaagtttgggcgtgatttgttaatcaggatgagataactgtaacaccagggcttcctcttctggaggtgtggatagttttttgcttcaaggacagatatgaggcccttgtttccagacagggtgaataatatcaaggctcagagggttcaagcagtgaggtggcagtctagtccaccaggaataggatttctaatcccagtagataagggtagggagttgtgagagcagtggaaatgttgccctgctctcaatctggctttggggaagaggcgggacctctgataaggctggcaaccaaatactaagctcagtgagcttggaaactgcagttaaggctgtcatgatctgctgggggaggaggaggtgtacatgcacatgtgtatatgcatgtacatgtgtgtgtagtggagggattgaatcagaaaagccagctgccttcaggaggaccacaagagccagagcaaagaaaaatggcatagttacaaccacacactgaaagacactcttggagtttttgtcatcccctgggactcttgttagaccctaggaaggagaccagatccccaaactttgttctgatgttatatgtatatattgaaaaattgttagtcatttgttctaatatcatttatcagctgattagttacctggttaattcttttcttactaatttgaaatattgtgtgatcatataagaatgtctttggtctgctgtgtttttgttccattaatctgtctgtaatcaccaatatgattccattttagtgactatatatttaaaatacattttgatatcttgtagggggaaatcccattatatattctcccagaaatttcttggctttctcacaagtgtattccttcaggcaggctttcaaatcatctggtgatgttcctttcaaaaaactcattggggctttggtgagtattgtcttgcatatgaatagttaaaaatggtagattgaacatacacttagctcttctccctcccagaatcccactaaatgagaataaaggaatgtttacagaagatataaatacatgagaacaaagtatgagataggagacatcagtgacacgattttggaagttggtggacagatggtaggggttaaatgatttaacagacatgagaaagctgaatcctaatctggaagttggaaaaggggagaaataacctaatgtacattgcagactcctacaaagaagcaggatttggcaggtggaataatcagttgaaagactgtttaaaaatttagtccctcatatctccaatccaaatttatacatctgaacaaatatccatcccccattctggcaggagacttgaagtttattctctaaggatgataaacagatgatctttgaattaggcaataccaggtacaactaaaacagagataccaaacagaaaacatggggactaagataaaccttatgtataggacctaagatctctagccatcttccctcatatagctcagtaatgttggcagccagatatatatgttcttcttaaattctagaaattttatattgaaatcttttactactgatttccttctattttctctatcctctattcatagaatttcaactattctaaaacattctcccccttctatggagggggtcaaaggcatcttctttgagaacctatcttccaagagaaataagcacaagacactcaaatcaaaagttttccaaatattatcctagagagaagagcaccattgagaagcactccccctgccatgagctcccagccttctttttagcgcctgcctcactcttaaatatgagcagacagccaaggactgccagacgtttatgaaaaaaaccccacctcactttaaatgccaatacaaatagaaagaaaaacttaataataactagtattaatatccctagagaatatgaatcaatgaagaagtagatactataaaacaaatatccagtgaacatgaaaccttagaaatagacaatatgatcgcataaactattggaagataccctgggcacagtggcccacacctgtaatcccagcactttgggaggctgaggcaggtagatcactgaggtcaggagttcgagaccagcctggccaacatggtgaaatcccatctctactaaaaatataaaaattagctgggcgtgtggcaggtgcctgtaatcccaactacttgggaggcggaggcacgatagtcactttaacccaggaggcagaggtcgcagtgagccgagatggtgccactgcactccagcctggacaacagagcaagactccatctcaaacaacataaaaaatcaaaaaatatatattggaagataaaatcaagagaatctcccagaaagactagaagaaagagaagaaaatagataatattttttaaaatagagacttatctagaatgttctagaataattgaagttctggccgggcacggtggctcacgcctgtaatcccagcactttgggaggctgaggcgggtggatcacgaggtcaggagatggagaccatcctggctaacatggtgaaaccccgtctctaacaaaaatacaaaaaaattagccgggcatggtggtgggcacctgtagtcccagctactcaggaggctgaggcaggagaatggcatgaacccagaaggcagaagttgcaatgagccacgatagcgccactgcactccagcctgggcgacacagcgagactccgtcaaaaaaaaaagaataattgaagttctatgaatagaggatagtgaaaatagataaaaggaaatcactaataaaataattcaaaataaaatttccagaatctatgaggaacatgaatgtcctgatagaaagggatgtcactgagcacccagaacaatggataaagtagaccaaatccaaggcacattatcgaggaatttcacaaagctggggacagataatggacaatataaagtctcagggagaaaaaaaaacaggtttcatacaaagtatcaagtataagaagacatcaaacttatcaataacaatagtggaagctagaaggcaatgaagcaacaacacactaaaaattctgaggaaaaataacttcaagaactccattttcagtgtctaaaaaacaaaactcatgtagccccttttcaggaagctgtttgaagatgtgcttctagaaatttatggaataaaccaagagaaaaaaaaaagacacaaagtccaggaaacagagaattcaattcaagagaaaggctgagggaatctctgtgatgataatgaatggagagttctgggtggcttccagttattaggtataatggtaagcagaattctacgatgacccgcaagattttcaccccttgatatatgtgccctgtagaatcccctcacatgagtgtgtgcaggatctgtgaatacgatgggatattactcctgtgattatgttatatggtgaaaatgaagaggttttcagatgttattaaagtccctaatcagttgactttaagctaatcaatagggagattgtccgggatgaagtcttacctaactagatgagccttttaaaaatagtctagaaatcatagagggaaggagtcaaagagatttgaaacatcagagattctcccctgctcaccttaaagaagcagacagccatttatgtggcgaggaccacatgtcagggaatggtgggtggtctatagaagccaacggcctcagtcccatatctacaaggaactgaatcctgccaagagtgacatgagcttggaagaggatcctgagcctcagatgagaattcagccctaacaaataccttgatttcaatccagtgagatcccaaacagggaaatcagctatgctgtgcctggactcctaacccatggaaagtctgaaataataaatgtgtgctattttaacccaccaagtttgtggcagtaaataattaatgcaggtgtagatggcaaacaatccagactgaagcagctcagactctggaaggatttatccagagatataaaattgtcctaatgtcctgagagatacatacaacttgaggataattgggaaatgtattagtagtaagtacacacaaagctaagcaatcaaacaccacatcattgctaactttaagaaaaacagaatgctgcaaaaaaaaatagtcatagtatataaggcaacttagttataaataggatttacagagtcagtatgatgtaaaaaccaaatgatggtctaagcaaaatcacatgataaatacagtgggaggatgaagatgagaaatatatgtaggagtacgagtggggtgagattttgcaaaagcaaaatcttcatctttcataccaggagtgatagacaatgactagaacaaaaaattcagaaattgcagtgtatgtctatcatggtgcctctgggaagggaaacatttgagtggatgaagcaggtaacttttgttttttattgaaaccttgtgaaagtacttgactctttaaaatatgtgaatgcataacttggacaaaaatgaaaataaatttaaagtaaagaattgaaagttcagtagattaaagacacataatattagttcttgagatgatgttttcatttaattgtattttcaaatacctcccacttattggctgtttataagtgaacaagattataaactgtaaaattcaattcacttattccatgtgtgaataaatgccacaaaagaaaataagaatttccttttcccaatcacaaacatttcccttacaaaatcaccttcaggaagtaacctgaccaaataaacgagagcttccatttctcaatttttagcacatcatagggtgaagggattatttctgttttcccttttgttccttagagtaacattaaaatatttgtaatatattgacacccctgatgaaagatcaaacatttcagtgtttgtttcttcaacaatcaacttctcatttggaatagctggaatctaaattcatttttctcacacttttcactctccagatgctggaattgcgctagatcatgaagaagatatgttgtggttgttttcatattttctattgagtggtattcaccagcaatgtgacagaattcagtgtacatcagcaaggtgtaccttttaccatttctcgcacttactatgtgagttcctaaaccctgttaagcagctatctccatttcagtaaaatggatagtaataacatctccaatatgggatttttgagtagcttacatgagataaataagcaaagggcttagcacaatgtaagaagtcaataagcattagctgctgatatcattgctattcaggaaaaagaactgtgattaataataagcattaatattaatgtttaataaatttaagaataaaattctaactttaaccaagtagaagttttgttgctgggcaagatggctgaataggaacagctccggtctgcagctcccagcgagatcaacacagaaggcgggtgatttctgcatttcccacagaggtacccagctcatctcattgggaatggttagacagtgggtgcagcccatggaaggtgagcagaagcagagtggggcattgcctcagctgggaagtgcaagaggttggggaattccctcccctagccaagggaagctgtgagggactgtgctgtgagggactgtgcattccggcccagatactacacttttcctacaatctttgcaacccacagaccaggagattccctcaggtgcctataccaccagggccctgggttttaagcacaaaactgggcagccatttgggcagacaccaagctagctgcaagagttatttttcataccccagtggcacctggaacgccagggagatagaaccattcactcccctggaaagggggctgaagccagggatccaagtggtctagctcagtggatcccattcttatggagcccacagcaagctaagatccactggcttgaaattctcactgccagcacagcagtctgaagttgacctgggacactcaaacttggtggggggaggggcgtccaccattactgaggcttgagtaggcggttttccccacacagtgtaaacaaagccaccaggaagttcaaatcgggcagaccccactgcagatcagcaaagccactgtagccagactgcctctctaggctcctcctctctggtcagggcatctctgaaaaaaaggcagcagccccagtcaggggcttatagataaaactctcatctccctgggacagagcacctgggggagggggcggctgtgggtgcagcttcagcagacttaaacgttcctgcctgccagctctgaagacagcagtggatctcccagcacagcgctcaagctctgctaagagacaggctgcctcctcaagtgggtgtctgacccccttgcctcctgactgggagacatctcccagcaggggtcaacctcataaaggagagctccagctggcatctggtgggtgcccttctgggacgaagcttccagaggaaggaacagacagcaatctttgctgttctgcagcctctgctggtgatacccaggcaaacagggtgtggagtggacctccagcaaactccagcagacctgcagcagaggggcctgactattagaaggaaaactaacaaacagaaaggaatagcatcaacatcaacaaaaaggatgtccacacagaaaccccatccgaaggtcaccaacatcaaagaccaaaggtagataaatccatgaagatgaggaaaagccagcgccaaaaggctgaaaattccaaaaaccagaatgcctcttctcctccaaaggatcacaactcctcaccagcaagggaacaaaactggatggagaatgagtttgataaattgacagaagtatgcttcagaaggtgcataataacaaactcctcccagctaaaggagcatgttctaacccaatgcaaggaagctaagaaccttgagaaaaggttagaggaattgctaactagagtaaccagtttagagaagaacataaatgacctgatggagctgaaaaacatagcacgagaactttgtgaagcatacacaaatatcaatagtcgaaccaatcaagtggaagaaaggatatcagagattgaagatcaacttaatgaaataaaggatgaagacaagattaaaaagaatgaaaaggaaaaacaaagcctccaagaaatatgggactatgtgaaaagaccaaatctacatctgattggtgtacctgaaattgatggggagaatggaaccaagttgggaaacactcttcaggatattctccaggagaacttcctcaacctagcaagacaggccaacattcaaattcaggaaatacagagaataccacaaagatactccttgaggagagcaaccccaaggtacataattgtcagatttgccaaggttgaaatgaaggaaaaaaatgttaagggcagccagagagaaaggtcaggttacccacaaagggaagcccatcagactaacagtggatctcttggcataaaccctacaagccagaagagagtgggggccaatattcaacattcttaaagaaaagaattttcaacccagaatttcatatccagccaaactaagcttcataagcaaaggagaaataaaatcctttccagacaagcaaatgctgagagattttgtcaccaccaggcctgccttagaagagttcctgaaggaagcactaaatatagaaaggaaaaatcagtactagccactgcaaaaacataccaaattgtaaagactgttgacactatgaagaaactgcatcaactaatgggcaaaataaccagctagcatcataatgacaggatcaaattcacacataaaaatattaaccttaaatgtaaatgggctaaatgccccaattaaaagacacagactgcaaattgggtaaagagtcaagacccatcagtgtgctgtattcaggagacccatctcacatgcagagacatacataggctcaaaataaaggaatggaaataaaggctcaaaataaggcaaatggaaagccaaaaacagcaggggttgcaatcctagtctctgataaaacagtctttaaaccaacgaagatcaaaaaagtcaaagaaaggtgttacataatggtaaagggatcaatgcaacaagaagagctaactatcctaaatatatatgcacccaatggaggagcacccagattcataaagcaagtccttagagacctacaaagagacttagactcccacactgtcaatattagacacatcaacaatgaaggaaaacatgttaagggcagccagagagaaaggttgggttacccacaaagggaagcctatcagactaacagctgatctcttggcagaaactctacaagccagaagagagtgggggccaatattcaacattcttaaaagaatttgcaacccagaatttcataagtgaagaagaaagaaaatcctttacagacaagcaaatgctgagagattttgtcaccaccaggcctgccccaaaagagctcctgaaagaagcactaaacatggaaaggaacaactggtaccagccactgcaaaacatgccaaattgtaaagaccatcgaggctaggaagaaactgcatcaactaatgaacaaaataaccagcaaacatcataatgacaggatcaaattcacacataacaatattaaccttaaatgtaaatgggctaaatgctccaattaaaagacacagactggcaaattggataaagagtcaagacccatcagtgtgctgtattccggagacccatctcacatgcagagacacacataggctcaaaataaagggatggagcaagatctaccaagcaaatggaaaacaaaaaaaggcaggggttgcaatcctagtctctgataaaacagactttaaaccaccaaagatcaaaagagacaaagaaggccattacataatggtaaagggatcaattcaacaagaagagctaactatcctaaatatatatgcatccaatacagaagcacccagattcataaagcaagtccttagagatctacaaagagacttagactcccacacaataataatgggagactttaacaccccactgttaacattagacagatcaacaagacagaaagttaacaaggatatccaggaattgaactcagctctgcaccaagtggacctaatagacatctacagaactctccaccccaaatcaacagaatatactttcttctcatcagtaccacaccacacttattccaaaattgaccacatagttggaagtaaagcactcctcagcaaatgtaaaagaacagaaattataacaaactgtctctcagaccacagtgcaatcaaactagaactcaggattaagaaactcactcaaaactgatcaactacatggaaactgaacaacctgctcctgaatgactactgggtatgtaacgaaatgaaggcagaaataaagatgttctttgaaaccaatgagaacaaagacacaacataccagaatctctgggacacattcagagcagtgtgtagagggaaatttatagcactaaatgcccacaagagaaagcaagaaagatctaaaattgacaccctaacatcacaattaaatgaactagaggagcaagagcaaacaaattgaaaagctagcagaaggcaagaaataactaagatcagagcagaactgaaggagatagagacacaaaaactcttcaaaaaatcagtgaatccaggagctggttttttgaaaagatcaacaaaattgatagactgctagcaagactaataaagaagacaagtgagaagaatcaaatagatgcaataaaaaatgataaaggggatatcaccaccgatcccacagaaatacaaactaccatcagagaatactataaacacctctatgcaaataagctagaaaatctagaagaaatggataaattcctggacacatacatcctcccaagactaaaccaggaagaagttgaatccctgaatagaccaataacagtttctgaaatggaggcaataattaatagcctaccaaccaaaaaaagtccaggaccagacacattcacagccaaattctaccagaggtacaaggaggagctggtaccattccttctgaaactattctaatcaatagaaaaagagggaatcctccataactcattttatgaggccagcatcatcctgataccaaagcctggcagagacacaacaaaaaaagagaattttagaccaatatccctgataaacatcgatgcaaaaatcctcaataaaatactggcaaaccgaatccagcagcacatcaaaaagcttatccaccatgatcaagtgggcttcatccctgagatgcaaggctggttcaacatgcgcaaatcaataaacgtaatccagcatataaacagaaccaaagaaaaaaccacatgattatctcaatagatgcagaaaaggcctttgacaaaattcaacaacacttcatgctaaaaactctcaataaattaggtattgatgggacgtatctcaaaataataagagctatctatgacaaacccacagccaatatcatactgaatgggcaaaaactggaagcattccctttgaaaactggcacaagacagggattccctctctcaccactcctattcaacatagtgttggaagttctggccaaggcaatcaggcaggagaaagaaataaagggtattcagttaggaaaagaggaagtcaaattgtccctgtttgcagatgacatgattctatatttagaaaaccccatcgtctcagcccaaagtctccttaatgacttcagcaaagtctcaggatacaaaatcaatgtgcgaaaatcacaagcattttttacaccaataacagacaaacagatccaaatcatgagtgaactcctattcacaattgcttcaaagagaataaaatacctaggaatccaacttgcaagggatgtgaaggacctcttcaaggagaactacaaaccactgctcaatgaaataaaagaggacacaaacaaatggaagaacattccatgctcatggataggaagaatcaacattgtgaaaatgaccatactgcccaaggtaatttatagattcagtgccatccttggatgcaagctaccaatgactttcttcacagaattggaaaaaattactttaaagttcatatggaaccaaaaaagagctcacattcccaagacaatcctaagccaaaagaacaaagctggaggcatcacgctacctgacttcaagctatactacaaggctacagtaaccaaaacagcatggtactggtaccaaaacagagctatagaccaatagaacagaacagagccctcagaaataataccacacatctacaaccatctgatctttgacaaacctgacaaaaacatgaaatggggaaaggattccctatttaataaatggtgctgggaaaactggctagccatatgtagaaagctgaagctgcatcccttccttacaccttatactaaaattaattcaagatggattaaagatttaaatgttagacctaaaaccataaaaaccctagaagaaaacctaggcaataccattcaggacataggcatgggcaaggacttcatgtctaaaacaccaaaagcaatggcaacaaaagccaaaattgacaaatggcatctaattaaactaaagaacttctgcacagcaaaagaaactaccatcagagtgaacaggcaacctacagaatgggagaaaatttttgcgatctactcatctgacaaagggctaatatccagaatctacaaagaactcaaacaaatttacaagaaaaaaacaaacagccccatcagaaagtgggcgatggatatgaacagacatttctcaaaggaagacatttatgcagccaacagacacatgaaaaaatactcatcatcaccggccatcagagtaatgcaagtcaaaaccacaatgagacaccatctcacaccagttagaatggtgatcattaaaaagtcaggaaacaacaggtgctggagaggatgtggagaaataggaacacttttacactgttggtgggactgtaaactagttcaaccattgtggaagacagtgtggcgattcctcaaggatctagaactagaaataccatttgatccatccatcccattactgggtatatacccaaaggattataaatcatgctgttataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctgagcaaactatcacaaggacaaaaaaccaaacactgcatgttctcactcataggtgggaattaaacaatgagaacacttggacacaggaaggggaacaacacatacaggggcctgttgtggggtggggagagtggggagggaaagcattaggagatatacctaatgtaaatgatgagttaatggttgcagcacaccaacatggcacatgtatacatatgtaacaaacctgtatgttgtgcacgtgtaccctagaacttaaagtataattaaaaagaaaatacaaactttaagttaaaaatgtaataaaaataataataattgtaataagttttacaattctgtatatggaattttctcaccctgcttaagaaataaatgcctaattaattaatttctaccctttttatgaaactagattaaacgtagtaatctgcataatcttttttatacatttgaatctgcaattcagaaaatgttttaatgatggagtagttgcatccatacacctacataaaattaaaaatacattatttttcacactcagaatttcacaaataattttgttggaaatctacaagttctttggaaagttggtaggaaaattgtgtttaaatagccactgacttttaattctcagaagatacaaatgaattcatctgaccttatctaggaaaccacattactacatgtgattattatttgcacatatagagcgagaaagcgtactaaagagttatccttgtgtaaacttaattcttcaaccattaagactttggctgggaaagaaaatgagaatgaatgagggttcctcagttcagattcttcttcactcgcctttaaccatttattttttgctcaaaaaaatttttttaaagcacaaatgcctatgctttcacatttccaaatgacaaacttaaaacttcactttagcagtatgttcatcatagctcaggaaaaaatctcaatacaatgtaaagaatgaaagcctataaagacatattaatcttttgctttgattggttttgttccattgcagttctataaagatacatgaattaagaacattgagcttaggaactgctaaattgaggatttctctagaatgctttcttctcttgtaaactcgtggaaattaaatgaaaaaactatgttaccacaatatttctgtgcaaagaccaaactttagaaaagttgtcaggaaattccaaaacttctacaccctaattacgtgggtgttgtggcctgaatgtaatttttctattcctcttttccttgttaaatttataccttcaatacagttctgttcatgtggtaaaaactgtgtcataatttgcccagggtatgcagtgtggccaagttctcactgttcttaagatccttaactgggcatttcctgacttttgatttttcaccctttaaacaattttgcattaatgcacaccatacaggatattagcttgagagaaaagaaagaaatttaggataaggatatttgtaaacatgtggcacccacagagaacagttcaataagaccagatttgctgtttgaataaatatgctttttagggcactcagcttattcttctaagcatgagaggaagagaaagacaaatctttattttgcattttttataaaagctatcctagtttcacctcatttatcattcagctacaaaatgaaaacttggcctttgttcactcacaactctaatttttcagaaaatcatgcacagatttgaacaactctcacttctgagtggttaacatgaaaccttaagtttttagaatgtggataagttttaacaaggaaggaaaacaatttcaatcaggtaagaaaacagtttaatttggagattcaagcccttaaataatggggatctagagtaggattagaaatcaagagagatcgagatccccacagaccatagttaaaatgaaactagttccagtgtggtgcaaattgaaattgatattaatagttaatattgtagtggatttcaggagtaaattttctgtacaagtgtagaaaactatgattgatatgtaatataatgaagtttgccctgtttcttaactaagttgtggtctaccaccatccccccactcttcctgtcctctccccatctctccctccctctccccatctctctctctctttccacacacactcttttctctctctctctccccactctctctcctgttttccaagtggaacagagttggctagagatgatggtcttagctgtatatcccggtcttagctgtatgtcccttccaccctctttctcttgttgcctaattcctcctacctcagaaccctgactctgtggattcacattcttttggcacttggtgccaacttgccttctgccacttggccatccagctattgtgtgctctctgatggggcagctggcagaagaggggccatcactcccttgattcacagatgtgatcatttaatcaattgttcaacaatcatttattgcatatcaccatgtgcctggcacttggattggagtccctgggaggaataatgtttttccaacttaccttgactcttcctctgcaactcctcaaggtcccactccacagccttgcatggtgagtaggctctcactttctttggtgatcctggactcccaattttgttctcctagacttaggaaactgtcagacattttgctcaacttctcagcttcttcgttccctcatttgggcttgacaaatgtcttaaaggagaaggaatacccaaatggcaggcttacctctctgcagttctgtctgctcccagttccttgaagttaaagttgtttaatcccttgttagcagttcaatgccttaaagcagctgttttaaacaacttttccagcttttctcaacaagttgttttaaacagcttgtccagtttgtccctcattggaggggtgtttccaatgatctagtcttccctcaccttttaagattcttttccacatcttagcttcctgagatcgtatctctcatacccctttcttttaagcagaattcatcatgtcattctctgtgtcagcaaactcctgagtgcatgcctgtattaaagagtgtattcctgttataaaacttacttaaacatttgtctctcgtcttagacagttcatgtgtaaaggacactaattatatctaacatatatttgtgcccctagtgcctaatgttggtgcatataatagatcttcaataatgcttattgatggaataggtggcatttcatataaatgttattgttcattagattcagtgtctcaaatgaaaagtgtgagctttcttcccaccacaagaagaaaaggagaacgaaacttgtatatctcatatagaatgcttcagatagggaaattagaaaaccaagtatcatctttggttttgtcaaagggagagtggggaaataagaaaagataagtacagtaatcatcaaggttagaaaggaaaaaagaaagagaagaaatctttaaatccttatacacaaattttttgggatgattttccaagatgttagcctatttacattgttcagcctctgcatgtgtgtcattatctcccaaaggagaatcacatgatacccaaatatctgcctttaatcctcatgcctggtgggatgggtgttcaaaaggaaaggaattctgacaattgttttcagagatatccacctcaatatttagggtttctgggtggatatttgataaattgtgtagaaatatttaaaagtacagaataataataataaaaagtgcactttcggcacaatatgtggatgggaagtaaaggaaatggcactttttcctcacagtgaaaatttatttataaaatacaaaaaattgtcctatttacagtacattaattactgcaaatggcataagcagaaggaatttatgtgaaattgcagttttgccttttcattcttgtcctattctcagcctttttttttctccatatcttcccctataaaataaaagaaaatagtcacatggacaatttccttctgttgtttaaggatgtctcaattctcagagtagcaacagtatgctatgataatatttctaatttcaaattttgcagttaaaaaaatacaaaacctgtcactcatgatcaataatgcacagaaatcatggagtgacagtctctaaaattgccattaaaataatgtgagcaacacgcttcaccatgatctatttattcagcacaattttactgttaaaaaaacaaagtcaagggaacctgtaactattaagcaccttaccacaccgatcttgtattctccccaataagcataagaggtaggtgatcttaccctcagagagccaaggaagcaagggttctgagagatgtagtgccttgtccaaagcaaggaagtggaaaaagagaatccaaacacaaactccagttctcttgcttgcagaatctctgctgtttccacttgaccacaccattttcagtcttcaggcagggtatggatggatcatggctctgacacctaaaaaaatgaactcctccaatgtaatgcaaaataaaataatgccaaaccctaaaagaagtacaaaaacatgccacattgtcttacttttttccccatggtaaatattttatttatttatagaagtatcaataaccaatttttttcaaagagccctctctctccctcctctaccctctctcccacccgcttggtagtgttctaagcacatagcttgtttttcatttgtgtaatctggtactagtcagggtaggaaaactttttctctatcgagcagagtttcttaagtaaggtttatgggcaactaaggagtcaatagagggatgaaagatatcgatgagagctctgatgtaatgtgcaaaatgttgtgtatataggcagttttctggggtgtagggtagagcttttgttgctgtcctcaatagatgaaaaaccattgtttacacattctcttctaaattaataacaaggattataaaatgttattcaataactaccaaaaatcaagataattcttgctaacttatccttacatagcttttcatctctccttggcattgttctaagcattttatgtatattatttaatcctcacaagaacccaacgtagttagtattatcatggtttccactttatttaaggtgcaagatatttcataaataaaaacatctcagttctatattatgataatagctaatggagaaaggtagaagaacagaagagagggaaagagaaaaaggaagaaaaatagagcaaggaaggatgcagatgaaagggtgaggaagagaaatctagtgctgaagtattgtaggaaaacagaagtgacaactatgtataggctggggcaaccatagctgtaaaaacacaattctgctatttgccaaagctacaagcattaacagattaattattttagaagaaaaaagaatacataaatgattagattaaaaacatgtataaacactgtcagaatttattaggagaactgtctgaatttcagcctaatgtttagaagcacagacatttctgaaaagttctcttttcttcatttgatggaaaatccttattcacacagtgtggaaacaggctgagaaaatagtcatttcattgaataaacatccatcttccacatggtcttttggacattaattaatggttcctcatagctcaccctgtatattggtgaaattaagccaagaactgtatcaagactatggatgaatgcctgtctatccttcctcactcgccaagtctaccatgaaattaaactgagctgttataattggaaagcggattatctatattgtaactgaaatgctctcagtacgtttaaactagccctgtatagtgcctgtgatgataaatattgtaggaatttgaactagattctttcttctctttaatgaaaagctcatgaatacagtaagtgcctttaggatagggaagttagtatggttttcctttcatattaaagaagttttgttacttgagagagaatgaatgatcttggctcagtgttgagtttctcattttcttttgttttcatctttaaaaatgtggggagaagagtgggtttgaatataaaaattgactttgttttttcctttattctcaatgatcaaggtggatctgagatgcacatttttcaagcaagtgttttctaatatatttggtatttgttgtgttatgtctcccctacaccacccctcatccctcacatacattgtctactctacaagactgtagagccatggaattagggccacaacttagggaacaggggcagggagggaccattcaggctctatgtgaattgtttttctcacagaactaatggattcacaatttagactaaatggctatcaaagatggacgttaaataccttgaattggctctgaatgaccaaattttctttcaaaaagctaagcatatatatttcaaaggtagaaagggaacttgcatattcattgttctctttatgttcacttataaaaatacgtactccctacttgcccatttcttttcattggacatagactgttgtcacaatcagctcatgaagctgtcagcagatccatggagactgctttaaagtaaaggcaatgtaacatcaatgcaaatcccatgattattaacgaaacaaatagaattcatttaaaatgacttttacagttgaagtctcctctcagaaatcttccccactattctgtttccgtttcaaagtcacatctttgttaatgacatcatggaatcctgaattcaaattgcttgtgttttgttaagctttgggaacactcatgctagagttccagctttgctagggcatattagaaaaccacatactatttaaaagggttttagtattggttaaacactttgtgtattaaaatgctatattattgcagcagagttgaaaatcttcccttgaattgggaatattaagtaaaagaattcagctaaaggtatatcactaaaatatttgcagataaagaacatttgaattatgactccaatttttactcactttttccaaaaagaaaatttattaagtgcttgccatctgccagacattggctatatgttaaataaggagaagagaataatgtaaagaaagatcaggcatacccatgatgctcaaggatttttttggaatttataagtgagggaaatgcaaatgcataattccagtacagcatgctgagggccatggcaggggtatgcctcatgagattgagagccaattgcctgaaggaatctggtgattagttttggaagggaaatataaatctggccatcaaagaggaaggatgttgtgggtagttgccagattctctagctgcctagaccgtttaaacactcttgtaatggttgggaaacttcttgcatccccaatatagaaggcaaaaacctttcttcaccagactcacttggagctaaacacttgcctattacctagattccagcagtcagaggggtaaacaggagacattgatatataggtgagcaatggaagtggtaggtgtgtgggtttgccttttggagacagaagtagagctttagtgtgagcaatgcaggggtggggaaatctgtgatgttgagtcagaaagaggaggctagggtatttgggtattgttcttggcatctgagtacacaaaagtccctgactcttctgggaactttgtaagcttcttcataccgctcaatatgttttgtgaactaccagtatcctataataaatgtccttttgctagaatgagtatagtttggacttgaggacctcgactgatagaaatatgtaggtatttatggtttggccaaggcagaaagaagagggtgtgcaaagaaaagaagaaattaaggaagtaggctaagttagagtgtgatagggatggttttgacgtgaccattggtagttaggtagggagtaatataaggagatgagattaagaaaagttaatatcagatttggggacaaactaggatatagttctaaattatctagactttactccataagcaatggggaacctttgggaaagttttaattgaaagactgacagacattttgatgtctctattttcaagcaagaaccctggtggtattgggaggaggcatgaatgaagaattgctcatagtgggaagaccagtttgaaagctgataccatagtccatgtgaaaaataatgaggccctaatgagatggtcacagtgaagatgtggtgggggagtgatgggggggttggcaggtgtatctgtgagatctctagagaggacaatcagtaggactttatgacatggaaattaatggggctggcgcagtggctcacacctgtaatcctaacattttgggaggccaaagcaggtggattgcctgagctcaggagttcaagaccaccctcggcaacattgcaaaaccccatctctactaaaaatacaaaaattagctgggtgtggtggcagatgcctgtaatcccagctactcaggaggctgaggcatgagaattacttgaacctgggaggcagaggttgcaaagagtcgagatcatgccactgcactccagcctgggcgatagagcaagactctgtctccaaaaacaaacaaaaaaagtaatgggtcatgaggaagaaaaatagggataactcaagttttccaatttacattattaggtgaatagtaatgaaagttattgagatgggaattatagtggaaaaagcaagtcctgaagtgaatgtgagaggataagttaattttagacatcaaattttaagtacttgaaggaaatagttgggaatacacatctggaattttatagagcagtcaatgttgtagataaaattcaaaatcattagtaattaagtggtagttggagtcatgggcatagatataataaacaagggagagtatgtagggaaaaaaggagcagagatctggataggggctggggaggtgtaattttaaggggatggaaagaaatcagtataaaagacggaaaactgggaaaggatcatcaaagatgtagaaggaaaactagaagcgacactcaagcagacttgagtcttctactgttggaaattaatgtcttcttttacttcatcttaacatgaaggtcctgctattacctttaaaaatatttttctttcactggaatattccacatagcatacatcggaacgttaactgtgttcagtgggtactgccactaattcatcttgaaacccctatgttcaaggttttagaagagtgtataatgtacataaaataaatacaatagagtaagcattaagtacatgggttaggttttctgcagaaagtgaacagtcttcatttcctttatagatttctaagtggtaaaaccaccaaacaattccttgtgataaatcactgcagacagcatgaaaaatttccttaggtaattattacactcaaggatttctggtaaggcaaccaaacgagcataatactgacagtccagacaccttagtttgagctttcaacaggtgatccacagaacaacattcaaatttatatgttcacatgaatggaaacatttggcacatgtacagaaacctttcttttcagaagttaacaattatgatttctaactaggaaattttattcacaatccttcaatgactttcagcattggcaacagcttaaaaaactagagttggcttagtccctacttctagatatttagctcttgagttcttcagttcctcatctgtgatttttgaatattggattccccagattcttctacagacacacaacagttctccaccttgtgaaagatttctccaggagtaagaattattctcagttcctttaatgtgctattaccattttgtcccatcctgcctggaatcatctctatactcttctcctgcccacttctagatccaaaggggaaagagccctgcactctaattgctgatataagaattcaccatcaatatcaaatcccatgccttttcatcttatatttacctggcatttttcatggtgacatatccaatgaattgcaaacagaaataccctggatcacaaatacgtttataatggtaaccaacaacattcatgtaatttttttagcagccttcagtacaaacttaggaatggtgaaagcaaatgactactatgggttggaggttgacagaattgggcataataggcaaattgaaggttttcaggagagccagtgaaataactaaccctagagtccaaactggggaaggaaatttatgaatttatttattcttttagctgattattgtgtgcttgttccactagggccagattactcttatgtccccaggtttttgctgtttaaaggaaatatttaagaagggaaatatttaagaaaggaaatgataatatatttcacagatgaggaaacagaggttcagagaaagtaagtaacatgtgtaagaactagtaagtggtgaactacaaagtcagacctggtctgtctgcctcaaaggtccatgctcctttcactacaccatgctggaatccttgaatccttcacaaacttatcaggggaacccgcccctgataattcaacgtggatccttttctattttccctaagtgtcggccggtctgagaaataaagggaaagagtacaaaagagagaaattttaaagctgggtgtctgagggagatatcacatgccggcaggttccgtgatgccccctgagccataaaaccagcaagtttttgttagcaattttcaaaagggagggagtgcatgaatagggtgtgggtcacagagatcacatgcttcaagggcaacaaaagatcacaaggcagaaggtcagggcgaaactagaatcactaatgaacttccatgtcccgctgtgcacgcattgtcagggttcaagagcagagaactggtctgactagaattcgccaggctggaatttcctaatcctagcaagcctgggggcgctgcacgagactagggcgtgtttcatccctatctacagctgcataaggcagacactcccaggacggccattttagaggccccctctgggaatgcattcttttcccagggctgttaattattaatattccttactggggaaagaattcagtgatatttctcttacctgttttcggtaataagagaaatatggctctgtcctgcccagcccacaggcagccagactttaagattatctcccttgttcctgaaaatcgctgttatcctgttcttaaggtgcccagatttcatattgtttaaacaatttgtgcagttaacacaatcatcacagggtcctgaggcaacatacctcctcagtttatgaagatgacaggattaagagattaaagtaaagacaggcataggaaatcacaagaatattgattggggaagtgataaatgtccatgaaatcttcacaatttatgttcagagattgcagtaaagacaggtgtaagaaattataaaagtattaatttggggaactaataaatgtccatgaaatcttcccaatttatgttcttctgctgtggcttcagctggtccctctgttcggggtccctgacttcccatgacacaaaatcatgttgcccttaacacttccctctgttattcaaggggtcatgcaaccctgagagcaggtcaggtgcctcaatataaaggtccaggggccatggaccctgacacagtcagaacctgtgtctctacatctgggaagatataaccatcagactaaggtttgctgtccttcaagcattatcccctgatgtaggaatgtagtcaggaagtttgacagctttcacatctgtctccttgagtgctctgccctcccagactccctctccctaagacagtcttcaatatctggtctctgacactccagtttggttttgaaatgcttttggtttctctggccatgctatgttccagggaagagctgttttgttttggtttttctcatgccttaagttctgttttggtcaaagcaacagcttccttcccaatttatattacagtggaggttttccactcaataaggaagaaaaacatcaattatagtagaaaccagtgggagaggtaaggggacctggtggatgagaggagggaagaaggaagagaaaatgaggaatgaaagggaccaaaaaaggaaaagttgttaaaagcttgacacacacacacacaaaaatggaggaggtaattatggctgaaaggttgtggggagaggtcattaggaagtctttaagattaaaaaaataatatatccaactctggggaggtgacaaggtcattaagcgttgctggaagcagtgtaaattagtatggcttttttggcaagaatctagagtttggcaagagccttaaaactgtttatacctggccaggcactgtggctcatgcctgtaatcccagcacttttggaggccgaggcgggtggatcatgagatcacgagatccagaccaatctgatcaacatggtgaaaccccatctctactaaaaatagaaaaattagctgggcatggtggcacacgcctgtaatcccagctactcgggaggctgaggcaggagaattgcttgaacctgggaagcggaggttgcagtgagccaagatcgcaccactacactccatcctggtgacggagcaagactctgtctcaaaaaaaaaaaaaaaaatgtttataccctttggctcaatattgtacttctggaaatatatcctaaaaatacttctgaattttgaagcctatagaaaaaaagaacttcgtgcacaaaatttttttctcagtaatagttatgtaactaaataattggtgacaaccaatgtggctatcaatagacaagtggttaaatagttttgaccattcagtaattcctattacttgattgaatattaggtagccattgaaaatgattgttttccaagaccatgtaatgtaacaagtgcttacaataaaaacaagctacaaaaaactatatcatccaaattatgtttacaaatgaagaaataagtgtctgtgagaaatggtgttggaaaacacaccaatgtattaatactgatagtgttttagtagtgagactacagggttggtatttttttaacaaagcaattcttaaaattaagatattatttacacacaataaaattcacccatttttagtgtacaatgtgatacattgtggtattgtgtacaattggttaccagcacctcaatcaagaagttccatgtgagggatgaaaaattacctattgggtacaatgtacactcttcaggtgatgggtatacagtaaagcccagacttcaccattgtgcaatttatccatgtaaccaaaaagcgcttgtactactaaaactactgaatttttttttttttaagaagttcccttatggcctttcacagtgaatctcctcttctcacccctgaccccagacaactgctactgatcttttctctgtcaacgaaagtttttccttatctagaatggcacatacatggtttcatatggtatacaagactattgtttttagcgataatctactttaaaatgtttcttcaatgagtacattaaaaaataatttgaacctaaaacatagacttcaactgtttctttttccactaaatgcaaagtgggaaagaaataaagagctttgattacttaagagaagatagttcaagcagacctaagttatcagcgagctcagaaaatctccctgcttagaggctataaatagtatggtgtaatactgatcctcattcaaagctgtgatagagtagaagataacttttcaaagtttgtttctaacccgataagaggataataggagaagagagagataagaagagatgtttgtaagcagaaaactataaaggggggatatttttcattgttttgtattctgaacatatgctattataaatttaccattccggaacattctctttaaataatgcaaagcttgtctgaccacccagctatatttctgtttttcatttttaatgtctgcacattagtcatttattttaagctatgtaattataagacaaaagatgctaggttaagtataaccacccatgaacataaagccatttttagtaaaattacagtctgagttactatatgtagtcatgtgattatctgcataaacacctatgaatttggagtcagtatgaaataacaaagttaaatattgagtgaaaaatgctatacacacattatgtttttatgtgtgtgcacatcaatatatatgcagttgagaatgttaaatagaagtgttctttcattctttccttattttacaaaagaaaaaattttgaatgttttgcttcccaataactcccaaataccttatttaatgctttttaattgtggtaaaatatgtgtaacaaaatttactattttaatccttttaagtgtacagtgtagtcgcattaaatacattcgcatcgttgtgcaaccaccatccccatccatttccagaacttttctcatctggcaaaactgaaactctgtacccattaaacacaacttgtccttctttcctcccagcaaggttttggcagccaccattccactttctatctctatgattttgaataccataagtacctcatatgagtgaaatcatatggtatttgtcctttttttattatatggcagaacatttctatgagtatttcctcatggtgacatagggaagttgatcctataatgatacaaagatgctctgggatgctttcctcatgtatcttgatggtccttgacaggaatatctctatctgtatttcttgctggtatatagttaactattaatggtacaccatgttgtagccatataataaaacagagtagtacttaacctcactgaaggactctgttgtgttgggtacttgacaggaatttttaatctggaaatttcttaaattttaggaaatttatttttgtattatttcttatatacttttctccctacactattctctgctctctttctgaaatttctaataatttggattttagacctcttaaacttattttctaatgtttttctcttcctctctagttttcccaattgtttgttttaatttctggtcaagattgtcaacttctaatccttcttctaaatttctaatccttctcctacattttaattactgttatcatgattttaatttctatgatctgatttttatttctttctttttaaaaataaaaccctgttctactttcctgaatgccatatcttttttatctcttggatgatattatagttttttgaagtatcttctcactgatttacttctattttcttcaattcctctttggtattcacctatcactcacattagaggctttctcgaaggtctgaggatcctttgcttccaccatgtaaaaaagagctaattgatagctctggattcctgtgtggatgttgggggaggagggccttatagagtgtggactttaatgtaggatcactgggatgagttatctgggtcaggtggggggtacaaatctcagtagctttgagcctcttctttgagctcagtttcccagggagaagttttccatctccctcctgggatatttaatgctggcttctcagtgggatctcactcatcaggcagtagatttttactttattgttctgtctacagtgcagcatccttttctctgaccagccgcaagtccagggttcctttgattcatcactgccagagaataggtctgcagacttttactgaaatgggagtagtttccagattgtttgagttagggaagagatacatgtccctaactgctttttaaaatgcagctaatttgtgtgctattttcaattttacctgtaacccaatttaatttattttatttttttattttaatttttattttattttattattattatactttaagttttagggcacaggtgcacaatgtgcaggttagttacatatgtatacatgtgccatgctggtgtgctgcacccattaactcctcatttagcattaggtatatctcctaatgctatccctcccccctccccccaccccacagcagtccccagagtgtgatgttccccttcctgtgtccatgtgttctcattgttcaattcccacctatgagtgagaacatgcggtgtttggttttttgtccttgtgatagtttactgagaatgatgatttccaatttcatccatgtccctacaaaggacatgaactcatcattttttatggctgcatagtattccatggtgtatatgtgccacattttcttgatccagtctatcattgttggacatttgggttggttccaagtctttgctattgtgaatagtgccgcaataaacatacgtgtgcatgtgtctttataacagcatgatttataatcctttgggtatatacccagtaatgggatggctgggtcaaatggtatttctagttctagatccctgaggaatcaccacactgtcttccacaatggttgaactagtttacagtcccaccaacagtgtaaaagtgttcctatttctccacattctctccagcacctgttgtttcctgactttataatgattaccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctcacatttaagtctttaatccatcttgaattaattttagtataaggtgtaaggaagggatgcagtttcagctttctacatatggctagccagttttcccagcaccatttattaaatagggaatcctttccccattgcttgtttttctcaggtttgtcaaagatcagatagctgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggattcctaggtattttattttctttgaagcaattgtgaatgggagttcactgatgatttgcctctctgtttgtctgttattggtgtataagaatatttgtgatttttgcacgttgattttgtatcctgagactttgctgaagttgcttatcagcttaaggggattttgggctgagacaatggggttttctagatatacaatcatgtcatctgcaaacagggacaatttgacttcctcttttcctaattgaataccctttatttccttctcctgcgtaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcagtacctaatttattgagagtttttagcatgaagcgttgttgaattttgtcaaaggccttttctgcatctattgagataatcatatggtttttgtctttgattctgtttatatgctggattacatttattgatttgcgtatattgaaccagccttgcatcccagggatgaagcccacttgatcatggtagataagctttttgatgtgctgctggattcggtttgccagtattttattgaggatttttgcatcaatgttcatcaaggatattggtctaaaattctcttttttggttgtgtctctgcccggctttggtatcaggatgctgctggcctcataaaatgagttagggaggattccctctttttgtattgattagaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcgaggaatttatcgatttcttctagattttctagtttatttgcgtagaggtgtttatagtattctctgatggtagtttgtatttctgtgggatcagtggtgatatcccctttatcattttttattgcgtctatttgattcttctctctttttttctttattagtcttgctagcagtctatcaattttgttgatcatttcaaaaaaccagctcctggattcattaattttttgaagggttttttgtgtctctatttccttcagttctgctctgatcttagttatttcttgccttctgctagcttttgaatgtgtttgctcttgcttttctaattcttttaattatgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttacctgtaacccaattttaaaggtaaccagtggttctaattcctgagtgattccggagttctatggtatgaatcgtcctgctttggggtttttcttattaccattgtaaatttcatctctatttctgcttccaaaatacagtggctgtggcttttttccccctagttctttatctttgtgagttttggcctttttatatccctgtaattttaatagtgtttggggaaggtatagaggtgaacatgtgtgtatctaggctgatatgtgtgattggaaactcgatgtgtgatttttagatccctactgtatttttattattatttaaatacgattttttagctgtatgttactgaattgtgattagaaaacatgggctgtatgatattagttctttggtgttgagatattcttcgtgaactattacatggtcattattgtaaatgttccatgaatatttgaaaataagctcaattgtcttaggtgggtgcagaaattttctgtttcaattaattaaggtttgttaattgtgttgtcaaagtcttctatttccttgctatatacttgatttctgagagagtcatcttcctttgtattactatgagtatcatttccacaatttctcctagtagtactttccattttttgctttatatattttgatgctactctgttgaatgcacacacatttgggatctttacatattcctggtgaatttttcatttaccactttatgaagagcctctttaccttgaaatctcttttgctgtcaagtctattctagctagtgtgtactagtgttctttcagaatgtttctgttaaatctttttttattctttcacttccatccttttgttaaaaggtacaattgacacacaatgaagtacacacagttaaactgtataattaggtaacttttgacatatgtatacacctgtgaaattatcattaaaatcaacatgatgaatatactcatcacctccaaaagttaccttgtgtttttcaacccctccctctagcccctctctgtctcctatccccaagcaaccactgacatgctttctgtcattatagactagtttgtaatttctagaatttcatataaattgaattatacagtgtgtactctcttttagtctggcttctttcaggataattattttgggttcacctatatggttgcttatataagtaattaattcctttttattgctgaatagtgttccattgtatgggtatgccacaatttgtttatctatccaaccactaatggacgtttgggctgattccagttttggactattgaaaactgggttggtaatttatgtgtaagtctttcttatggatatatactttcttttctcttggaatggctggagtgtatgggagatgtataattaacttttaaaggacctgccaaattgttttccaaagtggttgtgccattttatactcccaccagcagtctgtgagagttccagtttctctgcattctcaccaccaacacctggtatggttaatttttaaaatttagttattttaataggtgtgtaattgtgtcccattgtaattttgattagcatttccttaatgactagtgatgtcaagcacctttttatgggttttttttttgctctctgtatattttacttttgaagtgtcttttcaaatcttttgtacacaaatgtttgtttagtatctacttgaaataatatttttctcctttgacatattcaagtgcttaatcaaagtagtaaaatttctagtactaaatcctaggtaaattttatgtttccaaggtgtgtcatttttcaatatacagcagatcgtttggtggtttttttttgtttgtttgtttttttgtttttgagacagggtctcactctattgcccaggctggagtgcaatggcacgaacatggctcaatgcagcctccacctcctagagtcaagtcgtcctcccacgtcaacctgctgagtagctagaactacaggtgtgtgccaccatgcctggctacttttttaacattttagtagtgaggaggtctcactgtgttgcccaggctggtcttgaactcctgggctcaagcaatccccctgccttggccttccaaagtgctgggattaataggagtgagccaccaggcctggcctcagcagctgtcttaatagtcttgatttgcttcaattcaatgttgatttttgcctatgaatttaagaatagcttagtctatcattttttctataatctttccttgtcagatttttaatcagtcttacgtttctacatttctcatggtctgaaatgtttctagagcaacagtattctgtctcttgaaaacttgatagaactcatctgtaaagctctatggacatggtggattttttggagataatttgtaataatcatagttttagaagttactgttatagccagaagttttcttatttcttctcaagtcaatgttggtaacttttactttgctagaaataatccatttagtcagatttcaaaatgttttagcatatgattataataatatttttaaaagcatctctgtgactgctttttttcttttttctttcttttttctttttttttttttgagacagggactcactctgtcgcccaggctgtagtgcagtggcgtgatctctgctcactgtaacctccacctcctgggctcaggtgattcttttgcctcagcctcccgagtagctgggattacaggcacccaccaccatgcctgactaatttttgtatttttagtagagatggagtttcaccatgttggccaggctggtctcgaactccggacctcaggtaatccgccttccttggcctcccaaactgctggaattacaggcgtgagccaccgcacccagcctccatgactgttttttatattccctttctcatttctacattttggtgtttgatatttctcagttttgtttcctaaaactatactgagggttttcctgtatttttttttaatctttcaatttctcaggtatttggttttgaaattattactttgttctattttccaattcattaattttgccttttatctttattatttcctttcttgacttttcttataatcttgttctcttagtaagtgacttagctcatttatttccactattttattgattaatttcaataaaatgttatgaagttacctttgtgtacaattttaccacaacctgtttatcttgatatgttgtaattgtctttaattgtagagcttatttacattatatacgtgcacaaatttagattaatgcttctaaaatttccaatttgtttttttttttgttggtgtatatttgcctaaaattttgttataaatttctaagtcattacattgtagctggtaaaatgtctactttggggaaatctaaaaataggctatttgtgggtgacaatttgtaaacatccttgaatgtgaatacacattccttgaggcaaagttctatatgtaactattaagtaattttagcaattaaattattcagtttttctatattgtattttgttttggtctattgaatatttcagaattgttttataataaaacactgaaatatgcttctcttaaactctgtttaattgtagcaacattacttcatatatatttctacagagacctagacatacactgtccattatggtaggcactcaccacatgtgactttttacatttaaattaattagaattaaataaaattttaaattcagtttatatgatactctagttgaatttccagtgctcaaaaaccccatgtgcctagtagctaccattttggactgaacaagtatagaacatttccattgtcatagaaagttctattggacagcattgcttgactattatattttattgtggattatacctttgattagtgtagtgttgctttattttttatttattgcaatctgcatttaatgctttctattttttctttcaatttcctgatacatatttgccatccttttatttttaatacttctgaacattttgttctatatattatctcttctaaataatatataattctattgctaaaatatttttaaattagtttaacaaatttgttaattttcatactaatatattttatcttctgatgtcttcatttattttttttaaacagcttcctagtattcttactggtgttcatcttttgatccatgtgtagaatattggttaagaccataagctcaagcatatgcctagtcgggcatgggtcccatttcaatatttcaagaatcagaagctcttaaattctttgtgcctaaatatcctcatttttaaaacttgaaaaatagggataaaaatagtacccatttggtagggttatcgagagggttgtaggaataaatgttttaaaagtacctgatacattagtagtcagtgctcataactactactagttattttttgggctgctttgtctctagaaacactgaatgtattttttattatgatttcactgttaaattatagaatatgtgcaacctgtatatctctaattatcagtgtcacaaaataaatgcaattatttgaatcccatctaaattgaggtcattagcttctttttcattcctccctcttgtagacccatcttatgaattttgttggaattatttgtcactgtagatccatattgtttaatattaaatactattttaactcatttagctttgctttcaagaatgattatttttgcattctttaatgtaatcataagtatttggttcaccactagacctatttaacctttcttatactcttttttctttatgtatttatatgttttggccaaatggtatcacattgtacaatttttaaaaaatatttatttatttattatttatttatttttgagactgagtctcgctctgttgcccaagctgaagtgcagtggcgggatctcagctcactgcaacctctgcctcctgggttcaagcaattctcataccccgagtagctgggactacaggtgtgcctagctaatttttgtatttttagtagagtggattcaccatgttggctaggctggtcttcaactcctggcctcaagtgatctgcctacctcggcctcccaaaaacactgcaaattttgaatctgcctttctttccttaagaatctttgagagatagaaaaatttatcccaggagcaaaaagtaattaaagttcacttgatacgccaaaaaatgtgaaatatagccatccaatttcctcaatttattcacattgtttgggccatatagttatctatgtttgggtggtatccatttggccatttcattatgggtgtgtcactgtctatatgttttgcttggaagctgaaatggatctcttccctctgtatcatcatagatgagttcaattactacttgtacttagatgacgccacagtctgcgtgtccatttctggactccttctctctctttagtacaataactcctgattttaaaagctctttccgcatgctgttattcacaagatgtgcgtttattaatctgtaaataatgatgttggattaaatgatctcaaaggtttattccaggaataaaagtctatgacctatagctgctattcctttagtattccaccgaaagtgctctttaaaattcttttaaactcctcctcctgaatttgttctttttccactatttgtgtgaagctggccattatttctctaacaaattgaactgtcttttaactgaagcacagagcctttgtaaaacatccatgatctttgattctctgaaacctactctgttacacttagtggctccagaatccaaagggaacatagtcaccacctgtgttctcaacattgaactgctcctgaactccgtttttcttactcatcacacattctctcaactcttcaagacacatgataactcaccgttcggtgccactcaaaaagcaggatcataagggccagtaccagtgggataatgaattggctcaagggacagtagccatccctccatttctgttttctttgcctttgaaatattttcagtaatacctgaccacacatcattgcctcatctctttcttggagagctcaagctatacccttcgcctcaggagtgtcagcacagtttcagtacaatatatatggcacatgccacactactgagagcaccaagagagaaaagcaaacctctctagggctgagggagtcacctcaactgaatgatgattacctacctgtggactataagctccagaggtggcttctgattccagtttacttagctaatcagaacatggtgcactttctctctctctctctctctctctctctctctctctctctcattaattttcatgtctaatccataccagaaaaaaaatcaggcctgtccttaaattacttttgtactaatattacgactgttactactgttaccataactatgagactgttgctgctgatactatcaacttagtgctgatacttctgctactgctactactgtggctagggatactatgactatcatagccacagttgtcattctggtagcttttactctatggcatgaaatcagcaagacactttccatacattattttatttaatctttatatcagctcttttggataatattagttatccctacttgagagaggagaaaatcgaatcttagggaggttaagtaaatttcccagtgtgacagagattgtaggtagtatagctgtggtatttgaacctagatcagtttggcctcaaagtccacacttttaactgttacagggccccaagctggaaaattcctcatgagctgatagcatctccttccaaagtactggcaaatgttgctaatagatttcacctctcttcctgcctaagcccagatacaacctcagaatccttttccagttagagccaggacagccactagagaaaatccatcagatttggcatgttgagctaaagcctgtttgtgagccctgtactccatgacataaaatggcattccccctctgctttcccttctttagctctcctgtggcactgagatgacaaggggctgaagccaaagcccattcacttgggagatgcaataatgtggaaccataggcagaagttgaggctgttgccactgtgtactcctgacccttttcttgaatagcacatattgatgacttctccatatactagaacatcgagcattgcttgtgaggacaagagtaactcaaacattttgtatatattgtctcttaatagttatagagcataggctctaatagttttagctctgtccttctctataccattgaccacacaacctctcctcaccagactccattcttactatttggagaatgggatttacagtacttacagctttctacaactagaaagctttcaaatcatgaaacgtgcatgtatgagtgtcaccaggaagttcaagataattataattgatgcagtgaagcaaagtcagactgaaaaatgcatatccatatgcttgcacctttaaatatatgttcatttattcttagtgttggtaaaaaatgtgtcaattcaaggagaggaggagatttcttcctgttattatgaagcagtgccaaaaagaaaagatcaattattctcaagacacatttagttgagccttcctcccacatccaaaatacttctgtgagttacacatctgtacaatgcagcaattgtttcatctttctcaaactaatagagatgctagaaacatctggtagttgatagttaattttttttttcattgcaccttttcataggaagcagggaacacaattcaatatctcccctgagagggtcttgcgtttatgacaggtgtgtatttcttaatgagtcgttgtttgacaccgttgcttctcttaagtccagctggaagtacattcatctggcaaaaaagagaggggaggaaaagtgaaatttgaaagaaagttggagtgtcaggtggttgttgcataaaacatccaattcactccagtaatatttattctgcttattttgtgcaatttcctgcaactggcttttacaactctgtcactatgatgacttttctgttttgagttatttagctgcgtactattaatttatctgagactaaaatgatgcttctttcctgtgtagaactaggaattgattcagcatacggcttggccttgggacaaacaccttcatcccaatatcccagcatccaagccccaattgaggttcagaaagaacagaaggatataagattagttattatatcctgaattttctgtctccttcttagtgtaactctttgatctcaaaagacttatttttagctcgttgtgacctcactgagattatccctatccttcctagcagttatgattagctagttatttttactgaaaacatttcagggcttgaagtgggagggtgaggatgctgcattgttggtggagggcccagtatttggaattcttctcttgatgtgacataacgaatcttaattgccctgcccttaggccgtggcatagctactctggctggctaagcctgaaggacagatgttgcttagggagaggttcagagcttgcccaaagagatgccattagcaagcagaagtgaatgtagggcctccttgatgaccaggaccatggcatctacctgctgcctcagtgacttcctcatgtgaagacttggtttgctggagagctatagaatatgtattctaaaagactcagtgctaatgatgtttgtatcaccatcgcttatctcaaacttctcagactcctaggctctgttgacaatctcgccttttagttggcttaaagtactctttctacacacacacacacacacacacacacacacacacacccccacacacacactgaatgaagaactctgctgttaatagaagcatttcactggtcttttttaaacattcaatgttaggcaaaatatgatacttgcctactggtttagtgatttcctcacttgattccagtgagaatggtttggaatatgggctatttctaatttgttcatcaaaatacaaataaaatacatgcaaaattgtacagtacaatacaacagaacccaaccctttttatccatttctctcaagagtcttctagtagtatgttggcaataatattcccactggactcatgaggtcactgaagcaatgagagattccataatttgaccaaggccaatgctaatgaacaaagcggctgtgcctctacattaaattacctggttagtcctggttgtataatttcacttagcatgctaaattattttgatttcctctaagcatctattgtaaagtggcaaagctaatccaagtaagcaattggattcacacaggatgaggacatggtggggtggcctcttgagtgctggtgacctcagtgcccaggcatctccattccctcaaagccctctcttgctgataaggtcaggaagaatcttgttctgttcatggtcttctattggctggcatgccctcagttatcattactgccacttactgactatacagaaatgtgtttccatgggataaccacttggcaatggctttgataattactatttgtgctgccgccagtccatcttcttttgtctgtctttacgggtggtctcctgacggtctcatgaatgccatgaatgtaaggaatgtgtaagagtctgggactctgatttcaaggcaattttttctgaactcccctccccttcctttatgacaggagtaaaaagaactttagtaattaggttaaactctttaggaacatttcttgttagaagttgtgtgtcaacactgaaaaagtcactatggaaaggtactctcattcatcttggcgactctgtctaagaagttttctttgtcttagaaaccaatgcaacagatttttgaattacctaataataagtgttatatttctcccatagcaggagagagatttcttttcccaagtatggtcttctattctcttttctttaagtctcaagagtggtatttaatctttgagaacattatattttgcatatggtaaagattgttaaaaccgttggggaaatttaccaggaaattggcgcatttttttccttcttccttttctgcatagaagtaacaatgattctaacactgtgttttctgtgatctaagactcatggtaacagtatgagctttaaggatttcaccaaaacctgtacagacctgcttggcccatatctactttgccttatggttggcagtggggctccatgtgatagagatgtatcagagtcacccagacaatttgttaagattcagattgctgacttccacccacagagtttctgattcattgtgtctggagtgagccgtaaaaatgtgcctatctaacaagtttataggtgatactgatgctgctggttctgggaccacagttttcgagaactcccagagatgggagtaagagtaacaattgccccatggccaacatctgaagctgctattccttgtgctaggataaccataaacctctggatttagtaggaacagcctatgctactactgggaagcttctgagtctatcacatcttgttaggatgcttgaaaatggacaataatatatttgcaaaatatggccctagcttcttaagagatatccaagcactattatttttgttgctttttcttccaaatccttgtcttggaactgatggcttgtgagaaaaatgactacaaatgccatcaggaaaggaaggtcttagcatgatagtcagtttaactcttgaagaagaattcgtttttcctgtgtcacatggcttaaaagttagttaaaccaggacaagcctcgatgtgtctggattgagctaatgagtagctgaatagtttacccataagtgcagagtaatcctcatgaccatatgatataatatggaaagtaatcaacagtttcaaaaactgacatcacccagcctattgttttcatttgacttaactgataattcctacgtgccttaaagggaaaactagaccaattagtagaggaggaagaaacaacctggcaaagaggcacaactctaattacatatgcaagcccagccacaattttcagctgcagtgtgtgagatgggtgagaaaataggacagtaagaagctagtgctgtgcaaagattagaggtagagccctccgccaaaggacttaatgacaagttctaacaatgtcacgaatgctttgcgaaaggaacaaccaaattgtaatagagcaactcataaatgaagtgaataattatgtcttcctcttctaaataacctcttaaaagaggctaatacacacacacacacacacacacacacacacacacacacacacacaccacataccactcctgacaacttagtgatgaatcagtagtctctaaatgaaaatattggccgggcacagtggctcacgcctataatctcagcacttgggaggccgaggcaggtagatcacttgaggtcaggttttcaagaccagcctggccaacatggtgaaaccctgtctcactaaaaatacaaaaattaactgagtgtggtggtatgtacctgtagtcccagctgcttgggaggccaaggcaggagaattgcttgaacccaggaggcagaggttgcagtgagccaagatggtgccactgcactccagcctgggcaaccgagtgagactctgtctctaaataaatacataaataaatgcaaaaattagttgcagatgtaaattagtttctgttatgcagtgaaaggaaatggtacagaattataaggtggaaataataggctaacaaatcacttatagatggataaacgtaatttatgatctctcagctcagcatctctgtgttacacaactccagggggcaccattaaataggctgggtgcttggaacactttggaattatctaatgggattttccctgttgagaaaaaactgaggaacaattatacaggctttgggctctagatgtctcctataccatgaggcagtttgttatgctgttcttcagaagccacctgaaaaggaaagcctagcaaacatttgactggagagtctagtgatcgtcttctccaggcatttcccatctctgcttcttggctgcttttgtttcccagttctgccacccttactgcattaactggtgtcttcacctgccttctgccttctcccttgctaccactgcctacaccaaagtcagagaattggagaatctcaagcgattatagtctggcctctaagtgacctcagctcttttgggctcccttacccaaaggaattttcagtttttgccaatttcctcaggccatttcagtttttgccaatttcctcaggctaggctggagtgtactctgtatcttacaaaagcaattctctctcagtccctgcccacgaatatagagctaaacataataaaagtccaacttgacatatatgagtattaagaacttattatggtagtcatttttctaatctcctgaatgcattaattcattttacctgtatgacaaccctgtaatgtagttgccataactatccctatttttacagatgagtgagcttgacaccacaccattaagtaacatataaagttccccagataatagggtagagctcggatttgaacccaggcagtccagcttcacagtctgtgctgttaaacatctgcaggtgctaagaatcttacctcccagggagtaaattcttcctcctgtaggggtatatgccacctccctcaaatgctgccccttttctcaataagatccagttggtctcgtctttctactcccttttagtatcagaggatcatttttggccttccaaaacatgactgccaaagacaaagtcctctgggagactgggggatagggtcatgcaaatcacacttttggtgttctttatcttgatttctttccctgagaaaatgatcaagatatttccatatcgataataacagaacttccctcaccaccacccccacttttaacaccaagagtccactcttttaaagtgaaataatcctaattaatctgaatttactaaataaattgggaggaagggtgtttgttaataaaacgacttcattccgtttgagttgctgagtacaactaaagtggaaattagttttcacgtcctcacaacatgcacaacttcataagaatatatttgtgcctatatagcactttagttttataaaaatgtgcagagataagaaatcaggcttcaataattaactttcttaagtaggagacaagtgaatttggctaactttgacaaaccaagtggcatactagatacagaaaaattcttttaaaaaatgagaatacctcggtgatgaaataatctgtataacaaacccccatgacacaagtttacctgtgtaacaaacctgcacatgtaccccgaacttaaaagttaaaaaaagacttaatggtttccatataaattttaacattgttcatgtcttcatgtaacaaatttttattgagtttctactgtgtgcttggtagtggagacacagccctgaatgagagagagagatgttttctgtccatgggtatttaaagtctagtgggaaagacaaacagtgaaataaataattatgataatatttgatgtgaattgatggtgggtggaggatggctgatggaagccttgagtaggggatctaaccaaggtagaagagaaagcattctggaagatttgacatttatgcagagacttgaagaatgtggagggccagcctggggatgagtgaaggacaagcattccaagtagaagcaatagcatatgtgaaaaatgagaggtgagaaagaatctaatatattcatgtaactgaaacatcatctagaaatagatttcattttgctgatgaggacactcaaacctaaaatggtgaggaaaactgctcaatggtgctgggtatagaatgcaggtcatctgatttcaagagctgccctcctgccattacctccatggccttccagagaccaggcagaccttggggcaggattgttgcttgctcataaggcacctttgcatgagttagaaatataatgtatttctatattgttataaacattttgggccgggtgcagtagctcatgcctataatcccagcactttgggaggccgaggcaggcggatcacgaggttaagagatcgagaccatcctggccaacatggtgaaaccccgtttctactaaaaatacaaaaatatttttggggggcgttgtggcacgtacctgttgtcccagctactcaggaggctgaggcaggagaactgcttgaacccaggaggcagaggttgcagtgagccaagatcgcaccactgcactccagcctggtgacagagtgagattccatctcaaaaaacaaacaaatgaacaaacaaaaaatatataaacattttgttagaaaaagtctgccagaattatgtcaataaatgcataaatcgacagtgtcagccatcttaatggtgttccattagatgtacaacatgcataaacatattggctgttgagaattcaggccaatcaaacctaaattagtaatctttcaatcatcttttgggtaagactctatagccatctcactcctatggctttttaatggttcctgatgagctgtccagagtagaaccattgaccttgacctcctctcaggtgtttgtgttctcttggctcctgatttatgacccattgcctgctgtgaccttcaacattcctgtctattctcctgcctgcttgcctcctggtttctaatttataactttccatgatcaggtttcttttcttaatcagaaataaatagaaccatcaaattataaaatttgacgtttaattttaaattttacctctttattgggtttctctccctctcctatttagtcttatttttgttgttgttgttgttttatccttgttgttagctgtaatccttggagccttgtttgtttgggaaggtaatttgagtctcttctataaagagcaagctggagaaaagaatggaagctgtgcttggtttagaagagattttctcaagtgtgttacacactgggaaatactagttttacatgatgtgcatagatgtgcaacaaagagagaagattcattagttaaataatcttgggcaactgtgggatgaaaaagggcaaccacttttctacaccgcggagacttcagagactttatatgctaatgtgcttgtgagtatgcaactgtatgcagcacttgtaagatttagttgatcatataaataatgaggttgttgtgctccgtggaatactcttgcctcctaagctaaatgctctaaccaggccatagagagcctttgttcaaaagagggagacagtagtagcccatttgttgacacccaaggagacatcacaaagggagagttcattctgggtaggctgtccatatctcaggcggtgtttagtggcaaagcagggaggggccaggaaaggccagagtagaagcctgcccagggaaaaagaagtcatgaagtctgatgatcacagcttctcttagctgtgtagggcagggctccaactgcactaagaaatttgagtgcccatctggaaatgggctgagagatcttggttgggtataggtgtggtatccctaataaatgccttaaggtcatggtaaaaaaccctgacttcagcatcagatatatttttttctatttcacatcccactttgaggggccattttgaaacacattacacattgtttcacacaaatggttatacacacacacacacacacacacacacagttctgatactttttaacttggcactctatctgtaaaatcattctatatagagctacctcatttaaaaaataactgcacataattctattgtataggtgtgctataatttacttactagtcccatatcagtgggcatgtatgtggtttgctgtattgaaatgatgcaacaaatattgaacacattacttcacacacaagaatatttctgcaggataaatattttaggaatggaatatctgactcaaaaataatcatttttaattttgatagatatttccaagttaccctccatagagattgaagcaatttatgcacactcccattatgtatgagagttcattcttcattttagttatgtttttgtttgacctacacagtgctgttaaaaacctgaattttcaaaaacgagagcgtattcattttctagaactaccataccaaaatgccacagactgggtagctcaaacaacagaaatttattttctcacagttctgggggccagaggtgtgaaatcaaggtgtcggcagggttggtttcttctgattcctctgtctttggcttgcagatggccacctactcgctgtgtcctcacatggtcttttgtctgtatgcatacatccttggtgtgtctctttgtgtcccaaaaattctcttataaggacaccagtcagattggaatagagccctccctaccagcctcattttaccttaattacctctttaaaggccctatctccaaatacagtcatattctaagatactggggttaggatttcaacatatgaatttaggggagacataattcagaccataacaaggatatttaaattaaaagttcagaaattttttgttttcgtgaaaaacttgacattggccctacaaaccgacgggaatcaatgagctggagtgaacactgacgccatactttaggtgccatttatctttatgtatatataaatgcatgtgtgtgtattcacacatatatacacatataaatatatgtatttattcacatataagagaattaagagggaagtgtggtacagatgcatatatatatatacacacatatatatgaaaattaagagaagagtgaaacatttcttccccacagtgaagagggaaatattgcagacatattagatacagtgctcaaacagctttttgcccagtaccccaacatataggaagcactcaataaaaatacacatataatgtttagagtcaggattaattgggcttgggctagaatcaactcacctcttgggatcctttagtatctacaaatgaatggatttggggacttgacggctaacattcaatacatgttcttaaatcaaacgtgtaaaatctaattttacaaatgattcttaatctctaaaatcttttagttaaacatgcatatatttaaaattgtttaattttacaatcttgatttaagattaacatcctgtccacaaagacataaagaaccagcaaaagagcttcagatatgtataatggaatgtaagagtttcaatgcaaatgccttaggtctaattttttgcattcctctaaaatatcacagagagccaggatttttttccctcagatctttatttacactgtatagattccaagggccaggcagtgacggtcaaggtgagcaagggaccctggactcttgtttgtctcacagcataccgtaaggcaagtcgagcagccttagctttacttttccttaccctaagcagaaagatctggacttaatgtattaattttagtgggggaagtgaggaaacagcaacttagaagcatcaattgaggatcagctaagttgtaagagcagtaatttccctccccctacccataacaccatcacgtgctatagtggatctggcctgtcaaaggtttgtgagctaaagttaaggctctgcagtatttgcatggccccagggacacagtgaacatcttattgttactgctgaaacctggtgttaggatttttagcaacaggaaagcagacccactgggtgttctgagagaataatggtttactcttatactgtaacttgtgccataactgtttgagtaagaaaagaatgccaagtggcaacccccaaaagtgtttctctggctgctctgcctccactgctcaagttgtccctccatagtcttggggatatccagggaatgtgcccatggtactctatgtgtcctccccatgctgtgggaatgcacaccacctgatatggtttggttctgtgtccccactcaaatctcatgttgaattgtaattcctgatgttggaagtggggcctggtggaagttaattggatcacgggggtggtttctaatggcttagcaccgtcccccctagttttgtctcatgatagagttctcacgagatttggttgtttgaaagtgcgtagcatctccccttttactctctctctttcctgctgccatgtgaagacctgcttgcttcccctttgccctttcaccatgattgtaatttttctgaggcctccccagctgtgcctcctgtacagcctgtggaactgtgagtcaattaaacctcttttcttcataaattatctagtctcaggtagttctttacagcagtgtgaaaacggactaatataccacctctttcttcccctcctgtgagtctctgtggggagaaatttgattacttccatctgcaatggaagggaatacttccactgcagatgtctctcaacagcattgctgctacagttgcaaccaatgcgttctgtcaaggtgaatagaggtggatagaggccaccatatcaccaactttgttgtcagaataaagtgggcagccctcataagcaaagtctccaccaatgccagcttctccctcatagttataaatccaataatatttgtgctttcagtggcccttagaaattttgcagaaacaattttggttcttaataggtattttttaatgtttccttgtccagagattcagggtgaattcatgatgaggcttatgctgtgcttagaatgacccctttctttcaaaggttacctgttgtccttgaaacactcttttcctgttgactttttattcttccaggataagttattttctatgaggctctttagtctcttatgtgcataggttcctggtgagatcaccctactgtatcttcatgagtcacaaggtgaaaaaagttacacctcaagcccttgcctgagtatgtgatcactgatggatgggaaatttcagttcttagaaggaggtgggatagaaagaaaaaattacaaaaggaaggaagatcaaggagctctgaaaaagtcgggctgtggggaaaagatctaaccatccacttccttgctctatctctgtaatgttcattccagaggttacctagagcaagaaaatggaagagaagtgctctttgtgaagtgcctattacttgccaatcactggtgagaagttcttcatgttcaatatcttctttagtcttagcaaattcctatggagcaatgttaggatcccagtcttacagatgaaaaaattaagactgggaaacatcaagtaattgctggaatcttgattctgactttgaaacttccgacgtttcggcaacacaattctgacttctcatttgttcatcaacttgagttagaagtccttctgaagcccagagatgtcctgcgtctgactctgtccaactgtgtccctcttagccatgtaatctggctgctcctgcatcaccaagctgacctttagggttggcttcttttagtccagggtttctcagccacagtactagtgacatttggaggcacataattcttggctgtggcggctgccctgttcattttaggatgttaacagtatccctggcctctattcactagaagtcagtagcatcctcccttaccctgagtagtgacaactagaaatgtctccagacattgctcaaggttgcccagggatcagaattgcccctggctgaaaaccacagattacgggatcccagtcctaaggcatctcctcttaagaaggctccacttgtctggtcatctccatgaatacttcgtcattaccttctatagccacattcaacagaccagcacctgacttttttcagagaggatgcagagacccatgtacaaagtgagcggagttgagcaggccacctgggctctagacagagcctgggtgaaaatggtggccctgaggatggatgggaggagtttataggcaggtctggttgatgcccctgtgctctttttcctgcttccttcggagtgggaacgatggttagagtgggaagtatctgaggccccgccaatacctgcaactctctaattcccatcctcgatagattttaactttttgtctcaggttgctgtgtctcccctgttctggtttcctgtctccctcatcttttctctgctttccactccttccttggagagtttgggcatcccaagcaaaaggagagactcactgggatgagatgaattatctttatcaaaggaagcattacactctttttgttggcttcactatctcccagtgacaccaagtctcttagctcagcaaactactaagcaacactttgccaactgtgattagatgcatcacggcacacatggatgcatatgtgtttaacacaaacacagataaagatacttttgctctaactaaaatggtatatttttgttcctctactctgttgtcttatctagacacctcttaatatgggacagcttcataagtcaccttatctttgatcaggtcctcaccgaactctgcagatagcacccctgtgtccgcttggctgtctttaaagaacactagagaagaatgacccagtcctgatgactggacttggtagaggacagatggaagggcatttgaatgctcattggttggcccaaagaaaatagatggccaatgttttatggaacaggcacgaagcagttggtgcttcttgccatctcttcctccaagagaactcctggtttgctggtttggaatagtgatgatcttagtgcatttgcattgttatcaatgatagtttcatttgttttattttttaactaaaagtacaattacttaaacattgatggtcaaatgcacatgttatggtcacaggcttacgtgcatgatatgcatgatacataactgctaggaaagaacggaacatatgcagataggtaaccatgttagtgatgaattaaagggctatttccttgttatgttgtgttataacaacttatgataaatattgacattattgggttcattttagtgtgacttggtgttgctttagcataaataggtttaatttgggcatcggaaatgtataaaaactttgccatttgatattaatggtgattttgttctttacttatgaaaatttacattaggaaaggttcttttcagaaggtagtgactctcaaaaggtaggaagaagactgtgtatggtgtatgagtgtatgtgttcagatttagaaacagacgtggatttttaaaaacttaaaaatatatatgtttatataaaatacaatatatattttaaaattaactaatgtcgttacatttttgtatttgaaatctagaaggtatagactcagtgaaaaatgtttcatactttgaatatattaacttagcagtaagataatgatgattttataaaacaaaaatttatcaacaaagaattcatgttctagatgagggggattaaagacaggatggttaatgggtacaaaaatacagttacatagaaggaataagatctagtgttcagtagcacaatagggtgctaatagttaacaataacttactgtatatttcaaaataactaaaagaatggaattggatattcctaacacaaattcttgagatgatggctatcccaattactctgatctgattgttatacattatatgcttgtatcaaaactattacatgtatggttatacatgtaacaatttatggggtacaggtaccccataaatatgtacaactattatgtatccataattttttaaaagtaaataaaaaataattcatgttataaatagtattttagtttctgattttatgctatatttttagtccttgttctaacttgtaattttgcaacagattatgactcccaatgaattcgcttggaaaggctgtttttctatagtaggaaacacaatgtccttaatatcagattatcattattttacctaaatttattctttctttgcaactaattatttcaatccagtgactctggggacattctacaggtagccagtatacattgtttcccttgcaagagacatattttctatcttttcgctttttgtttttgacaaacgtagttttaaatgcctgcaaaaacttgcagcccctccttctcaaatggcattgctgttttgtggttattatcttatgttgccttaaaacttctaaacatggtagaaataaagcattgttgtcccacgtgagcctaagaacatcaactttgaggaggtaatgccaaccccctttcatccaatgtcaagtgtcagctcgatgaaacaatttcatggtatttgacttagtgaaaatttctgatctttgacaaacctgagaaaaacaagaaatggggaaaggattccctatttaataaatggtgctgggaaaactggctagccatatgtagaaagctgaaactggatcccttccttacaccttatacaaaaatcaattcaagctggattaaagacttaaacgttagacctaaaaccataaaaaccctagaagaaaacctaggcaataccattcaggacataggcatgggcaaggacttcatgtctaaaacaccaaaagcaacggcaacaaaagacaaaattgacaaatgggatctaattaaactaaagagcttctgtacagcaaaagaaactaccatcagagtgaacaggcaacctacaaaatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagacgtttatgaagccaaaaaacacatgaaaaaatgctcatcatcactggccatcagagaaatgcaaatcaaaaccacagtgagataccatctcacaccagttacaatggcgatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccctcccattactgggtatatacccaaaggactataaatcatgctgctataaagacacatgcacacgtatgtttattgcggcactattcccaatagcaaagacttggaaccaacccaaatgtccaacaatgatagactggattaagaaaatgtggcacatatacagcatggaatactatgcagccataaaaaatgatgagttcatgtcctttgtagggacatggatgaaattggaaatcatcattctcagtaaactatcgcaagaacaaaaaaccaaacaccgcatattctcattcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacttatgtaactaacctgcacaatgtgcacatgtaccctaaaacttaaagtataataataaaagaaaaaaaaaagaaaatttcaggggctgtcgccctgggcctctgggattctcatcacacagtaagtctagttgactgaagcatgaggaagaaagatattgccaaatgtgtctcaatcactgatgtaatttgcagttcacatcttttcagtgaaataacatagagtatatgtggctagctgaaacttattttaagtcacaactggaaaagtaaatgaaagagaagagagaacctcataaattaattgagtggcactttagaagcaggtgcaaccaggctcttgaaagcatacatctcaaccctggaagtctgcattccagctctcaatccttgcaggacagctttattggctttgaggtttatgatttatgacttgccattcatggagtctttataaaatttcagcggagaatattctgaccaatgccatgattaaaggacaaaggtttaaacaagttgaccaaggtcaaaaagggggttaattctgaagttggcattagatgtctggcctagtttccatcttctcagtcacaattagcgtgaatggccataagatccagtattttcagcaaagtccaggttaaacagtccctatataaatattgatcatgcccctttcactcagaaagtctcccagtttcatgaaaaattctatattcaccttactgtcaggtgttctatgtcttcatctgccttaatatattttcctgattaattatttaaaaggtttatctattttccctttgtgtaaaataaatgggagaagattattgtgtccttcaagtctttatagcaatataaaaaattcaatttgattattaatattttccatttttagtattagaattttattctgagttatatacccaagataaacaagtgcatatatccacacaaagactagtacaccccattttctttgcatttttattcataatagtccatatagacacatacatatacacaggcacaaatatccatcaacaggagtctgtgttttatttggatggaggaatactacatagcaacaaaaaagaacaaaccattggcacataaaactgaatgaatgaaccttagaaactcaacatgtttctcatgttcttcaacatgtgcctcaaaaggcacaaagagtacatactgtacaatttaatttatgggataaaaaaacagacaaagctattctttcattggtagaaatcacaatattgcttgcccgggaggtaagggtggatactaactagatggaaacaggagaagctttctataatgaaaatgttctatatcttcatctgggaagcagttccatgaatatatacatatgcaaaaatttatagagctttacagtttagatttgaacaatttattgtgtgtaaattatatctcaagctgtaaaaggccagagaagaaattatgtaagaaccacatctattatatatttctattaaatttctacagcatgtttataacgacatctattagatatttctattaaatttctacaacatgtttattactgacatattcagagaagtaacacaggctatgaataaaataatactataactcattttcattaagaatgggtatttatactaggtgatgggttgataggtgcagcaaactaccatggcacacatttacctatgtaacaaacctgcatatcctgcacatgtaccccggaacttaaaataaaaacaaaaataaaaattgaaaaaaggcattattcacaatagcaaagacttggaaccaacccaagtgtccaacaatgatagactggattaagaaaatgtggcacatatacaccatggaatactatgcagccataaaaaatgacgagttcatgtcctttgtagggacatggatgaaattgaaaatcatcattctcagtaaactatcgcaagaacaaaaaaccaaacaccgcatattctcactcataggtgggaactgaacaatgagatcacatggacacaggaaggggaatatcacactctggggactgttgtggggtggggggaggggggagggatagcatcgggagatatacctaatgctagatgacgagttagtgggtgcagcacaccagcatggcacatgtatacatatgtaactaacctgcacaatgtgcacatgtaccctaaaacttaaagtataattaaaaaaaaaagaatgggtatttatcattgtatagtattaacttgctccagtgtaaccacattccaatttacttcgatgtatctgcactcaaaatagcaagaacaaattgattctcatgggtctacttgtcttacctctcccttccctttcttcaccatcattgagtcctgactaactcttatcaaagttctgtggttttgggtgaaaatgctgaacaaatgaagttcagtcagagacaaggccgtgttggaaggtttgattgccaggtcctggagacctgagaggtttatgctgagtgcaggcattaggaggtcagagctgaggataccaggcattcttctctcattccttccccctctctaaactcctgtctagggaagggagatgaagagggagagaatttgaggttggaagtgtaccaattggcgctttctgaaatttgctgcagaataatattataattacaaacaggcaggctctgttttcatggcaacaaaaacaaactttaaggcaaaagtgtggtgggagtgaggaaaggcatatggttgattaaaacaactttcctttttttccaccaaaacatttaattggctttagagtcaaggaaggttcatagtcaaagatgccagtaagttcctttgtatcccacttttcatctctgctttgctcctattttgtgtcaaggtttatgtaagtgctaaagggtttagaccaatgatcctcaatttgaggtgattttgtacccccaccccaggagacttctggcaatttctggagacatttttggttgtcacaatttaggggtggggtgctactggcatctagtaggtagaagccagggatgctgctaagcaccttgcaaggcacaggttgatactcacctacaaaaattatctgaccctaaaagtcaatagtggtaaggttgagaaaccctggtttggactaaaccctatgtctaggactaagagggaaggcagaatgtgttaggatttagaatcctatcgtagaactaatatcttagaaatcttttcatttcacaattctgttacatgtgaaaatatctatatccaagggctgggatggacccaaccctcacagcatttctcagtgactttgtggggcattaagacaagtagagccacaagagtcaatttgtttttgctattttgatttaagatacatcaaagcaaattggaatgtggttataatggagcaagttaatactatataatgataaaatataatcttcttgaggaaaaggacaaagataaatgaaaagatcattggatgagtcatcagaaaaccaggatcctaggcctgaactgtcatagatctgtgattttatgacactggttgcttgggtactctttcttagcctgactttcctcatttatgaaatgaaaagctgaagtagattacttttctttaaatctcttttaacacaaatattcaacgatttcatgggaaccaacatactcttcactaaaaaaaaaatggcagcattagttctggaatatttcagacaataaaatgactagaggaatgtaaaaattgttatacagattactctaaaaaaactcttattatgcctgtcacatagaagaagtttctttgtctctataacatgaagatatgtctttctaaattgtcagttaaactgtttggcaaaatgtgttccaggtaaagataaataactgtgcagagctgtttaacatttgttcctaatgttaacttttaaactctgctaagaaaaataattctgttcagaaatttgatctgtctgccttccttttatattgcttttggctcttccagaacttcagaaatgtcaatttgttattcatgttggccttcgctaatccttccaaagaatgtgaaaatgcccacagtcttttatattaggaaataactgagattaaaacagattaaatctaagcttctttctttggctctgttctgatgtaatgagtgttactgcagcatttacaaaggcagtggggttttttacactaaaccataatttatttgtatgagcattcagtagggccattgatacagttaagcctggtgacttttcacaacttaaatgccaagatcctggggtgctgctctgaagtgttgggcaaggtggtagtaggggaggagttagagagacataagtgtgtgtcatgccaaagtcatggaaggggaagagggggatggacagactgagggttgtggacttgcagaaccagtgggggaacatggcagggtagccagctcacgtactaatgaattggaaatcgaattgtataggtgagtatcttctagatagcatctattctgatcaccaagaataatataatgttctctttttcatgcaagacgctataggactcacatcagaaagagggcgtctttattttccagtagttatacaaagaatatgatgttctatccacaacccttcatataaactgacttaggatgagacactgtgacacagggagctaaccaactcacaggggctgaaatgcacatggctttgggcttcagttctacccctaaaatggtatggcagaggctttgaagagagtgaatgcattatacttgttagttattactcagctacattctctccaacccaaagctgaaagaaagctggaactaaattcacttaagggtctgagaaaagctttctgtttttaagagactggataagaagaatccctcccagaaatctgaagtctattattgtttcctgtagttgcacttgcccaaaggaagttctcgtttgattgactctgtctgctgctccatagcgactttccagctctcaggcctgatccaaggagccacagagcatgcccatcaagagctatgtgggaccatgggggcgggcctgggttttatgtgaagtaatggcttttcaagcctggcatgacagttcgcagtccagcatggcaaccagcagcccagcatgaaggaggcagacagttgaacagattatttttatggcttacttaaagaaatagttttgatgtcaaatccattttggtttcaaatgggaaaatcagagttaacctctctatactattcagaaaaaatcagctgaaaagtgcagaaaccaaattggtttaccaactggtggtcatcatgccgagagcattataaccaatgctctcctctttgcagtcccttcaccccagttgactaattgtttagatccaattaactttcatttgttgtatgttgcataaactggactttacaactaggtataagaagaacaaggagggaagaagagtatcttctttgtattaaattatgtctcgtttttcacaagatagttcatatctccctttaaatgtcatatatgatatatgcctctttaaatgttgtgattgcttgaaattgtgaaaaaaattaaaatttttattgaaatgctaattatttcagaggataatttttagcacaatgatattttttatcctgcctggtggtggttttgtcagcataaccacattctccatctttttctgtcttaaaaaggcaatagaacaaacaaaaataaacagaaattaaaaaaaaaaaagcatctgttccgattccttcaagccttgaactcttctccaaaattcactgttcacttaaagcttatattttggaggtcacccataatatcctagtatgaaagtcatggtgtttccttcgtgctcattcaacactcctgctccatagcattcaaccttgctgaccaagtcttccttagaattgtctccctccttatttttgtgacactctgttatccttatcttcctatttctctgatcacttggtttttgcctctactttttggtctctctttctgttactttaatatagtttaatatagacatttgtcaaacctctttctctccctatccctctccctctctcacaacaatcctgtactaacatggctttcattaattgtcctaaatggagaactccatatctttattcattactgacccacctctctagatccatctaaaccagaatttttcaaacttggcactattgtcatttggaagctggacaattatctgtagaaggggctgtcctgtgcgttgtatgaagttcagcagcacccctggcctctacgcactagattgactagcacacccccagttgtgacagtcaaaaacacctccagtcattgccaaatgtgccctaggaggcaaaatctcccctggttgagaactactgaaataaatattgacagcagtgggtagcaagaggtggatacaggtcttagaagaggagagatgatgttaaaaataagtagattttacccaacagctagattaattcgtagagtttttctccatggtcaagtgggcttcatccctgggatgcaaggctggttcaatatacgcaaatcaataaatgtaatccagcatataaacagaaccaacgacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctctgaaaactggcacaagacagggatgccctctctcaccactcctattcaacatagtgttggaagttctggccacggcaattaggcaggagaaggaaataaagggtattcagttaggaaaagaggaaacaaaattgtccctgtttgcagatgacatgattatatatctagaaaaccccattgtctcagcccaaaatccccttaagctgataagcaacttcagcaaagtctcaggatacaaaatcaatgtacaaaaatcagaagcattcttatacaccaataacagacaaacagccaaatcatgagtgaactcccattcacaattgcttcaaagaaaataaaatacctaggaatccaacttacaagggacatgaaggacctcttcaaggagaactacaaaccactgctcaatgaaataaaagaggatacaaacaaatggaagaacattccatgctcatgggtaggaagaatcagtatcatgaaaatggccatactgcccaaggtaatttatagattcaatgccatcaccatcaagctaccaatgactttcttcacagaattggaaaaaaaaaactactttaaagttcatatagaaccaaaaaagagcccgcatggccaagtcaatcctaagccaaaagaacaaagctggaggcatcacgctacctgacttcaaactatactacaaggctacagtaaccaaaacagcatggtactggtaccaaaacagaaatatagatcaatggaacagaacagagccctcagaaataacaccgcatatctacaactatctgatctttgacaaacctgagaaaaacatgaaatggggaaaggattccccatttaataaatggtgctgggaaaactggctagccatatgtggaaagctgaaactggatcccttccttacaccttatacaaaaattaattcaagctggattaaagacttaaacgttagacctaaaaccataaaaacgctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttacaatggcgatcattcaaaagtcaggaaacaacaggtgctggagaggatgtggagaaataggaacacttacactgttggtgggactgtaaactagttcaaccattgtggaagtcagtgtggcgattcctcagggatctagaactagaaataccatttgacccagccctcccattactgggtatatacccaaaggactataaatcatgctgctataaagacacatgcacacgtatgtttattgcggcactattcccaatagcaaggacttggaaccaacccaaatgtccaacaatgatagactggattaagaaaatgtggcccatatgcaccatggaatactacgcagccataaaaaacaatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagaggggagggatagctttaggagatatacctaatgctaaatgacaagttaatgggtgcagcacaccagcatggcacatgtatacatatgtaactaacctgtacattgtgcacatgtaccctaaaacttaaagtataataataataaaataaaataaaataaattaattaagcttttccaacaaattaggtaggaaaaatatttctgctttttctcatagaatgtagtcaattttgaactgtttttgttttcacacaaagtacttagccatatagagctaaatgataataagagaaatggtgttcttagaactttcatcttaattctgtattaaagaccacttatttgaccattttccccatgtaataacattaaactcctttagaaaagctctggaacatacccaataccaaaaggaaaaactgtatggttaaaggttagataaagtgcagagttaacctttagacatttcaaatagacaaggcaaacattctcctttaagccaagtgtctgtctctttagagtctatcaatttaatttttatcagttgtaaccaacttcttttttttattattgtactttaagttttagggtacatgtgcataatgtgcaggctagtcacatatgcatacatgtgccatgttggtgtgctgcacccattaactcgtcatttaacattaggtatatctcccaatgctatccctcccccctccccccaccccacaacaaaaccaaacaccgcatgttctcactcataggtgggaattgaacaatgagaacacatggacacaggaaggggaacatcacacaccggggcatgttgttaatcaacttcttaagaatgaaagaaaccatgtttatatcctggaattttagtattaagggaaggctctagatttaggagacagagaacattgggttaataagcctgccattcaagttttactagaaagatttgcttccctggagatttttgtcaaaattacaattttcagactaaaattatcaagcgtaggtgcgcaaaacaaaatttaaaaactatcatgaccttttgactggataagttatgtcactaggaaactagccttactctcaattatgttagcatagtctgtttggttttccactagctttcaatctttatttataataagaagacaaataatacagctaggtgcgtattagtttcctattgctgctgcaacatattaccacaaatatagcaacttaaaacaacacaaaatctcactgctctgtaagtcagaagtcgagttggcttggctgatttctctgctcaggggctcacaaggctgaaatcaatgtgtcagccaactaggctctcctcaggagactctgagaaaaatccacttccaagttctttggcgttgttagccaattcaattccttgcggttgtaggcttgaggtccccgtttccttgctggctgtcagtcagaccactctgctcccagcagctgcctacattctttctcttgctttcccctggcccctgccgacagtggtgggttgagcccctcttacccttggaatctcttcagtttccccttccatcattgctataaactgaacatttgtgtacctccaaaattcatatatttaaacttaataccaatgtgatggtatttgaaggtggggactttgagaagtgattaggtcatgagggcggagcctcatgaatgggattggtgctcttataaaagagaccccagggagctccctcacccctttcaccatatgaggacagagcgagaaggccctgtctatgaaccagtaagcaggccttcaccagacaccaatcagccagtgccttgatcttagacttcccaaccttcagaattgtgagaaataaatttctattatttataaattacccagtctaaggtatttggttttagcagcccaaacggactaaaatatctttctgtaggttctttatacatatataaaatatatcctagtttactcctttcttttacaaaaacaatatgaaattccatttatataaaaagtacagaataggtaaatccatacagacagaaagtagtggttgcctaagactgagggtggggtgttgtaaggagtaactgctaaaaggtatggggtttacttttagagggataaaaatgttcttaaattagacagtggtgatagttgcacaacatcatgaatgtaccaaaaaccactgaactgtatagtttaaaagggcaagttgtatgatatatgatgtatcttaagaaaaagaaaactaggtctaatccttcctttttctgtgacgtgggcaaatgatttattgaaactggttgaaccccaaatgactctcttctgaaaatgaaggagggtctcccagcaggaatgctggaagggtgaaagttgatgatgtttgtgaagcccctgcacatggtctgccctccgtaaactgggatgtgccaactctttcactcactccccaaatcctagagaggggccccgtaaggatgctaaaggactggttggtacctgcaggggaatgaggagcaccaaggagaagaggcagggactgcccagggtgattagagtctaaccaccctttcctgattgggctcttttttcatgagctggttctggtcttgggaaagccaccttggagtaaaatcaggaatagctgttgggagaaaaaacatgtttatcaaaggtcaagtgtataaaaccttctgaagcaataccatggctaaaatcatgtgttttccttttccttaaattttggcatctcttttctttttagccacttgattgccgagccccatagaagacataatttacaagaaactcatagagactcaaaatgtaaggttctctgaaagaaattgaggtgtagttcttaggtt

SEQ ID NO: 4250 - DNA, 147298 bp, human; identical to SEQ ID NO: 4249

SEQ ID NO: 4251 - DNA, 7348 bp, human
aaggatcaagcatccctgagtttcaaacagaaacttgcactgaatacattcaaaggtatgtggattttatttataatttgatatcctttttattgtgcttatttctttctctgcatttcttttaaaagatataaatgtattctacatttctaatactatatgccatcaatagttactttttagttggcccataattaaattagactctgattactgaaatgatttttaactttataatgcaacaaagtgcttgtctaattccaaaggtctttcttggccacatttcacagtaaaatatttattttaattaattatcgattaaagtaaaaataatacattcacaggctgtgatctactactttgaaaagctttttatttaattacataaaatagaaccatccatgaagtgttttttctcattaacccaaacaaacaaacaaacaaaaaacaaatttaggagttagaaaactttagtgtacttttcatagacagcattatcacatgtaatattcacttcttatacaaaatttaaggtctttcttctgacagttttcccagtaatttgtgccacaaatcaatgtgcacattttaggaggacctgttttgcttaatgtcccaagggtcttatttatagaataattacagtgcaacatcaaacaaaatgaagattccattgaaagaaaatgaaacctcttagggagaaagtattcaaaattcattgaagaatcacataaaattcgtaccatcctctcctgttggttcagccacatcttttgctccacaatctggagctcagagatgttactggagggtcttgcctgaagttctgtagataggaatttctggaactaaaatctatcttggcaaattaatatattttctcaaatgattagtccttgtttttaacagtagcaatgtccaggtagactgtgcacgagacatttctgtgcctccttgttctaaaattataaaatactgtgcactttgatgatcttcccaacctttagagccaactttattcctttaatcattaattataaatacaatttagcttctatgactaagggctgtataggcataggaaaatggcatgcaaagtcatatgaagatagatcattcatgtccctgtaacttgtttagccctcaacctaaattaaatgcatctttatcactactgtgactccagaaacaatgaaataggctgagagctggaaatcacatatgactgaagtaaattcacaaacaatggctccatccttcttactagcaatagactaatgtagattatgtgtgttttatggagcattcattacatccatgtttcagaagagataagaaaagtggatgttgacttacatttcagaaccatcaagaaatggggacctggattttatttgcctgcctcctgggagcagcttttgccatgcctgtgagtaaaacaccccttgcataagtcagtgtccaatttcacaaacttggacataaaaatctgctcatagttggtgaaattagggtttaaaacagtatgagatcagatgtcttcatatgtctctgggttgaagaaacacttcaggagcttgttttaaaaaggtatattctcaaatgccgctaccaaaaattctgatttggtacagctggggcggggcccaggactctgcatttttataagcaccccaggagattctgttggaactgttagcttgtaaatatcaccacccatctctagatggaggaagcttttggaagggacccttgaaaggtctccagagaaagtgcttaaccagctttggacaaatattacagagatgccagttttgtctaaaacccaattcctctcaagattccaaatctcttcctgccctccacatattgctgctcttacccctcagggggtaagatttttgtgttaggaatccactttttgagccacattcctgttctcagaggccccacccctttgggtacatctgatgagtacgtgacttttttgtggttgcccgggatcctgcctacacccaatacatagtgatatattttatattcaaatgtattaaagatcaggacattagacccactctgtctggacacaggtgcataagggcagagaacttagatcacatgcatgccaagcaggctgcatctgctttttggtggaataaagagcagttgatacaaccagaagccagcaagcttgcacccttgcctcctctcttcctctctcacccacaaaaccaagattctgtgctctgacttcctgaaatcctgcattgcagcgattcctagtttcctcaggggtccctgccttacaaattcagcccttttcccactctctaagatggtattgttcaagagggtataggacctgactaaaaccattcacatccagatgagagagaataaaccttcccatgaaatgtgagcatttttaaagaatataatagagccaatcctaaatgaggccaatgtctgagggagattttctgcatgaccgtctctcctccctggaccccaggcacaaccagagttccacaatacaggcaccagacacttgggccccacttttgagaggacagacagtcctgattcagatcatcattcaggtggccttttatttttaacttgaaaatttttctgccataaaaccgttggcagaataataaaaaaagatcggcctaaacgtcataaatcaactctttcattttccatgggatttataatgtttccactttgctccacccatcttgttctggcattcatcaataattcccaccttgtggtttcttttgtggcttcttttgttgtatggaagtgttgtttactttgcatgtcaattatgagaaatccctttgatacttaaaagtacttgaccacctcctgatctacaagggaacattcgtgagacaattctctccttgttgatatttctttattgtgaaagagaaacacacttctctccccattatggggtgagttttatcagcaagtaaactgttgggcaggatagggtaggattcattgaaaacactgggcgtgggggtgggatgctgtccaaagatcactggagaataaatgtgtgctggtttctgcttccaggtctccagccataaggctataaccccaggaacagtcatttagctgttctgaacctctttaaaataaaaggtctcctcttctatacagcacatttgttcaaactaaaaacagacctcaagtatattctgcactatatagatttttttaaagtagcttcagtctcctttaatgtgaacaattgcatactgacttaatctcttcctctctcttctcttccttcactctctcccttcctctctctttctattctcctcccctcctccctgtaaaagctaccacctcatcctgggcaccctggttatatcaacttcagctatgaggtaatttttctctttactaattttgaccattgtttgcgttaacaatgccctgggctctgtaaagaatagtgtgttgattctttatcccagatgtttctcaagtggtcctgattttacagttcctaccaccagcttcccagtttaagctctgatggttggcctcaagcctgtgtcgtcccagcagcctcccgcctggccactctgactcagtctgtcctcctaaatatggccgtaagcttacccatcatgaaccactactcagggaggctccatgatagggcaaaaagtaaactctgaccagcttggttctaacccagctagtaaaatgtaaggattaggtaagatgttatttaaaactctttccagctcaaaaaactcctgattctaagatagtcacactctatgtgtgtctcttgcttgcctctgctgaaatattagtgactaagtggtataggagagactccgcagaacagcggaatgcatgagttttggacgtcgggtttgaggttctcctcaacctcttactaactttgtgattttgggcaaatcatttcctctttctggaaccctggtttcctcatctggagaaaggaaataattataataaccatatttcaaaatattgtttggagagtaatatagttaatgaatatgaaaagtgctttgtcaagtataatatgagcaaggttactgattattttttgtatcgattaaatgccgtattactatatgaagaatcctcaaacctaaggctaaccaagtatatatactgttcagaaaggaataagattcttacttctctcacaggttcaggtaacaatctatgagtttatttacttataaaagctgaagacaaatgttagtaagattttgaggcaagattttctgttgaaccgaaaagattgacacatctgatcagtcaatctgtgtttctaggatgagggacagtgtttgcacctctctttttcccattgtgacatcaaagaaaaaaatgaaattaacatcatgtcatattattatgtcataattttgtgtttgttttgctcttacaatgaaaagaaggaactatggaattaaacagatttactccctgtgtaacctcagtcaagttaatgaatctctttaactccccataaccttatctaaaaagtgagagtaataatacttgcctcctagcatataagaaaagatgaagaatgtgtgtgatggatgtaaacacagtgcctgtcacacaggaagcacccaacaaatttttaccttcttctttcttttgtagaactcacattctcaggctatcaatgttgacaggactgcattagtgagtctatatttcctactgcatcagtgagtttctatattggatgaaagtaaattaaatcaaatgggttctaatatctttttctcttaaggtgcttacccctttgaagtggtaccagagcataaggccaccggtatgtagacattttgttccttattccctgaaaatattaggcatgcattaaaattcccatattaagtgaaatatcatgtctactccacatgcagacattaatgggaaatttagtttgtaaaaaatcatatctgtgtacacagttacaaatttttgcaaaggaaaaatgaataaaatattcctatagccataatggcaaagaaaacactgctgcttctctggttggagtcacctgagccaatggtaaacctgcctctctgtttctcaccagtacccttcctatggttacgagcccatgggtggatggctgcaccaccaaatcatccccgtgctgtcccaacagcaccccccgactcacaccctgcagcctcatcaccacatcccagtggtgccagctcagcagcccgtgatcccccagcaaccaatgatgcccgttcctggccaacactccatgactccaatccaacaccaccagccaaacctccctccgcccgcccagcagccctaccagccccagcctgttcagccacagcctcaccagcccatgcagccccagccacctgtgcaccccatgcagcccctgccgccacagccacctctgcctccgatgttccccatgcagcccctgcctcccatgcttcctgatctgactctggaagcttggccatcaacagacaagaccaagcgggaggaagtggtgagtatattttgaagccactacaatgcaaatcctgtgaaaatggtgcagcaaaataggccccagagttctaaggtctccgacaaccaaggatctagagttgtagtagttacaggtctatgattctattagtccaagcaatatgctatacctttatgttaaagacaaattcctctaaatggcttggtaattaagaccacagtttttatggtaggtttcaattttactattactgaatttctaccagaatatgtattaccaaaacccattaatagaaatatatattactaaaccccatgaattttaagggcaacagtataagggaatatcagttctccttatatttcaaaggtttgactagcaagaataggctagagttgcactgaaggcttaagacaagagggagcggataattttgagagtgcaaatatctgaacaggctacaaaaggtagacgggaaatctcttcaaaaacctacaggaagattccccatttccagtagttttcaatctaacttggaggcggctaaactaaacatactgttagattccttttctgtactggggttctatagatgattaagcttttagcaagaagttactgcaatttagcactaaatcttccattacaggtagctcttacaaatgaatgggaatagtcaacaaaacaaacttaatctacatccataaagtcttacttctatgtatacgagattatgtgatcctatcatgtatatgtatccaactgtaattccaatttatacatgttattgatgatttgctactgagaagaagagagaagtgaggtggaaatgaccaggataagaagccaggacacaaaggttccaattctggctttgccctcaaagacgaggcagtattgtaaaagttacttcaaatgtatcggtgttttattttcttttaaatgggggaaaatgacgaaatcagattattttcaagtctctgtccaattataaataccatagtttctgaatttaaaaaaatcataatatatgtcataaatggcttcataattgtgagcatgtttacggaaaatatggggcagaattttttgaaaattgattgaatcccaagtaatcggtgcctatcattggctattctagtccaaggcacatgttctctctgtacatagaaaatgcatttacttctttatgaataattaataccatgaactttataatgtgctcacatcttgacaaagctatttatggaaaggtgactttgggcagatagtttgaactctttaaaactcagtttctttttgtgtaaaatttgagtataaacattgatagtttcttagagttgttttatggaaaacaaaatagcgtgataagcttggagcctgacatgcaagacgtaccccccaaaaaggtagcaattgttattttattataaaataataggctttaagtgtcctgaaggtggaagcagtcctcatggacacctaatatctaatgacaacgaaataacaaagaaacttcagaaattatagagttcaacttaaatggttgtacattgttttgacaaaactgaagccagacatgttattgtaaatggtactcactaggaacatttgtaaattattttaactgttcttttgcaatttttttcaggattaaaagatcagaagatgagaggggaatgaatacttcagatgctttcaggagtgacacaagaacacaatgatttttgcttataatcactttacttagcaaattctgtaactaaaaaagtaccattagcagacaataaaatgcattaaaaatca

SEQ ID NO: 4252 - DNA, 7348 bp, human; identical to SEQ ID NO: 4251

SEQ ID NO: 4253 - DNA, 7340 bp, human
aaggatcaagcatccctgagtttcaaacagaaacttgcactgaatacattcaaaggtatgtggattttatttataatttgatatcctttttattgtgcttatttctttctctgcatttcttttaaaagatataaatgtattctacatttctaatactatatgccatcaatagttactttttagttggcccataattaaattagactctgattactgaaatgatttttaactttataatgcaacaaagtgcttgtctaattccaaaggtctttcttggccacatttcacagtaaaatatttattttaattaattatcgattaaagtaaaaataatacattcacaggctgtgatctactactttgaaaagctttttatttaattacataaaatagaaccatccatgaagtgttttttctcattaacccaaacaaacaaacaaacaaaaaacaaatttaggagttagaaaactttagtgtacttttcatagacagcattatcacatgtaatattcacttcttatacaaaatttaaggtctttcttctgacagttttcccagtaatttgtgccacaaatcaatgtgcacattttaggaggacctgttttgcttaatgtcccaagggtcttatttatagaataattacagtgcaacatcaaacaaaatgaagattccattgaaagaaaatgaaacctcttagggagaaagtattcaaaattcattgaagaatcacataaaattcgtaccatcctctcctgttggttcagccacatcttttgctccacaatctggagctcagagatgttactggagggtcttgcctgaagttctgtagataggaatttctggaactaaaatctatcttggcaaattaatatattttctcaaatgattagtccttgtttttaacagtagcaatgtccaggtagactgtgcacgagacatttctgtgcctccttgttctaaaattataaaatactgtgcactttgatgatcttcccaacctttagagccaactttattcctttaatcattaattataaatacaatttagcttctatgactaagggctgtataggcataggaaaatggcatgcaaagtcatatgaagatagatcattcatgtccctgtaacttgtttagccctcaacctaaattaaatgcatctttatcactactgtgactccagaaacaatgaaataggctgagagctggaaatcacatatgactgaagtaaattcacaaacaatggctccatccttcttactagcaatagactaatgtagattatgtgtgttttatggagcattcattacatccatgtttcagaagagataagaaaagtggatgttgacttacatttcagaaccatcaagaaatggggacctggattttatttgcctgcctcctgggagcagcttttgccatgcctgtgagtaaaacaccccttgcataagtcagtgtccaatttcacaaacttggacataaaaatctgctcatagttggtgaaattagggtttaaaacagtatgagatcagatgtcttcatatgtctctgggttgaagaaacacttcaggagcttgttttaaaaaggtatattctcaaatgccgctaccaaaaattctgatttggtacagctggggcggggcccaggactctgcatttttataagcaccccaggagattctgttggaactgttagcttgtaaatatcaccacccatctctagatggaggaagcttttggaagggacccttgaaaggtctccagagaaagtgcttaaccagctttggacaaatattacagagatgccagttttgtctaaaacccaattcctctcaagattccaaatctcttcctgccctccacatattgctgctcttacccctcagggggtaagatttttgtgttaggaatccactttttgagccacattcctgttctcagaggccccacccctttgggtacatctgatgagtacgtgacttttttgtggttgcccgggatcctgcctacacccaatacatagtgatatattttatattcaaatgtattaaagatcaggacattagacccactctgtctggacacaggtgcataagggcagagaacttagatcacatgcatgccaagcaggctgcatctgctttttggtggaataaagagcagttgatacaaccagaagccagcaagcttgcacccttgcctcctctcttcctctctcacccacaaaaccaagattctgtgctctgacttcctgaaatcctgcattgcagcgattcctagtttcctcaggggtccctgccttacaaattcagcccttttcccactctctaagatggtattgttcaagagggtataggacctgactaaaaccattcacatccagatgagagagaataaaccttcccatgaaatgtgagcatttttaaagaatataatagagccaatcctaaatgaggccaatgtctgagggagattttctgcatgaccgtctctcctccctggaccccaggcacaaccagagttccacaatacaggcaccagacacttgggccccacttttgagaggacagacagtcctgattcagatcatcattcaggtggccttttatttttaacttgaaaatttttctgccataaaaccgttggcagaataataaaaaaagatcggcctaaacgtcataaatcaactctttcattttccatgggatttataatgtttccactttgctccacccatcttgttctggcattcatcaataattcccaccttgtggtttcttttgtggcttcttttgttgtatggaagtgttgtttactttgcatgtcaattatgagaaatccctttgatacttaaaagtacttgaccacctcctgatctacaagggaacattcgtgagacaattctctccttgttgatatttctttattgtgaaagagaaacacacttctctccccattatggggtgagttttatcagcaagtaaactgttgggcaggatagggtaggattcattgaaaacactgggcgtgggggtgggatgctgtccaaagatcactggagaataaatgtgtgctggtttctgcttccaggtctccagccataaggctataaccccaggaacagtcatttagctgttctgaacctctttaaaataaaaggtctcctcttctatacagcacatttgttcaaactaaaaacagacctcaagtatattctgcactatatagatttttttaaagtagcttcagtctcctttaatgtgaacaattgcatactgacttaatctcttcctctctcttctcttccttcactctctcccttcctctctctttctattctcctcccctcctccctgtaaaagctaccacctcatcctgggcaccctggttatatcaacttcagctatgaggtaatttttctctttactaattttgaccattgtttgcgttaacaatgccctgggctctgtaaagaatagtgtgttgattctttatcccagatgtttctcaagtggtcctgattttacagttcctaccaccagcttcccagtttaagctctgatggttggcctcaagcctgtgtcgtcccagcagcctcccgcctggccactctgactcagtctgtcctcctaaatatggccgtaagcttacccatcatgaaccactactcagggaggctccatgatagggcaaaaagtaaactctgaccagcttggttctaacccagctagtaaaatgtaaggattaggtaagatgttatttaaaactctttccagctcaaaaaactcctgattctaagatagtcacactctatgtgtgtctcttgcttgcctctgctgaaatattagtgactaagtggtataggagagactccgcagaacagcggaatgcatgagttttggacgtcgggtttgaggttctcctcaacctcttactaactttgtgattttgggcaaatcatttcctctttctggaaccctggtttcctcatctggagaaaggaaataattataataaccatatttcaaaatattgtttggagagtaatatagttaatgaatatgaaaagtgctttgtcaagtataatatgagcaaggttactgattattttttgtatcgattaaatgccgtattactatatgaagaatcctcaaacctaaggctaaccaagtatatatactgttcagaaaggaataagattcttacttctctcacaggttcaggtaacaatctatgagtttatttacttataaaagctgaagacaaatgttagtaagattttgaggcaagattttctgttgaaccgaaaagattgacacatctgatcagtcaatctgtgtttctaggatgagggacagtgtttgcacctctctttttcccattgtgacatcaaagaaaaaaatgaaattaacatcatgtcatattattatgtcataattttgtgtttgttttgctcttacaatgaaaagaaggaactatggaattaaacagatttactccctgtgtaacctcagtcaagttaatgaatctctttaactccccataaccttatctaaaaagtgagagtaataatacttgcctcctagcatataagaaaagatgaagaatgtgtgtgatggatgtaaacacagtgcctgtcacacaggaagcacccaacaaatttttaccttcttctttcttttgtagaactcacattctcaggctatcaatgttgacaggactgcattagtgagtctatatttcctactgcatcagtgagtttctatattggatgaaagtaaattaaatcaaatgggttctaatatctttttctcttaaggtgcttacccctttgaagtggtaccagagcataaggccaccggtatgtagacattttgttccttattccctgaaaatattaggcatgcattaaaattcccatattaagtgaaatatcatgtctactccacatgcagacattaatgggaaatttagtttgtaaaaaatcatatctgtgtacacagttacaaatttttgcaaaggaaaaatgaataaaatattcctatagccataatggcaaagaaaacactgctgcttctctggttggagtcacctgagccaatggtaaacctgcctctctgtttctcaccagtacccttcctatggttacgagcccatgggtggatggctgcaccaccaaatcatccccgtgctgtcccaacagcaccccccgactcacaccctgcagcctcatcaccacatcccagtggtgccagctcagcagcccgtgatcccccagcaaccaatgatgcccgttcctggccaacactccatgactccaatccaacaccaccagccaaacctccctccgcccgcccagcagccctaccagccccagcctgttcagccacagcctcaccagcccatgcagccccagccacctgtgcaccccatgcagcccctgccgccacagccacctctgcctccgatgttccccatgcagcccctgcctcccatgcttcctgatctgactctggaagcttggccatcaacagacaagaccaagcgggaggaagtggtgagtatattttgaagccactacaatgcaaatcctgtgaaaatggtgcagcaaaataggccccagagttctaaggtctccgacaaccaaggatctagagttgtagtagttacaggtctatgattctattagtccaagcaatatgctatacctttatgttaaagacaaattcctctaaatggcttggtaattaagaccacagtttttatggtaggtttcaattttactattactgaatttctaccagaatatgtattaccaaaacccattaatagaaatatatattactaaaccccatgaattttaagggcaacagtataagggaatatcagttctccttatatttcaaaggtttgactagcaagaataggctagagttgcactgaaggcttaagacaagagggagcggataattttgagagtgcaaatatctgaacaggctacaaaaggtagacgggaaatctcttcaaaaacctacaggaagattccccatttccagtagttttcaatctaacttggaggcggctaaactaaacatactgttagattccttttctgtactggggttctatagatgattaagcttttagcaagaagttactgcaatttagcactaaatcttccattacaggtagctcttacaaatgaatgggaatagtcaacaaaacaaacttaatctacatccataaagtcttacttctatgtatacgagattatgtgatcctatcatgtatatgtatccaactgtaattccaatttatacatgttattgatgatttgctactgagaagaagagagaagtgaggtggaaatgaccaggataagaagccaggacacaaaggttccaattctggctttgccctcaaagacgaggcagtattgtaaaagttacttcaaatgtatcggtgttttattttcttttaaatgggggaaaatgacgaaatcagattattttcaagtctctgtccaattataaataccatagtttctgaatttaaaaaaatcataatatatgtcataaatggcttcataattgtgagcatgtttacggaaaatatggggcagaattttttgaaaattgattgaatcccaagtaatcggtgcctatcattggctattctagtccaaggcacatgttctctctgtacatagaaaatgcatttacttctttatgaataattaataccatgaactttataatgtgctcacatcttgacaaagctatttatggaaaggtgactttgggcagatagtttgaactctttaaaactcagtttctttttgtgtaaaatttgagtataaacattgatagtttcttagagttgttttatggaaaacaaaatagcgtgataagcttggagcctgacatgcaagacgtaccccccaaaaaggtagcaattgttattttattataaaataataggctttaagtgtcctgaaggtggaagcagtcctcatggacacctaatatctaatgacaacgaaataacaaagaaacttcagaaattatagagttcaacttaaatggttgtacattgttttgacaaaactgaagccagacatgttattgtaaatggtactcactaggaacatttgtaaattattttaactgttcttttgcaatttttttcaggattaaaagatcagaagatgagaggggaatgaatacttcagatgctttcaggagtgacacaagaacacaatgatttttgcttataatcactttacttagcaaattctgtaactaaaaaagtaccattagcagacaataaaatgcatt

SEQ ID NO: 4254 - DNA, 290230 bp, human; identical to SEQ ID NO: 3022

SEQ ID NO: 4255 - DNA, 207522 bp, human; identical to SEQ ID NO: 3023

SEQ ID NO: 4256 - DNA, 516178 bp, human; identical to SEQ ID NO: 3024

SEQ ID NO: 4257 - DNA, 527536 bp, human; identical to SEQ ID NO: 3025

SEQ ID NO: 4258 - DNA, 528157 bp, human; identical to SEQ ID NO: 3026

SEQ ID NO: 4259 - DNA, 528157 bp, human; identical to SEQ ID NO: 3026

SEQ ID NO: 4260 - DNA, 522304 bp, human; identical to SEQ ID NO: 3028

SEQ ID NO: 4261 - DNA, 516178 bp, human; identical to SEQ ID NO: 3024

SEQ ID NO: 4262 - DNA, 527536 bp, human; identical to SEQ ID NO: 3025

SEQ ID NO: 4263 - DNA, 528157 bp, human; identical to SEQ ID NO: 3026

SEQ ID NO: 4264 - DNA, 528157 bp, human; identical to SEQ ID NO: 3026

SEQ ID NO: 4265 - DNA, 522304 bp, human; identical to SEQ ID NO: 3028

SEQ ID NO: 4266 - DNA, 516178 bp, human; identical to SEQ ID NO: 3024

SEQ ID NO: 4267 - DNA, 527536 bp, human; identical to SEQ ID NO: 3025

SEQ ID NO: 4268 - DNA, 528157 bp, human; identical to SEQ ID NO: 3026

SEQ ID NO: 4269 - DNA, 528157 bp, human; identical to SEQ ID NO: 3026

SEQ ID NO: 4270 - DNA, 522304 bp, human; identical to SEQ ID NO: 3028

SEQ ID NO: 4271 - DNA, 1444 bp, human
ttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtg

SEQ ID NO: 4272 - DNA, 1413 bp, human
aaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaaggtgagtgaacttgttaaaccagactgaaaattgattgtctttgctgcatagaaacattgcagacttaagtttcagaaacacttgtagagaagtttgtttcatttcctgcttttactttgtagcattgcaaacttctttaagtttttgaaacacttgtagagaagtttgtttcatttcctgtctttactttgtagcgttgcaaacttctttaagttttagaaacacttgtagagaagtttgattcatttcctgtttttactttgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgcc

SEQ ID NO: 4273 - DNA, 16199 bp, human
agaagcctcacactgtctcacgctcagagaccaatcacggggtggttggacggatgtttcctattttgaaggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaaggtgagtgaacttgttaaaccagactgaaaattgattgtctttgctgcatagaaacattgcagacttaagtttcagaaacacttgtagagaagtttgtttcatttcctgcttttactttgtagcattgcaaacttctttaagtttttgaaacacttgtagagaagtttgtttcatttcctgtctttactttgtagcgttgcaaacttctttaagttttagaaacacttgtagagaagtttgattcatttcctgtttttactttgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggaggatgattgttactacattaacaggaggaaacgggtatgtagggagaatgtataaaacattaatttgtttggcattttcattttgccatagtttgcaatcatagacgtaagcaatagcgaatcttggtggaacgaaatttatatttttcagctttgtattgagtcaggttttaaagttctctgccagtggtgctgtgcagctgataaaaattgaaactcacacagctctggctgcccattagggttgtgttgggagctttccagaatgctgctgcttgtgcttcagcccagaaattaagaattaattgatctgtggtggagtccaactgcaggtatacttgaagaagttccccaggttgttctcacagatcactgagattaagaatcactgcttacatctattcaaaaaagtaatattgtaatctacataaggttatgatcagtagagaaaaaaagatcaaagagattgcgaacatatttaagaagttctattcaaacagaattggctttggtttatttttgagttaaaaaatgatacagacatgaccagtgtttcttggaatatgtggtttgttacattaggatgcatacatcagatgtctatgtttttgttaacagttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaagtgagtactggcatgtttggtgttttgtggttctctctgtattagagaggtggcttccatttagaacaggtgacacttgtctctattccgttattttgaattcatttaatatttaataatttattgataattcattgaatcatctaatattaaaaccttgtcacttttgtgaaatcttcagtacttcaataactatttacacatcttacatggatgcattgaaagtgcactgcctcagcactgagacagttttttcagtgatactgtttagggcgagaactttccttgagaagcaccagaatgggcagtgaggatttctcaaagcttgtttacaaacaggttttcattccagtcagagaaagcttccttgtatcctgcctggtacacatgacccagctagatgagaggcagaaaggtggagtgttggagttaaagcaagggttagggattcactagggtcaacccgtttcagcttgcagtgataggggtgtgtccacctgtccacttttgcagcacaggctgctggacacctcgtgtggcctcaaacatatttatttgtgtttaatggggtaagttaaagtgactgctgtattttctgcactttatgttttcctatgtaatcttgacagtagctacaaatccatttcattttgtgtgtatgtaggtgtagtatataatgattagatttaaaactgccctattaaaaatcggcaacttcattgtgaacatttggaaagtacctcttacttgtgtctctaatctcttctttttaatcctcccagtgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggtaagttatatagcctgcactttcaccctcacatgtcagcagtacaatgatcagatccttgttttgaagagttcaatctgatggtgtgggccaacatgtttggaggagggaaggaaatgaaaagtgtgtgtcctggtggttttcttttttcctgggtaagctaagtcatcattcactttcatatggctctggcagattttaccaagtgaagaccccagcatagagaacttaggtgggatgatgagcagctctcccattttggggaagacggtagtgggtggggtgaagagagcacaggccggggagggtggaaggggcaggtttgaattgagtcccctcactggctgtttgtgttagttgcagaggtttcttaggagcctccttcttttgcaggtgtgggatggacggaaggcaggcctagctagtagtattaaatgggaatgttcacacagggcctgcaaactttggccttcagtaaaagttacttctcttcttgctctgcgatgtcaccacttttcctccctcagttaccgagcatgctctgttcttttttgagggggcagggagggggatcctgcaacctaaagtctttcccttaatctctataaggtattgtgctcgctccctcttccctctcttcctgagagagtggtctgttctcatgatttccactcatctgtctcctctgttaaccacttattatctgccttcatctactgctgtgctgcaaaactttgcctgcacgtgaactgataacctcccacttgcagtgtgctgccctttttctcggccaccttgccctgccctccctttctccctctgcttcatggctgtcagctccccagcttctctttccgcctggccgccatctcctctcagccatccttcctttggtagcttctctctctcctttccctttccccatgtcagtttcaccccaggtgagaggcctgcaggactcactggggacctatgtcaaagtccccagggcctacttcaaaccttgagactcctccggggtgggttgtgtgttttcacacagcaaccccaatgcttttcttagtcctgccagtagttacgtttcaacgaggtggtagggtattcttgttctctagaccagcgtttctcagcctcggccctattgatgttttgaatcagatctttctttgttgtggggctgcctgtgcaatataggatgtttagcagaattagtggccttcacccactagatgcggataacacctctttcctcagttgcagcaaccaaaattgtctccagacattgccatctgttccctgtcagggcaacattgctcccacttgagacccactgctctaagacacatataacaggggcatcacaatctttaatgccagcgtgccttgcagagttatggagagggtccaagtgacttcggtacatatttacgaccctcctggagtagagagagcatttcgtgtcttcagaagcactccatgttctggaaaggccctttgagccatgtgtgacatcctccatcttccctaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtttctctttgtactttttattttttatttgtatttattgatgtgaaattcacatataaaattaaccattgtaaagtgaataattcagtggcacttaacagcttcattgacacatccacatatacagttcaatccagtagtttttagtgtattcacagagttgtgcgaccatctgcacagtcaattccagaacattttcagcacccccccacgagaaaccccatacccagtagcaatcactccccacttccccttctgcaagctcctggcaaccactaagctgctttcggtctctctggatttgcctaccctgggtatttcatataaatggaaacatagtatgtggccctttgtgattggctccattcactaagcatagtcttttaaggttcatccacattgtagcatatgtcagtgctttattccttatttttttaaccaaataaaattcaggtgctatctgttaggaaagtcttatcgttaaaggttggtaatttctgagaaccaagtttagatttatgttctgcagtttttaacagtcttgaggcagtctttaattcagttgctgtgtgaataatttcatctttttctttggaagagacacctgtgcatagcagatcatcttcacctattcctctgactcctagcaaggaagggagtgctgtgtttgctggctttgaagggagaagaactaatgaaataaacgaggtaaagaatgtttgatgtttgttcccaatggttcctttatttgtgattacttcaattctataggtggaagtcaaggttcttaaagcatcatgttgctgctattactgtaaacattatcaaaattgtacgtaattttatgcttaacactgtgggttttggtttctaaagtgagaaaattgttaggattccagccctacactgacaatcatcttttaaataagtgcaattattgaaataccagtatttttactttatagaacagatgtcaatttccacagagggccagagggtaaatactttcggctttgtgggccatatggtgtctgtcaaggctacttaactccaaaagtagccacagatagtatgtaaataaaatgagtgtgctatattccaataaaacttgatttatggacactgaaatttgactagcatttaattttcatgtgtttgaaaattttttttgtttttcaatcatttaaaaatataacatccactcttagcttgtgggcaatatagaaacaggcagtagttgggcgggatgtgaccagcaggctgtagtttgctgactcctactttaaatccctgattcccctccatcattaacagtaataccaatagccgtcccttcagggatgggctctaggccaccactgtgccagacacttgaaccaaatactttgaattctcgagatcagccttgccaccagatttccacttgatagatgggaaaacttttcattttaaaactatttttaaggcccattaggtgatctgtaggtggtgagtttgtcagggattctgaagacgtctcagtttatcagcatattctgtgaacgtctcctaggaggtgagatttcctctttttttaaggtgagtaggagttgcacaagggaaaatggctttgctaggcaaagaacatttttttctttttttgacacagggtctcactctcatgctgtcacccaggctgcagtgcagtggcaggatgttagctcactgcagcctctgcctcctgggctcaggcgatcctcccacctcagcctcctgagtagctggaactacaggctcatgccaccatggcctggctaatttttgcatttttttgtagagactaagttttgccatgttgcccagcctggtcaccaactcctgagctcaagtgatcctcccgcctctgcctcccaaagtgctggggttacaggcatgagccactgtgcccagcctaggcaaagagcacttgatgatgggaagagaagtcacaaaactttcttccagacgataactgtcttcagtagtgtgtaccctaaggtctcttgagagactgctcaactctgctgttccagcaggaaagccctaaacaaagggacgtggctctgccataaacaaaggggtgtggctctgtgtgctgcccccttaattcattcatggacactgagaatttaatgtcatgtgattttcacatatcacaaaatattattcgtatgattttttttccccaaccattttgaacatatgagcatggggctggatttggcctaggggctacagttggctgaccccatagagaatctagaaagcctaatttgtgttatgatgattgttgagggtaggttaggaaatccctagttcaagcagtccctgacatgcccatttttcagataagaatgcactacgaattttattattgaggggaaatcgtgaatttaaggggcatctgagttgtcaagtaagggctattcccactccggtctgcagtgcgaatgcgccatctagtggttataggtacagctgcaacttatagtttgaaagtgctttctgggaaatggttggggttcaggcggctctcacaaggactcatgagaccttcgtggattcccaccttcttacgtacgtctaccaccgtgttttttgaccagggctctttctctcagttccaatcgctgctccacagtactaggggctggtctgggccagcacatgccagtaaaggtccatcaatgattcccatgcataccccactgggaatcccccgactagaaacctaccatttttccccggaaaatgtgtcttcataaatagaagattataaactgccttgaaacacagaattgagtgagtgagatagagccagatgacctgcttttgtacgtgccaagtgctgttcatgcctctgagattgcaaagtcctgtatgtttcctttgagtcactttcagaatggttccaaagcttcagctgtgtgcactgggcaggtgctggggatgctgtaaagatgctggaacgatcccttccctcagtgctccacagtgcagaagtggggcgctgggggtggagacctaggcgagagtctaggcctgtctaggcaggggccaaagtgaagctaggcctttgttctggatccttcagggccaccttggtgcttattagcttctggcagttccatgttgttaaactgactatatcagtgtttctgagtttgtgggggcatctttctttctgctttgtctgctggtggacttcctccagtctgactgtttccatattgaatatgacgtcccaaaagccaaagtagcagctcagtagagtaggctctggttctataatttgctgaagtacttttacggaaattcatcagagagttttgaaatgcaactctccctttaacaaaagccccaggtccacccacagttctgaaattcagaatgaagacaaatcagttatcaggtttgaagtctatttcagttgattcaaggggttaaaagattcaaattcgtttccataatgaatctaacagcaagaaattaaggaatcttgaaacaacagtaatattattcagaacatctatggattactttttaatgcttcattctctctctagtgcagcaggattttcttttttctgggtggaggggaagggggccagagtttcactcttgttgcccaggctggagtgcagtggcacaaccttggttcactgtaacctctgcctccttggttcaggtgattctcctgcctcagcctcccaagtagctgggattacaggcgtccaccaccacacctggctaattttttgtatttttagtagagatggggtttcaacatgttggccaggctggtctcaagctcccgaccgcagttgatccacacacctcggcctcccaaagtgctgggattacaggtgtgagccaccgcgcctggccatgcagcagaattttcaataaagagaaaggactaaagaacctaaacagttacagttatttatagagaataactgttgcgagttaagaaattaaagactttcttgatctattttaagtgtttttgcctttcatctttgttttttgtaagcttgtgtttattttgatccaatcacttattttttcccctctacgtacaatttactgtcataattgttaggtggttggaagtgtctccattaagaataacaaaagcattcaattcgtgctttttccaggtcctctcctggaagcttgtgcctgacaattaccccccaggtgaccagccgcctccaccctcttacatttatggggcacaacatttgctgcgattgtttggtaagaatcctggttcctgccttctttccatttttcattttgtattctcttgttagctttctgtacaccttgtggtttgggctataattatctaactaagaaatttggggatccaagaaaaattaaaagtaatctatcaaagaaaaggcattgaatgaatcttaaatttcataaaaattatgtttgtaatatttgtactgctactctgtctttgttcagtaagagtttggggatttgtttgataatgtggatgttaatttcagttccagtagagataaggaggggcccagaccttccctgagtgaatcctatgcattgtcagattctgctaattgtaaatggttttgcctttatttttaatgcagtgaaacttccagaaatccttggaaagatgtccttttctgagaagaatctgaaggctttattgaagcactttgatctctttttgaggtatttttattattttgtcaaaacttacacctgttgccatatatgtggcttttctgaacttctctttagcacatggggaagtcagctctgtgatattttaaatagtagaagtattacctaagcatggttggttctaaccgtaatgggaattaggagtgggtttttttggtatttcttttttccataatttctctggtttctgagttaggggcattcattgtacagaggtgaagtttttttgtctcactagaagaatttaatttaaaaaaaccttataaatagaaaataaattttctaaagtagaagtgattgagattgatgataatttagttttacatttttttattcaacagtacctcaagtagtggactttcctttgttgcatgtacataaactaacttaaatagtagcatttataggttggatttcggtgtttactttagaattaagagaaaagaccccttgtctgtgttgtcatgtatgaattcagaccaaggtattgtttcctgcagctgacaaagccagtcatttttttatctaataggatcatttgatctgaggctctgctgtgtcctctcccttccagatgatgtctatggaccactttctctccttggccttcaaggctagttgtccccctgcctcacccagctcatcctagctacctgactttgtttcttccttctctttaaggagtatctcttccttgtatccaggccccaccctgacttatcaagtaggatttaccacagagtggagagtatcccagccagggaaatcgtcttgtggttttaagagatcctttcatgtaggcattttgaataaagtgtccatgagtggaattagacttcacaacattttcttggaaacaagtttccaaaagaccctcttccctcccagcctcttcctcaacaaaacccacaactctgtttggcataaaattttgtaaactgaaatcaaatagtgccaagaaaatatgaagagtcagttgcaggatagcataggaaatcctgctaattttgatgcatgcctaatacaaaatagaaattagaattttaggaagtaacttaggaggacttactaataaacctagtaagaggttttaaaaacgtattcgaagatatcaaccagaatcaatggactcaataatgatcataaaaagagtacactcatagaagaaaaagagttagctatccaatgagttttgactcaatttatactgaagaaggtttgcacatttttaggaatttgggcaggtgggagtcactgggaagcaagcataaggcaaatgtgcttattagtgaatattgcacatgtgagaatgtcttagccctccatggcaaaatcagttgaagtttgagtcaagatatcatatgtatattgaagattcttgaatgaccagcacatttttaacatccgtcttcatacatatgagtctttcctgtgtcttggtactgttagctagaactgtaacatgttttggcatggcaaattaggacaccaaatgccattactagttgttctgttcaatttttgtatgactttgctcatataaatgatgtacatttctgaagtgagatttattgtttataatcgttttttattttttattttgtttatttatttatttttgagacggagtcttgctctgtcgcctgggctggagtgcagtggcgtgatctcggctcactgcaagctctgcctcccaggttcatgccattctcctgcctcagcctcccgagtagctgggactacaggcacccgccaccacgcccagctaattttttgtgtttttagtagagacggggtttcactgtgttagccaggatgttctcgatctcctgacctcgtgaccacctgcctcggcctcccaaagtgctgggattacaggcgtgaaccacagtgcccagcctataatctgttgtttttaatagtttgtttgaacaacagaaaaatgtagaaacattcatgggcttttttttttccgcccccaacagaagtgtttatataaccagactgccacctagtggagtgtaggttctgtttccatttgtacacctgatgatggtgaaggcattcagataagtagtaattcacatagaagctggataagtgcagtgaaaataatcagtatagagagatcaaaattatagtcatttttttcttcctaataccaaaaaacagttgaaatgttagtaggttgaaagtcaatattttgcttgatggtatttagtccttagtatggtgctcattggggctattttttttttccaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaag

SEQ ID NO: 4274 - DNA, 9740 bp, human
gcctcgccctccgccacgatgagcaaatgagcgcgagcgagggcatgaaatttaaattccactcaggggagaaagtgctgtgcttcgagcctgaccccaccaaggcgcgagtgctgtacgatgccaaggtgccgccgcggagggacagggaggaggcgcgggctgggggacccgggaccgggggcgggggcgggggcggacggccgcgcggagctgagggaccggccgggctcctcggcctgcgaggagcggtgcggccggcagggggcgctcacagggcgctacgcccgggagtcggggcggggtctgggatgcttccacttccttccgtcaggccgggcggcgcacgcgcggttgggagcctcgcccatgctttgtcgcgttaccggggctaccgtttgcgcccccgactgcaacggtggccgctgagggaggaggcttctcgaatacggtttctgtcttcgcgttaaatgtctccttctgtgcggcctggtgccgggtgggctcctgtgggacgccctggccgtccgatccaggttctaattcatagttacacggcgctggccgctgacttgcgacgttgtgtccctgggaccctagtccagtttaggccccatcccgcctgtaggccgtgaaccccatcccgagggcaaggttggcccagtgttttcgtaccccagggccttgcagcatttacgttttcaaactctgaaggatttacgtgggtctgaccatagttgatgggaatcgcgccccgggccggtccacctaagtctccgggagctgagccacatcttgcagctcctcagatttgggtggcgggcaggagttggcaccaggtctcccagatccccaaggaaagcacccaggtgctttcatttcagagacctgggttcctagggccacctgggcgaagccttaggcggcagggacaggggcagtcccaggtgtgtctttggcgatgtctggacagctctgtccattagagatgctaaaggacatccctaaagggatgagcatattctgccttcagttccctcccctgctgctcctgtcttttaaccgcgtctgctatccctctttctcctcgccctccagcctcctcggggcggaggggggggggcacgccccatcattagttttagttgttccctctagggacacaacagggagggattccagagtctccagctagccatcctggcactggacataggggagcccaggagactacaactcccagagctctcagggctgcagctttcatctagcctggagtctctccttagtgacaaatcggctggccaatggcttcagaagcctcacactgtctcacgctcagagaccaatcacggggtggttggacggatgtttcctattttgaaggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaaggtgagtgaacttgttaaaccagactgaaaattgattgtctttgctgcatagaaacattgcagacttaagtttcagaaacacttgtagagaagtttgtttcatttcctgcttttactttgtagcattgcaaacttctttaagtttttgaaacacttgtagagaagtttgtttcatttcctgtctttactttgtagcgttgcaaacttctttaagttttagaaacacttgtagagaagtttgattcatttcctgtttttactttgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggaggatgattgttactacattaacaggaggaaacgggtatgtagggagaatgtataaaacattaatttgtttggcattttcattttgccatagtttgcaatcatagacgtaagcaatagcgaatcttggtggaacgaaatttatatttttcagctttgtattgagtcaggttttaaagttctctgccagtggtgctgtgcagctgataaaaattgaaactcacacagctctggctgcccattagggttgtgttgggagctttccagaatgctgctgcttgtgcttcagcccagaaattaagaattaattgatctgtggtggagtccaactgcaggtatacttgaagaagttccccaggttgttctcacagatcactgagattaagaatcactgcttacatctattcaaaaaagtaatattgtaatctacataaggttatgatcagtagagaaaaaaagatcaaagagattgcgaacatatttaagaagttctattcaaacagaattggctttggtttatttttgagttaaaaaatgatacagacatgaccagtgtttcttggaatatgtggtttgttacattaggatgcatacatcagatgtctatgtttttgttaacagttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaagtgagtactggcatgtttggtgttttgtggttctctctgtattagagaggtggcttccatttagaacaggtgacacttgtctctattccgttattttgaattcatttaatatttaataatttattgataattcattgaatcatctaatattaaaaccttgtcacttttgtgaaatcttcagtacttcaataactatttacacatcttacatggatgcattgaaagtgcactgcctcagcactgagacagttttttcagtgatactgtttagggcgagaactttccttgagaagcaccagaatgggcagtgaggatttctcaaagcttgtttacaaacaggttttcattccagtcagagaaagcttccttgtatcctgcctggtacacatgacccagctagatgagaggcagaaaggtggagtgttggagttaaagcaagggttagggattcactagggtcaacccgtttcagcttgcagtgataggggtgtgtccacctgtccacttttgcagcacaggctgctggacacctcgtgtggcctcaaacatatttatttgtgtttaatggggtaagttaaagtgactgctgtattttctgcactttatgttttcctatgtaatcttgacagtagctacaaatccatttcattttgtgtgtatgtaggtgtagtatataatgattagatttaaaactgccctattaaaaatcggcaacttcattgtgaacatttggaaagtacctcttacttgtgtctctaatctcttctttttaatcctcccagtgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggtaagttatatagcctgcactttcaccctcacatgtcagcagtacaatgatcagatccttgttttgaagagttcaatctgatggtgtgggccaacatgtttggaggagggaaggaaatgaaaagtgtgtgtcctggtggttttcttttttcctgggtaagctaagtcatcattcactttcatatggctctggcagattttaccaagtgaagaccccagcatagagaacttaggtgggatgatgagcagctctcccattttggggaagacggtagtgggtggggtgaagagagcacaggccggggagggtggaaggggcaggtttgaattgagtcccctcactggctgtttgtgttagttgcagaggtttcttaggagcctccttcttttgcaggtgtgggatggacggaaggcaggcctagctagtagtattaaatgggaatgttcacacagggcctgcaaactttggccttcagtaaaagttacttctcttcttgctctgcgatgtcaccacttttcctccctcagttaccgagcatgctctgttcttttttgagggggcagggagggggatcctgcaacctaaagtctttcccttaatctctataaggtattgtgctcgctccctcttccctctcttcctgagagagtggtctgttctcatgatttccactcatctgtctcctctgttaaccacttattatctgccttcatctactgctgtgctgcaaaactttgcctgcacgtgaactgataacctcccacttgcagtgtgctgccctttttctcggccaccttgccctgccctccctttctccctctgcttcatggctgtcagctccccagcttctctttccgcctggccgccatctcctctcagccatccttcctttggtagcttctctctctcctttccctttccccatgtcagtttcaccccaggtgagaggcctgcaggactcactggggacctatgtcaaagtccccagggcctacttcaaaccttgagactcctccggggtgggttgtgtgttttcacacagcaaccccaatgcttttcttagtcctgccagtagttacgtttcaacgaggtggtagggtattcttgttctctagaccagcgtttctcagcctcggccctattgatgttttgaatcagatctttctttgttgtggggctgcctgtgcaatataggatgtttagcagaattagtggccttcacccactagatgcggataacacctctttcctcagttgcagcaaccaaaattgtctccagacattgccatctgttccctgtcagggcaacattgctcccacttgagacccactgctctaagacacatataacaggggcatcacaatctttaatgccagcgtgccttgcagagttatggagagggtccaagtgacttcggtacatatttacgaccctcctggagtagagagagcatttcgtgtcttcagaagcactccatgttctggaaaggccctttgagccatgtgtgacatcctccatcttccctaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtt

SEQ ID NO: 4275 - DNA, 17592 bp, human
ggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaaggtgccgccgcggagggacagggaggaggcgcgggctgggggacccgggaccgggggcgggggcgggggcggacggccgcgcggagctgagggaccggccgggctcctcggcctgcgaggagcggtgcggccggcagggggcgctcacagggcgctacgcccgggagtcggggcggggtctgggatgcttccacttccttccgtcaggccgggcggcgcacgcgcggttgggagcctcgcccatgctttgtcgcgttaccggggctaccgtttgcgcccccgactgcaacggtggccgctgagggaggaggcttctcgaatacggtttctgtcttcgcgttaaatgtctccttctgtgcggcctggtgccgggtgggctcctgtgggacgccctggccgtccgatccaggttctaattcatagttacacggcgctggccgctgacttgcgacgttgtgtccctgggaccctagtccagtttaggccccatcccgcctgtaggccgtgaaccccatcccgagggcaaggttggcccagtgttttcgtaccccagggccttgcagcatttacgttttcaaactctgaaggatttacgtgggtctgaccatagttgatgggaatcgcgccccgggccggtccacctaagtctccgggagctgagccacatcttgcagctcctcagatttgggtggcgggcaggagttggcaccaggtctcccagatccccaaggaaagcacccaggtgctttcatttcagagacctgggttcctagggccacctgggcgaagccttaggcggcagggacaggggcagtcccaggtgtgtctttggcgatgtctggacagctctgtccattagagatgctaaaggacatccctaaagggatgagcatattctgccttcagttccctcccctgctgctcctgtcttttaaccgcgtctgctatccctctttctcctcgccctccagcctcctcggggcggaggggggggggcacgccccatcattagttttagttgttccctctagggacacaacagggagggattccagagtctccagctagccatcctggcactggacataggggagcccaggagactacaactcccagagctctcagggctgcagctttcatctagcctggagtctctccttagtgacaaatcggctggccaatggcttcagaagcctcacactgtctcacgctcagagaccaatcacggggtggttggacggatgtttcctattttgaaggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaaggtgagtgaacttgttaaaccagactgaaaattgattgtctttgctgcatagaaacattgcagacttaagtttcagaaacacttgtagagaagtttgtttcatttcctgcttttactttgtagcattgcaaacttctttaagtttttgaaacacttgtagagaagtttgtttcatttcctgtctttactttgtagcgttgcaaacttctttaagttttagaaacacttgtagagaagtttgattcatttcctgtttttactttgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggaggatgattgttactacattaacaggaggaaacgggtatgtagggagaatgtataaaacattaatttgtttggcattttcattttgccatagtttgcaatcatagacgtaagcaatagcgaatcttggtggaacgaaatttatatttttcagctttgtattgagtcaggttttaaagttctctgccagtggtgctgtgcagctgataaaaattgaaactcacacagctctggctgcccattagggttgtgttgggagctttccagaatgctgctgcttgtgcttcagcccagaaattaagaattaattgatctgtggtggagtccaactgcaggtatacttgaagaagttccccaggttgttctcacagatcactgagattaagaatcactgcttacatctattcaaaaaagtaatattgtaatctacataaggttatgatcagtagagaaaaaaagatcaaagagattgcgaacatatttaagaagttctattcaaacagaattggctttggtttatttttgagttaaaaaatgatacagacatgaccagtgtttcttggaatatgtggtttgttacattaggatgcatacatcagatgtctatgtttttgttaacagttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaagtgagtactggcatgtttggtgttttgtggttctctctgtattagagaggtggcttccatttagaacaggtgacacttgtctctattccgttattttgaattcatttaatatttaataatttattgataattcattgaatcatctaatattaaaaccttgtcacttttgtgaaatcttcagtacttcaataactatttacacatcttacatggatgcattgaaagtgcactgcctcagcactgagacagttttttcagtgatactgtttagggcgagaactttccttgagaagcaccagaatgggcagtgaggatttctcaaagcttgtttacaaacaggttttcattccagtcagagaaagcttccttgtatcctgcctggtacacatgacccagctagatgagaggcagaaaggtggagtgttggagttaaagcaagggttagggattcactagggtcaacccgtttcagcttgcagtgataggggtgtgtccacctgtccacttttgcagcacaggctgctggacacctcgtgtggcctcaaacatatttatttgtgtttaatggggtaagttaaagtgactgctgtattttctgcactttatgttttcctatgtaatcttgacagtagctacaaatccatttcattttgtgtgtatgtaggtgtagtatataatgattagatttaaaactgccctattaaaaatcggcaacttcattgtgaacatttggaaagtacctcttacttgtgtctctaatctcttctttttaatcctcccagtgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggtaagttatatagcctgcactttcaccctcacatgtcagcagtacaatgatcagatccttgttttgaagagttcaatctgatggtgtgggccaacatgtttggaggagggaaggaaatgaaaagtgtgtgtcctggtggttttcttttttcctgggtaagctaagtcatcattcactttcatatggctctggcagattttaccaagtgaagaccccagcatagagaacttaggtgggatgatgagcagctctcccattttggggaagacggtagtgggtggggtgaagagagcacaggccggggagggtggaaggggcaggtttgaattgagtcccctcactggctgtttgtgttagttgcagaggtttcttaggagcctccttcttttgcaggtgtgggatggacggaaggcaggcctagctagtagtattaaatgggaatgttcacacagggcctgcaaactttggccttcagtaaaagttacttctcttcttgctctgcgatgtcaccacttttcctccctcagttaccgagcatgctctgttcttttttgagggggcagggagggggatcctgcaacctaaagtctttcccttaatctctataaggtattgtgctcgctccctcttccctctcttcctgagagagtggtctgttctcatgatttccactcatctgtctcctctgttaaccacttattatctgccttcatctactgctgtgctgcaaaactttgcctgcacgtgaactgataacctcccacttgcagtgtgctgccctttttctcggccaccttgccctgccctccctttctccctctgcttcatggctgtcagctccccagcttctctttccgcctggccgccatctcctctcagccatccttcctttggtagcttctctctctcctttccctttccccatgtcagtttcaccccaggtgagaggcctgcaggactcactggggacctatgtcaaagtccccagggcctacttcaaaccttgagactcctccggggtgggttgtgtgttttcacacagcaaccccaatgcttttcttagtcctgccagtagttacgtttcaacgaggtggtagggtattcttgttctctagaccagcgtttctcagcctcggccctattgatgttttgaatcagatctttctttgttgtggggctgcctgtgcaatataggatgtttagcagaattagtggccttcacccactagatgcggataacacctctttcctcagttgcagcaaccaaaattgtctccagacattgccatctgttccctgtcagggcaacattgctcccacttgagacccactgctctaagacacatataacaggggcatcacaatctttaatgccagcgtgccttgcagagttatggagagggtccaagtgacttcggtacatatttacgaccctcctggagtagagagagcatttcgtgtcttcagaagcactccatgttctggaaaggccctttgagccatgtgtgacatcctccatcttccctaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtttctctttgtactttttattttttatttgtatttattgatgtgaaattcacatataaaattaaccattgtaaagtgaataattcagtggcacttaacagcttcattgacacatccacatatacagttcaatccagtagtttttagtgtattcacagagttgtgcgaccatctgcacagtcaattccagaacattttcagcacccccccacgagaaaccccatacccagtagcaatcactccccacttccccttctgcaagctcctggcaaccactaagctgctttcggtctctctggatttgcctaccctgggtatttcatataaatggaaacatagtatgtggccctttgtgattggctccattcactaagcatagtcttttaaggttcatccacattgtagcatatgtcagtgctttattccttatttttttaaccaaataaaattcaggtgctatctgttaggaaagtcttatcgttaaaggttggtaatttctgagaaccaagtttagatttatgttctgcagtttttaacagtcttgaggcagtctttaattcagttgctgtgtgaataatttcatctttttctttggaagagacacctgtgcatagcagatcatcttcacctattcctctgactcctagcaaggaagggagtgctgtgtttgctggctttgaagggagaagaactaatgaaataaacgaggtaaagaatgtttgatgtttgttcccaatggttcctttatttgtgattacttcaattctataggtggaagtcaaggttcttaaagcatcatgttgctgctattactgtaaacattatcaaaattgtacgtaattttatgcttaacactgtgggttttggtttctaaagtgagaaaattgttaggattccagccctacactgacaatcatcttttaaataagtgcaattattgaaataccagtatttttactttatagaacagatgtcaatttccacagagggccagagggtaaatactttcggctttgtgggccatatggtgtctgtcaaggctacttaactccaaaagtagccacagatagtatgtaaataaaatgagtgtgctatattccaataaaacttgatttatggacactgaaatttgactagcatttaattttcatgtgtttgaaaattttttttgtttttcaatcatttaaaaatataacatccactcttagcttgtgggcaatatagaaacaggcagtagttgggcgggatgtgaccagcaggctgtagtttgctgactcctactttaaatccctgattcccctccatcattaacagtaataccaatagccgtcccttcagggatgggctctaggccaccactgtgccagacacttgaaccaaatactttgaattctcgagatcagccttgccaccagatttccacttgatagatgggaaaacttttcattttaaaactatttttaaggcccattaggtgatctgtaggtggtgagtttgtcagggattctgaagacgtctcagtttatcagcatattctgtgaacgtctcctaggaggtgagatttcctctttttttaaggtgagtaggagttgcacaagggaaaatggctttgctaggcaaagaacatttttttctttttttgacacagggtctcactctcatgctgtcacccaggctgcagtgcagtggcaggatgttagctcactgcagcctctgcctcctgggctcaggcgatcctcccacctcagcctcctgagtagctggaactacaggctcatgccaccatggcctggctaatttttgcatttttttgtagagactaagttttgccatgttgcccagcctggtcaccaactcctgagctcaagtgatcctcccgcctctgcctcccaaagtgctggggttacaggcatgagccactgtgcccagcctaggcaaagagcacttgatgatgggaagagaagtcacaaaactttcttccagacgataactgtcttcagtagtgtgtaccctaaggtctcttgagagactgctcaactctgctgttccagcaggaaagccctaaacaaagggacgtggctctgccataaacaaaggggtgtggctctgtgtgctgcccccttaattcattcatggacactgagaatttaatgtcatgtgattttcacatatcacaaaatattattcgtatgattttttttccccaaccattttgaacatatgagcatggggctggatttggcctaggggctacagttggctgaccccatagagaatctagaaagcctaatttgtgttatgatgattgttgagggtaggttaggaaatccctagttcaagcagtccctgacatgcccatttttcagataagaatgcactacgaattttattattgaggggaaatcgtgaatttaaggggcatctgagttgtcaagtaagggctattcccactccggtctgcagtgcgaatgcgccatctagtggttataggtacagctgcaacttatagtttgaaagtgctttctgggaaatggttggggttcaggcggctctcacaaggactcatgagaccttcgtggattcccaccttcttacgtacgtctaccaccgtgttttttgaccagggctctttctctcagttccaatcgctgctccacagtactaggggctggtctgggccagcacatgccagtaaaggtccatcaatgattcccatgcataccccactgggaatcccccgactagaaacctaccatttttccccggaaaatgtgtcttcataaatagaagattataaactgccttgaaacacagaattgagtgagtgagatagagccagatgacctgcttttgtacgtgccaagtgctgttcatgcctctgagattgcaaagtcctgtatgtttcctttgagtcactttcagaatggttccaaagcttcagctgtgtgcactgggcaggtgctggggatgctgtaaagatgctggaacgatcccttccctcagtgctccacagtgcagaagtggggcgctgggggtggagacctaggcgagagtctaggcctgtctaggcaggggccaaagtgaagctaggcctttgttctggatccttcagggccaccttggtgcttattagcttctggcagttccatgttgttaaactgactatatcagtgtttctgagtttgtgggggcatctttctttctgctttgtctgctggtggacttcctccagtctgactgtttccatattgaatatgacgtcccaaaagccaaagtagcagctcagtagagtaggctctggttctataatttgctgaagtacttttacggaaattcatcagagagttttgaaatgcaactctccctttaacaaaagccccaggtccacccacagttctgaaattcagaatgaagacaaatcagttatcaggtttgaagtctatttcagttgattcaaggggttaaaagattcaaattcgtttccataatgaatctaacagcaagaaattaaggaatcttgaaacaacagtaatattattcagaacatctatggattactttttaatgcttcattctctctctagtgcagcaggattttcttttttctgggtggaggggaagggggccagagtttcactcttgttgcccaggctggagtgcagtggcacaaccttggttcactgtaacctctgcctccttggttcaggtgattctcctgcctcagcctcccaagtagctgggattacaggcgtccaccaccacacctggctaattttttgtatttttagtagagatggggtttcaacatgttggccaggctggtctcaagctcccgaccgcagttgatccacacacctcggcctcccaaagtgctgggattacaggtgtgagccaccgcgcctggccatgcagcagaattttcaataaagagaaaggactaaagaacctaaacagttacagttatttatagagaataactgttgcgagttaagaaattaaagactttcttgatctattttaagtgtttttgcctttcatctttgttttttgtaagcttgtgtttattttgatccaatcacttattttttcccctctacgtacaatttactgtcataattgttaggtggttggaagtgtctccattaagaataacaaaagcattcaattcgtgctttttccaggtcctctcctggaagcttgtgcctgacaattaccccccaggtgaccagccgcctccaccctcttacatttatggggcacaacatttgctgcgattgtttggtaagaatcctggttcctgccttctttccatttttcattttgtattctcttgttagctttctgtacaccttgtggtttgggctataattatctaactaagaaatttggggatccaagaaaaattaaaagtaatctatcaaagaaaaggcattgaatgaatcttaaatttcataaaaattatgtttgtaatatttgtactgctactctgtctttgttcagtaagagtttggggatttgtttgataatgtggatgttaatttcagttccagtagagataaggaggggcccagaccttccctgagtgaatcctatgcattgtcagattctgctaattgtaaatggttttgcctttatttttaatgcagtgaaacttccagaaatccttggaaagatgtccttttctgagaagaatctgaaggctttattgaagcactttgatctctttttgaggtatttttattattttgtcaaaacttacacctgttgccatatatgtggcttttctgaacttctctttagcacatggggaagtcagctctgtgatattttaaatagtagaagtattacctaagcatggttggttctaaccgtaatgggaattaggagtgggtttttttggtatttcttttttccataatttctctggtttctgagttaggggcattcattgtacagaggtgaagtttttttgtctcactagaagaatttaatttaaaaaaaccttataaatagaaaataaattttctaaagtagaagtgattgagattgatgataatttagttttacatttttttattcaacagtacctcaagtagtggactttcctttgttgcatgtacataaactaacttaaatagtagcatttataggttggatttcggtgtttactttagaattaagagaaaagaccccttgtctgtgttgtcatgtatgaattcagaccaaggtattgtttcctgcagctgacaaagccagtcatttttttatctaataggatcatttgatctgaggctctgctgtgtcctctcccttccagatgatgtctatggaccactttctctccttggccttcaaggctagttgtccccctgcctcacccagctcatcctagctacctgactttgtttcttccttctctttaaggagtatctcttccttgtatccaggccccaccctgacttatcaagtaggatttaccacagagtggagagtatcccagccagggaaatcgtcttgtggttttaagagatcctttcatgtaggcattttgaataaagtgtccatgagtggaattagacttcacaacattttcttggaaacaagtttccaaaagaccctcttccctcccagcctcttcctcaacaaaacccacaactctgtttggcataaaattttgtaaactgaaatcaaatagtgccaagaaaatatgaagagtcagttgcaggatagcataggaaatcctgctaattttgatgcatgcctaatacaaaatagaaattagaattttaggaagtaacttaggaggacttactaataaacctagtaagaggttttaaaaacgtattcgaagatatcaaccagaatcaatggactcaataatgatcataaaaagagtacactcatagaagaaaaagagttagctatccaatgagttttgactcaatttatactgaagaaggtttgcacatttttaggaatttgggcaggtgggagtcactgggaagcaagcataaggcaaatgtgcttattagtgaatattgcacatgtgagaatgtcttagccctccatggcaaaatcagttgaagtttgagtcaagatatcatatgtatattgaagattcttgaatgaccagcacatttttaacatccgtcttcatacatatgagtctttcctgtgtcttggtactgttagctagaactgtaacatgttttggcatggcaaattaggacaccaaatgccattactagttgttctgttcaatttttgtatgactttgctcatataaatgatgtacatttctgaagtgagatttattgtttataatcgttttttattttttattttgtttatttatttatttttgagacggagtcttgctctgtcgcctgggctggagtgcagtggcgtgatctcggctcactgcaagctctgcctcccaggttcatgccattctcctgcctcagcctcccgagtagctgggactacaggcacccgccaccacgcccagctaattttttgtgtttttagtagagacggggtttcactgtgttagccaggatgttctcgatctcctgacctcgtgaccacctgcctcggcctcccaaagtgctgggattacaggcgtgaaccacagtgcccagcctataatctgttgtttttaatagtttgtttgaacaacagaaaaatgtagaaacattcatgggcttttttttttccgcccccaacagaagtgtttatataaccagactgccacctagtggagtgtaggttctgtttccatttgtacacctgatgatggtgaaggcattcagataagtagtaattcacatagaagctggataagtgcagtgaaaataatcagtatagagagatcaaaattatagtcatttttttcttcctaataccaaaaaacagttgaaatgttagtaggttgaaagtcaatattttgcttgatggtatttagtccttagtatggtgctcattggggctattttttttttccaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaag

SEQ ID NO: 4276 - DNA, 16846 bp, human
ctttgtcgcgttaccggggctaccgtttgcgcccccgactgcaacggtggccgctgagggaggaggcttctcgaatacggtttctgtcttcgcgttaaatgtctccttctgtgcggcctggtgccgggtgggctcctgtgggacgccctggccgtccgatccaggttctaattcatagttacacggcgctggccgctgacttgcgacgttgtgtccctgggaccctagtccagtttaggccccatcccgcctgtaggccgtgaaccccatcccgagggcaaggttggcccagtgttttcgtaccccagggccttgcagcatttacgttttcaaactctgaaggatttacgtgggtctgaccatagttgatgggaatcgcgccccgggccggtccacctaagtctccgggagctgagccacatcttgcagctcctcagatttgggtggcgggcaggagttggcaccaggtctcccagatccccaaggaaagcacccaggtgctttcatttcagagacctgggttcctagggccacctgggcgaagccttaggcggcagggacaggggcagtcccaggtgtgtctttggcgatgtctggacagctctgtccattagagatgctaaaggacatccctaaagggatgagcatattctgccttcagttccctcccctgctgctcctgtcttttaaccgcgtctgctatccctctttctcctcgccctccagcctcctcggggcggaggggggggggcacgccccatcattagttttagttgttccctctagggacacaacagggagggattccagagtctccagctagccatcctggcactggacataggggagcccaggagactacaactcccagagctctcagggctgcagctttcatctagcctggagtctctccttagtgacaaatcggctggccaatggcttcagaagcctcacactgtctcacgctcagagaccaatcacggggtggttggacggatgtttcctattttgaaggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaaggtgagtgaacttgttaaaccagactgaaaattgattgtctttgctgcatagaaacattgcagacttaagtttcagaaacacttgtagagaagtttgtttcatttcctgcttttactttgtagcattgcaaacttctttaagtttttgaaacacttgtagagaagtttgtttcatttcctgtctttactttgtagcgttgcaaacttctttaagttttagaaacacttgtagagaagtttgattcatttcctgtttttactttgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggaggatgattgttactacattaacaggaggaaacgggtatgtagggagaatgtataaaacattaatttgtttggcattttcattttgccatagtttgcaatcatagacgtaagcaatagcgaatcttggtggaacgaaatttatatttttcagctttgtattgagtcaggttttaaagttctctgccagtggtgctgtgcagctgataaaaattgaaactcacacagctctggctgcccattagggttgtgttgggagctttccagaatgctgctgcttgtgcttcagcccagaaattaagaattaattgatctgtggtggagtccaactgcaggtatacttgaagaagttccccaggttgttctcacagatcactgagattaagaatcactgcttacatctattcaaaaaagtaatattgtaatctacataaggttatgatcagtagagaaaaaaagatcaaagagattgcgaacatatttaagaagttctattcaaacagaattggctttggtttatttttgagttaaaaaatgatacagacatgaccagtgtttcttggaatatgtggtttgttacattaggatgcatacatcagatgtctatgtttttgttaacagttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaagtgagtactggcatgtttggtgttttgtggttctctctgtattagagaggtggcttccatttagaacaggtgacacttgtctctattccgttattttgaattcatttaatatttaataatttattgataattcattgaatcatctaatattaaaaccttgtcacttttgtgaaatcttcagtacttcaataactatttacacatcttacatggatgcattgaaagtgcactgcctcagcactgagacagttttttcagtgatactgtttagggcgagaactttccttgagaagcaccagaatgggcagtgaggatttctcaaagcttgtttacaaacaggttttcattccagtcagagaaagcttccttgtatcctgcctggtacacatgacccagctagatgagaggcagaaaggtggagtgttggagttaaagcaagggttagggattcactagggtcaacccgtttcagcttgcagtgataggggtgtgtccacctgtccacttttgcagcacaggctgctggacacctcgtgtggcctcaaacatatttatttgtgtttaatggggtaagttaaagtgactgctgtattttctgcactttatgttttcctatgtaatcttgacagtagctacaaatccatttcattttgtgtgtatgtaggtgtagtatataatgattagatttaaaactgccctattaaaaatcggcaacttcattgtgaacatttggaaagtacctcttacttgtgtctctaatctcttctttttaatcctcccagtgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggtaagttatatagcctgcactttcaccctcacatgtcagcagtacaatgatcagatccttgttttgaagagttcaatctgatggtgtgggccaacatgtttggaggagggaaggaaatgaaaagtgtgtgtcctggtggttttcttttttcctgggtaagctaagtcatcattcactttcatatggctctggcagattttaccaagtgaagaccccagcatagagaacttaggtgggatgatgagcagctctcccattttggggaagacggtagtgggtggggtgaagagagcacaggccggggagggtggaaggggcaggtttgaattgagtcccctcactggctgtttgtgttagttgcagaggtttcttaggagcctccttcttttgcaggtgtgggatggacggaaggcaggcctagctagtagtattaaatgggaatgttcacacagggcctgcaaactttggccttcagtaaaagttacttctcttcttgctctgcgatgtcaccacttttcctccctcagttaccgagcatgctctgttcttttttgagggggcagggagggggatcctgcaacctaaagtctttcccttaatctctataaggtattgtgctcgctccctcttccctctcttcctgagagagtggtctgttctcatgatttccactcatctgtctcctctgttaaccacttattatctgccttcatctactgctgtgctgcaaaactttgcctgcacgtgaactgataacctcccacttgcagtgtgctgccctttttctcggccaccttgccctgccctccctttctccctctgcttcatggctgtcagctccccagcttctctttccgcctggccgccatctcctctcagccatccttcctttggtagcttctctctctcctttccctttccccatgtcagtttcaccccaggtgagaggcctgcaggactcactggggacctatgtcaaagtccccagggcctacttcaaaccttgagactcctccggggtgggttgtgtgttttcacacagcaaccccaatgcttttcttagtcctgccagtagttacgtttcaacgaggtggtagggtattcttgttctctagaccagcgtttctcagcctcggccctattgatgttttgaatcagatctttctttgttgtggggctgcctgtgcaatataggatgtttagcagaattagtggccttcacccactagatgcggataacacctctttcctcagttgcagcaaccaaaattgtctccagacattgccatctgttccctgtcagggcaacattgctcccacttgagacccactgctctaagacacatataacaggggcatcacaatctttaatgccagcgtgccttgcagagttatggagagggtccaagtgacttcggtacatatttacgaccctcctggagtagagagagcatttcgtgtcttcagaagcactccatgttctggaaaggccctttgagccatgtgtgacatcctccatcttccctaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtttctctttgtactttttattttttatttgtatttattgatgtgaaattcacatataaaattaaccattgtaaagtgaataattcagtggcacttaacagcttcattgacacatccacatatacagttcaatccagtagtttttagtgtattcacagagttgtgcgaccatctgcacagtcaattccagaacattttcagcacccccccacgagaaaccccatacccagtagcaatcactccccacttccccttctgcaagctcctggcaaccactaagctgctttcggtctctctggatttgcctaccctgggtatttcatataaatggaaacatagtatgtggccctttgtgattggctccattcactaagcatagtcttttaaggttcatccacattgtagcatatgtcagtgctttattccttatttttttaaccaaataaaattcaggtgctatctgttaggaaagtcttatcgttaaaggttggtaatttctgagaaccaagtttagatttatgttctgcagtttttaacagtcttgaggcagtctttaattcagttgctgtgtgaataatttcatctttttctttggaagagacacctgtgcatagcagatcatcttcacctattcctctgactcctagcaaggaagggagtgctgtgtttgctggctttgaagggagaagaactaatgaaataaacgaggtaaagaatgtttgatgtttgttcccaatggttcctttatttgtgattacttcaattctataggtggaagtcaaggttcttaaagcatcatgttgctgctattactgtaaacattatcaaaattgtacgtaattttatgcttaacactgtgggttttggtttctaaagtgagaaaattgttaggattccagccctacactgacaatcatcttttaaataagtgcaattattgaaataccagtatttttactttatagaacagatgtcaatttccacagagggccagagggtaaatactttcggctttgtgggccatatggtgtctgtcaaggctacttaactccaaaagtagccacagatagtatgtaaataaaatgagtgtgctatattccaataaaacttgatttatggacactgaaatttgactagcatttaattttcatgtgtttgaaaattttttttgtttttcaatcatttaaaaatataacatccactcttagcttgtgggcaatatagaaacaggcagtagttgggcgggatgtgaccagcaggctgtagtttgctgactcctactttaaatccctgattcccctccatcattaacagtaataccaatagccgtcccttcagggatgggctctaggccaccactgtgccagacacttgaaccaaatactttgaattctcgagatcagccttgccaccagatttccacttgatagatgggaaaacttttcattttaaaactatttttaaggcccattaggtgatctgtaggtggtgagtttgtcagggattctgaagacgtctcagtttatcagcatattctgtgaacgtctcctaggaggtgagatttcctctttttttaaggtgagtaggagttgcacaagggaaaatggctttgctaggcaaagaacatttttttctttttttgacacagggtctcactctcatgctgtcacccaggctgcagtgcagtggcaggatgttagctcactgcagcctctgcctcctgggctcaggcgatcctcccacctcagcctcctgagtagctggaactacaggctcatgccaccatggcctggctaatttttgcatttttttgtagagactaagttttgccatgttgcccagcctggtcaccaactcctgagctcaagtgatcctcccgcctctgcctcccaaagtgctggggttacaggcatgagccactgtgcccagcctaggcaaagagcacttgatgatgggaagagaagtcacaaaactttcttccagacgataactgtcttcagtagtgtgtaccctaaggtctcttgagagactgctcaactctgctgttccagcaggaaagccctaaacaaagggacgtggctctgccataaacaaaggggtgtggctctgtgtgctgcccccttaattcattcatggacactgagaatttaatgtcatgtgattttcacatatcacaaaatattattcgtatgattttttttccccaaccattttgaacatatgagcatggggctggatttggcctaggggctacagttggctgaccccatagagaatctagaaagcctaatttgtgttatgatgattgttgagggtaggttaggaaatccctagttcaagcagtccctgacatgcccatttttcagataagaatgcactacgaattttattattgaggggaaatcgtgaatttaaggggcatctgagttgtcaagtaagggctattcccactccggtctgcagtgcgaatgcgccatctagtggttataggtacagctgcaacttatagtttgaaagtgctttctgggaaatggttggggttcaggcggctctcacaaggactcatgagaccttcgtggattcccaccttcttacgtacgtctaccaccgtgttttttgaccagggctctttctctcagttccaatcgctgctccacagtactaggggctggtctgggccagcacatgccagtaaaggtccatcaatgattcccatgcataccccactgggaatcccccgactagaaacctaccatttttccccggaaaatgtgtcttcataaatagaagattataaactgccttgaaacacagaattgagtgagtgagatagagccagatgacctgcttttgtacgtgccaagtgctgttcatgcctctgagattgcaaagtcctgtatgtttcctttgagtcactttcagaatggttccaaagcttcagctgtgtgcactgggcaggtgctggggatgctgtaaagatgctggaacgatcccttccctcagtgctccacagtgcagaagtggggcgctgggggtggagacctaggcgagagtctaggcctgtctaggcaggggccaaagtgaagctaggcctttgttctggatccttcagggccaccttggtgcttattagcttctggcagttccatgttgttaaactgactatatcagtgtttctgagtttgtgggggcatctttctttctgctttgtctgctggtggacttcctccagtctgactgtttccatattgaatatgacgtcccaaaagccaaagtagcagctcagtagagtaggctctggttctataatttgctgaagtacttttacggaaattcatcagagagttttgaaatgcaactctccctttaacaaaagccccaggtccacccacagttctgaaattcagaatgaagacaaatcagttatcaggtttgaagtctatttcagttgattcaaggggttaaaagattcaaattcgtttccataatgaatctaacagcaagaaattaaggaatcttgaaacaacagtaatattattcagaacatctatggattactttttaatgcttcattctctctctagtgcagcaggattttcttttttctgggtggaggggaagggggccagagtttcactcttgttgcccaggctggagtgcagtggcacaaccttggttcactgtaacctctgcctccttggttcaggtgattctcctgcctcagcctcccaagtagctgggattacaggcgtccaccaccacacctggctaattttttgtatttttagtagagatggggtttcaacatgttggccaggctggtctcaagctcccgaccgcagttgatccacacacctcggcctcccaaagtgctgggattacaggtgtgagccaccgcgcctggccatgcagcagaattttcaataaagagaaaggactaaagaacctaaacagttacagttatttatagagaataactgttgcgagttaagaaattaaagactttcttgatctattttaagtgtttttgcctttcatctttgttttttgtaagcttgtgtttattttgatccaatcacttattttttcccctctacgtacaatttactgtcataattgttaggtggttggaagtgtctccattaagaataacaaaagcattcaattcgtgctttttccaggtcctctcctggaagcttgtgcctgacaattaccccccaggtgaccagccgcctccaccctcttacatttatggggcacaacatttgctgcgattgtttggtaagaatcctggttcctgccttctttccatttttcattttgtattctcttgttagctttctgtacaccttgtggtttgggctataattatctaactaagaaatttggggatccaagaaaaattaaaagtaatctatcaaagaaaaggcattgaatgaatcttaaatttcataaaaattatgtttgtaatatttgtactgctactctgtctttgttcagtaagagtttggggatttgtttgataatgtggatgttaatttcagttccagtagagataaggaggggcccagaccttccctgagtgaatcctatgcattgtcagattctgctaattgtaaatggttttgcctttatttttaatgcagtgaaacttccagaaatccttggaaagatgtccttttctgagaagaatctgaaggctttattgaagcactttgatctctttttgaggtatttttattattttgtcaaaacttacacctgttgccatatatgtggcttttctgaacttctctttagcacatggggaagtcagctctgtgatattttaaatagtagaagtattacctaagcatggttggttctaaccgtaatgggaattaggagtgggtttttttggtatttcttttttccataatttctctggtttctgagttaggggcattcattgtacagaggtgaagtttttttgtctcactagaagaatttaatttaaaaaaaccttataaatagaaaataaattttctaaagtagaagtgattgagattgatgataatttagttttacatttttttattcaacagtacctcaagtagtggactttcctttgttgcatgtacataaactaacttaaatagtagcatttataggttggatttcggtgtttactttagaattaagagaaaagaccccttgtctgtgttgtcatgtatgaattcagaccaaggtattgtttcctgcagctgacaaagccagtcatttttttatctaataggatcatttgatctgaggctctgctgtgtcctctcccttccagatgatgtctatggaccactttctctccttggccttcaaggctagttgtccccctgcctcacccagctcatcctagctacctgactttgtttcttccttctctttaaggagtatctcttccttgtatccaggccccaccctgacttatcaagtaggatttaccacagagtggagagtatcccagccagggaaatcgtcttgtggttttaagagatcctttcatgtaggcattttgaataaagtgtccatgagtggaattagacttcacaacattttcttggaaacaagtttccaaaagaccctcttccctcccagcctcttcctcaacaaaacccacaactctgtttggcataaaattttgtaaactgaaatcaaatagtgccaagaaaatatgaagagtcagttgcaggatagcataggaaatcctgctaattttgatgcatgcctaatacaaaatagaaattagaattttaggaagtaacttaggaggacttactaataaacctagtaagaggttttaaaaacgtattcgaagatatcaaccagaatcaatggactcaataatgatcataaaaagagtacactcatagaagaaaaagagttagctatccaatgagttttgactcaatttatactgaagaaggtttgcacatttttaggaatttgggcaggtgggagtcactgggaagcaagcataaggcaaatgtgcttattagtgaatattgcacatgtgagaatgtcttagccctccatggcaaaatcagttgaagtttgagtcaagatatcatatgtatattgaagattcttgaatgaccagcacatttttaacatccgtcttcatacatatgagtctttcctgtgtcttggtactgttagctagaactgtaacatgttttggcatggcaaattaggacaccaaatgccattactagttgttctgttcaatttttgtatgactttgctcatataaatgatgtacatttctgaagtgagatttattgtttataatcgttttttattttttattttgtttatttatttatttttgagacggagtcttgctctgtcgcctgggctggagtgcagtggcgtgatctcggctcactgcaagctctgcctcccaggttcatgccattctcctgcctcagcctcccgagtagctgggactacaggcacccgccaccacgcccagctaattttttgtgtttttagtagagacggggtttcactgtgttagccaggatgttctcgatctcctgacctcgtgaccacctgcctcggcctcccaaagtgctgggattacaggcgtgaaccacagtgcccagcctataatctgttgtttttaatagtttgtttgaacaacagaaaaatgtagaaacattcatgggcttttttttttccgcccccaacagaagtgtttatataaccagactgccacctagtggagtgtaggttctgtttccatttgtacacctgatgatggtgaaggcattcagataagtagtaattcacatagaagctggataagtgcagtgaaaataatcagtatagagagatcaaaattatagtcatttttttcttcctaataccaaaaaacagttgaaatgttagtaggttgaaagtcaatattttgcttgatggtatttagtccttagtatggtgctcattggggctattttttttttccaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggtttta

SEQ ID NO: 4277 - DNA, 16978 bp, human
cgatgagcaaatgagcgcgagcgagggcatgaaatttaaattccactcaggggagaaagtgctgtgcttcgagcctgaccccaccaaggcgcgagtgctgtacgatgccaaggtgccgccgcggagggacagggaggaggcgcgggctgggggacccgggaccgggggcgggggcgggggcggacggccgcgcggagctgagggaccggccgggctcctcggcctgcgaggagcggtgcggccggcagggggcgctcacagggcgctacgcccgggagtcggggcggggtctgggatgcttccacttccttccgtcaggccgggcggcgcacgcgcggttgggagcctcgcccatgctttgtcgcgttaccggggctaccgtttgcgcccccgactgcaacggtggccgctgagggaggaggcttctcgaatacggtttctgtcttcgcgttaaatgtctccttctgtgcggcctggtgccgggtgggctcctgtgggacgccctggccgtccgatccaggttctaattcatagttacacggcgctggccgctgacttgcgacgttgtgtccctgggaccctagtccagtttaggccccatcccgcctgtaggccgtgaaccccatcccgagggcaaggttggcccagtgttttcgtaccccagggccttgcagcatttacgttttcaaactctgaaggatttacgtgggtctgaccatagttgatgggaatcgcgccccgggccggtccacctaagtctccgggagctgagccacatcttgcagctcctcagatttgggtggcgggcaggagttggcaccaggtctcccagatccccaaggaaagcacccaggtgctttcatttcagagacctgggttcctagggccacctgggcgaagccttaggcggcagggacaggggcagtcccaggtgtgtctttggcgatgtctggacagctctgtccattagagatgctaaaggacatccctaaagggatgagcatattctgccttcagttccctcccctgctgctcctgtcttttaaccgcgtctgctatccctctttctcctcgccctccagcctcctcggggcggaggggggggggcacgccccatcattagttttagttgttccctctagggacacaacagggagggattccagagtctccagctagccatcctggcactggacataggggagcccaggagactacaactcccagagctctcagggctgcagctttcatctagcctggagtctctccttagtgacaaatcggctggccaatggcttcagaagcctcacactgtctcacgctcagagaccaatcacggggtggttggacggatgtttcctattttgaaggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaaggtgagtgaacttgttaaaccagactgaaaattgattgtctttgctgcatagaaacattgcagacttaagtttcagaaacacttgtagagaagtttgtttcatttcctgcttttactttgtagcattgcaaacttctttaagtttttgaaacacttgtagagaagtttgtttcatttcctgtctttactttgtagcgttgcaaacttctttaagttttagaaacacttgtagagaagtttgattcatttcctgtttttactttgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggaggatgattgttactacattaacaggaggaaacgggtatgtagggagaatgtataaaacattaatttgtttggcattttcattttgccatagtttgcaatcatagacgtaagcaatagcgaatcttggtggaacgaaatttatatttttcagctttgtattgagtcaggttttaaagttctctgccagtggtgctgtgcagctgataaaaattgaaactcacacagctctggctgcccattagggttgtgttgggagctttccagaatgctgctgcttgtgcttcagcccagaaattaagaattaattgatctgtggtggagtccaactgcaggtatacttgaagaagttccccaggttgttctcacagatcactgagattaagaatcactgcttacatctattcaaaaaagtaatattgtaatctacataaggttatgatcagtagagaaaaaaagatcaaagagattgcgaacatatttaagaagttctattcaaacagaattggctttggtttatttttgagttaaaaaatgatacagacatgaccagtgtttcttggaatatgtggtttgttacattaggatgcatacatcagatgtctatgtttttgttaacagttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaagtgagtactggcatgtttggtgttttgtggttctctctgtattagagaggtggcttccatttagaacaggtgacacttgtctctattccgttattttgaattcatttaatatttaataatttattgataattcattgaatcatctaatattaaaaccttgtcacttttgtgaaatcttcagtacttcaataactatttacacatcttacatggatgcattgaaagtgcactgcctcagcactgagacagttttttcagtgatactgtttagggcgagaactttccttgagaagcaccagaatgggcagtgaggatttctcaaagcttgtttacaaacaggttttcattccagtcagagaaagcttccttgtatcctgcctggtacacatgacccagctagatgagaggcagaaaggtggagtgttggagttaaagcaagggttagggattcactagggtcaacccgtttcagcttgcagtgataggggtgtgtccacctgtccacttttgcagcacaggctgctggacacctcgtgtggcctcaaacatatttatttgtgtttaatggggtaagttaaagtgactgctgtattttctgcactttatgttttcctatgtaatcttgacagtagctacaaatccatttcattttgtgtgtatgtaggtgtagtatataatgattagatttaaaactgccctattaaaaatcggcaacttcattgtgaacatttggaaagtacctcttacttgtgtctctaatctcttctttttaatcctcccagtgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggtaagttatatagcctgcactttcaccctcacatgtcagcagtacaatgatcagatccttgttttgaagagttcaatctgatggtgtgggccaacatgtttggaggagggaaggaaatgaaaagtgtgtgtcctggtggttttcttttttcctgggtaagctaagtcatcattcactttcatatggctctggcagattttaccaagtgaagaccccagcatagagaacttaggtgggatgatgagcagctctcccattttggggaagacggtagtgggtggggtgaagagagcacaggccggggagggtggaaggggcaggtttgaattgagtcccctcactggctgtttgtgttagttgcagaggtttcttaggagcctccttcttttgcaggtgtgggatggacggaaggcaggcctagctagtagtattaaatgggaatgttcacacagggcctgcaaactttggccttcagtaaaagttacttctcttcttgctctgcgatgtcaccacttttcctccctcagttaccgagcatgctctgttcttttttgagggggcagggagggggatcctgcaacctaaagtctttcccttaatctctataaggtattgtgctcgctccctcttccctctcttcctgagagagtggtctgttctcatgatttccactcatctgtctcctctgttaaccacttattatctgccttcatctactgctgtgctgcaaaactttgcctgcacgtgaactgataacctcccacttgcagtgtgctgccctttttctcggccaccttgccctgccctccctttctccctctgcttcatggctgtcagctccccagcttctctttccgcctggccgccatctcctctcagccatccttcctttggtagcttctctctctcctttccctttccccatgtcagtttcaccccaggtgagaggcctgcaggactcactggggacctatgtcaaagtccccagggcctacttcaaaccttgagactcctccggggtgggttgtgtgttttcacacagcaaccccaatgcttttcttagtcctgccagtagttacgtttcaacgaggtggtagggtattcttgttctctagaccagcgtttctcagcctcggccctattgatgttttgaatcagatctttctttgttgtggggctgcctgtgcaatataggatgtttagcagaattagtggccttcacccactagatgcggataacacctctttcctcagttgcagcaaccaaaattgtctccagacattgccatctgttccctgtcagggcaacattgctcccacttgagacccactgctctaagacacatataacaggggcatcacaatctttaatgccagcgtgccttgcagagttatggagagggtccaagtgacttcggtacatatttacgaccctcctggagtagagagagcatttcgtgtcttcagaagcactccatgttctggaaaggccctttgagccatgtgtgacatcctccatcttccctaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtttctctttgtactttttattttttatttgtatttattgatgtgaaattcacatataaaattaaccattgtaaagtgaataattcagtggcacttaacagcttcattgacacatccacatatacagttcaatccagtagtttttagtgtattcacagagttgtgcgaccatctgcacagtcaattccagaacattttcagcacccccccacgagaaaccccatacccagtagcaatcactccccacttccccttctgcaagctcctggcaaccactaagctgctttcggtctctctggatttgcctaccctgggtatttcatataaatggaaacatagtatgtggccctttgtgattggctccattcactaagcatagtcttttaaggttcatccacattgtagcatatgtcagtgctttattccttatttttttaaccaaataaaattcaggtgctatctgttaggaaagtcttatcgttaaaggttggtaatttctgagaaccaagtttagatttatgttctgcagtttttaacagtcttgaggcagtctttaattcagttgctgtgtgaataatttcatctttttctttggaagagacacctgtgcatagcagatcatcttcacctattcctctgactcctagcaaggaagggagtgctgtgtttgctggctttgaagggagaagaactaatgaaataaacgaggtaaagaatgtttgatgtttgttcccaatggttcctttatttgtgattacttcaattctataggtggaagtcaaggttcttaaagcatcatgttgctgctattactgtaaacattatcaaaattgtacgtaattttatgcttaacactgtgggttttggtttctaaagtgagaaaattgttaggattccagccctacactgacaatcatcttttaaataagtgcaattattgaaataccagtatttttactttatagaacagatgtcaatttccacagagggccagagggtaaatactttcggctttgtgggccatatggtgtctgtcaaggctacttaactccaaaagtagccacagatagtatgtaaataaaatgagtgtgctatattccaataaaacttgatttatggacactgaaatttgactagcatttaattttcatgtgtttgaaaattttttttgtttttcaatcatttaaaaatataacatccactcttagcttgtgggcaatatagaaacaggcagtagttgggcgggatgtgaccagcaggctgtagtttgctgactcctactttaaatccctgattcccctccatcattaacagtaataccaatagccgtcccttcagggatgggctctaggccaccactgtgccagacacttgaaccaaatactttgaattctcgagatcagccttgccaccagatttccacttgatagatgggaaaacttttcattttaaaactatttttaaggcccattaggtgatctgtaggtggtgagtttgtcagggattctgaagacgtctcagtttatcagcatattctgtgaacgtctcctaggaggtgagatttcctctttttttaaggtgagtaggagttgcacaagggaaaatggctttgctaggcaaagaacatttttttctttttttgacacagggtctcactctcatgctgtcacccaggctgcagtgcagtggcaggatgttagctcactgcagcctctgcctcctgggctcaggcgatcctcccacctcagcctcctgagtagctggaactacaggctcatgccaccatggcctggctaatttttgcatttttttgtagagactaagttttgccatgttgcccagcctggtcaccaactcctgagctcaagtgatcctcccgcctctgcctcccaaagtgctggggttacaggcatgagccactgtgcccagcctaggcaaagagcacttgatgatgggaagagaagtcacaaaactttcttccagacgataactgtcttcagtagtgtgtaccctaaggtctcttgagagactgctcaactctgctgttccagcaggaaagccctaaacaaagggacgtggctctgccataaacaaaggggtgtggctctgtgtgctgcccccttaattcattcatggacactgagaatttaatgtcatgtgattttcacatatcacaaaatattattcgtatgattttttttccccaaccattttgaacatatgagcatggggctggatttggcctaggggctacagttggctgaccccatagagaatctagaaagcctaatttgtgttatgatgattgttgagggtaggttaggaaatccctagttcaagcagtccctgacatgcccatttttcagataagaatgcactacgaattttattattgaggggaaatcgtgaatttaaggggcatctgagttgtcaagtaagggctattcccactccggtctgcagtgcgaatgcgccatctagtggttataggtacagctgcaacttatagtttgaaagtgctttctgggaaatggttggggttcaggcggctctcacaaggactcatgagaccttcgtggattcccaccttcttacgtacgtctaccaccgtgttttttgaccagggctctttctctcagttccaatcgctgctccacagtactaggggctggtctgggccagcacatgccagtaaaggtccatcaatgattcccatgcataccccactgggaatcccccgactagaaacctaccatttttccccggaaaatgtgtcttcataaatagaagattataaactgccttgaaacacagaattgagtgagtgagatagagccagatgacctgcttttgtacgtgccaagtgctgttcatgcctctgagattgcaaagtcctgtatgtttcctttgagtcactttcagaatggttccaaagcttcagctgtgtgcactgggcaggtgctggggatgctgtaaagatgctggaacgatcccttccctcagtgctccacagtgcagaagtggggcgctgggggtggagacctaggcgagagtctaggcctgtctaggcaggggccaaagtgaagctaggcctttgttctggatccttcagggccaccttggtgcttattagcttctggcagttccatgttgttaaactgactatatcagtgtttctgagtttgtgggggcatctttctttctgctttgtctgctggtggacttcctccagtctgactgtttccatattgaatatgacgtcccaaaagccaaagtagcagctcagtagagtaggctctggttctataatttgctgaagtacttttacggaaattcatcagagagttttgaaatgcaactctccctttaacaaaagccccaggtccacccacagttctgaaattcagaatgaagacaaatcagttatcaggtttgaagtctatttcagttgattcaaggggttaaaagattcaaattcgtttccataatgaatctaacagcaagaaattaaggaatcttgaaacaacagtaatattattcagaacatctatggattactttttaatgcttcattctctctctagtgcagcaggattttcttttttctgggtggaggggaagggggccagagtttcactcttgttgcccaggctggagtgcagtggcacaaccttggttcactgtaacctctgcctccttggttcaggtgattctcctgcctcagcctcccaagtagctgggattacaggcgtccaccaccacacctggctaattttttgtatttttagtagagatggggtttcaacatgttggccaggctggtctcaagctcccgaccgcagttgatccacacacctcggcctcccaaagtgctgggattacaggtgtgagccaccgcgcctggccatgcagcagaattttcaataaagagaaaggactaaagaacctaaacagttacagttatttatagagaataactgttgcgagttaagaaattaaagactttcttgatctattttaagtgtttttgcctttcatctttgttttttgtaagcttgtgtttattttgatccaatcacttattttttcccctctacgtacaatttactgtcataattgttaggtggttggaagtgtctccattaagaataacaaaagcattcaattcgtgctttttccaggtcctctcctggaagcttgtgcctgacaattaccccccaggtgaccagccgcctccaccctcttacatttatggggcacaacatttgctgcgattgtttggtaagaatcctggttcctgccttctttccatttttcattttgtattctcttgttagctttctgtacaccttgtggtttgggctataattatctaactaagaaatttggggatccaagaaaaattaaaagtaatctatcaaagaaaaggcattgaatgaatcttaaatttcataaaaattatgtttgtaatatttgtactgctactctgtctttgttcagtaagagtttggggatttgtttgataatgtggatgttaatttcagttccagtagagataaggaggggcccagaccttccctgagtgaatcctatgcattgtcagattctgctaattgtaaatggttttgcctttatttttaatgcagtgaaacttccagaaatccttggaaagatgtccttttctgagaagaatctgaaggctttattgaagcactttgatctctttttgaggtatttttattattttgtcaaaacttacacctgttgccatatatgtggcttttctgaacttctctttagcacatggggaagtcagctctgtgatattttaaatagtagaagtattacctaagcatggttggttctaaccgtaatgggaattaggagtgggtttttttggtatttcttttttccataatttctctggtttctgagttaggggcattcattgtacagaggtgaagtttttttgtctcactagaagaatttaatttaaaaaaaccttataaatagaaaataaattttctaaagtagaagtgattgagattgatgataatttagttttacatttttttattcaacagtacctcaagtagtggactttcctttgttgcatgtacataaactaacttaaatagtagcatttataggttggatttcggtgtttactttagaattaagagaaaagaccccttgtctgtgttgtcatgtatgaattcagaccaaggtattgtttcctgcagctgacaaagccagtcatttttttatctaataggatcatttgatctgaggctctgctgtgtcctctcccttccagatgatgtctatggaccactttctctccttggccttcaaggctagttgtccccctgcctcacccagctcatcctagctacctgactttgtttcttccttctctttaaggagtatctcttccttgtatccaggccccaccctgacttatcaagtaggatttaccacagagtggagagtatcccagccagggaaatcgtcttgtggttttaagagatcctttcatgtaggcattttgaataaagtgtccatgagtggaattagacttcacaacattttcttggaaacaagtttccaaaagaccctcttccctcccagcctcttcctcaacaaaacccacaactctgtttggcataaaattttgtaaactgaaatcaaatagtgccaagaaaatatgaagagtcagttgcaggatagcataggaaatcctgctaattttgatgcatgcctaatacaaaatagaaattagaattttaggaagtaacttaggaggacttactaataaacctagtaagaggttttaaaaacgtattcgaagatatcaaccagaatcaatggactcaataatgatcataaaaagagtacactcatagaagaaaaagagttagctatccaatgagttttgactcaatttatactgaagaaggtttgcacatttttaggaatttgggcaggtgggagtcactgggaagcaagcataaggcaaatgtgcttattagtgaatattgcacatgtgagaatgtcttagccctccatggcaaaatcagttgaagtttgagtcaagatatcatatgtatattgaagattcttgaatgaccagcacatttttaacatccgtcttcatacatatgagtctttcctgtgtcttggtactgttagctagaactgtaacatgttttggcatggcaaattaggacaccaaatgccattactagttgttctgttcaatttttgtatgactttgctcatataaatgatgtacatttctgaagtgagatttattgtttataatcgttttttattttttattttgtttatttatttatttttgagacggagtcttgctctgtcgcctgggctggagtgcagtggcgtgatctcggctcactgcaagctctgcctcccaggttcatgccattctcctgcctcagcctcccgagtagctgggactacaggcacccgccaccacgcccagctaattttttgtgtttttagtagagacggggtttcactgtgttagccaggatgttctcgatctcctgacctcgtgaccacctgcctcggcctcccaaagtgctgggattacaggcgtgaaccacagtgcccagcctataatctgttgtttttaatagtttgtttgaacaacagaaaaatgtagaaacattcatgggcttttttttttccgcccccaacagaagtgtttatataaccagactgccacctagtggagtgtaggttctgtttccatttgtacacctgatgatggtgaaggcattcagataagtagtaattcacatagaagctggataagtgcagtgaaaataatcagtatagagagatcaaaattatagtcatttttttcttcctaataccaaaaaacagttgaaatgttagtaggttgaaagtcaatattttgcttgatggtatttagtccttagtatggtgctcattggggctattttttttttccaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagt

SEQ ID NO: 4278 - DNA, 4029 bp, human
gttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggaggatgattgttactacattaacaggaggaaacgggtatgtagggagaatgtataaaacattaatttgtttggcattttcattttgccatagtttgcaatcatagacgtaagcaatagcgaatcttggtggaacgaaatttatatttttcagctttgtattgagtcaggttttaaagttctctgccagtggtgctgtgcagctgataaaaattgaaactcacacagctctggctgcccattagggttgtgttgggagctttccagaatgctgctgcttgtgcttcagcccagaaattaagaattaattgatctgtggtggagtccaactgcaggtatacttgaagaagttccccaggttgttctcacagatcactgagattaagaatcactgcttacatctattcaaaaaagtaatattgtaatctacataaggttatgatcagtagagaaaaaaagatcaaagagattgcgaacatatttaagaagttctattcaaacagaattggctttggtttatttttgagttaaaaaatgatacagacatgaccagtgtttcttggaatatgtggtttgttacattaggatgcatacatcagatgtctatgtttttgttaacagttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaagtgagtactggcatgtttggtgttttgtggttctctctgtattagagaggtggcttccatttagaacaggtgacacttgtctctattccgttattttgaattcatttaatatttaataatttattgataattcattgaatcatctaatattaaaaccttgtcacttttgtgaaatcttcagtacttcaataactatttacacatcttacatggatgcattgaaagtgcactgcctcagcactgagacagttttttcagtgatactgtttagggcgagaactttccttgagaagcaccagaatgggcagtgaggatttctcaaagcttgtttacaaacaggttttcattccagtcagagaaagcttccttgtatcctgcctggtacacatgacccagctagatgagaggcagaaaggtggagtgttggagttaaagcaagggttagggattcactagggtcaacccgtttcagcttgcagtgataggggtgtgtccacctgtccacttttgcagcacaggctgctggacacctcgtgtggcctcaaacatatttatttgtgtttaatggggtaagttaaagtgactgctgtattttctgcactttatgttttcctatgtaatcttgacagtagctacaaatccatttcattttgtgtgtatgtaggtgtagtatataatgattagatttaaaactgccctattaaaaatcggcaacttcattgtgaacatttggaaagtacctcttacttgtgtctctaatctcttctttttaatcctcccagtgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggtaagttatatagcctgcactttcaccctcacatgtcagcagtacaatgatcagatccttgttttgaagagttcaatctgatggtgtgggccaacatgtttggaggagggaaggaaatgaaaagtgtgtgtcctggtggttttcttttttcctgggtaagctaagtcatcattcactttcatatggctctggcagattttaccaagtgaagaccccagcatagagaacttaggtgggatgatgagcagctctcccattttggggaagacggtagtgggtggggtgaagagagcacaggccggggagggtggaa

SEQ ID NO: 4279 - DNA, 4371 bp, human
cgcggttgggagcctcgcccatgctttgtcgcgttaccggggctaccgtttgcgcccccgactgcaacggtggccgctgagggaggaggcttctcgaatacggtttctgtcttcgcgttaaatgtctccttctgtgcggcctggtgccgggtgggctcctgtgggacgccctggccgtccgatccaggttctaattcatagttacacggcgctggccgctgacttgcgacgttgtgtccctgggaccctagtccagtttaggccccatcccgcctgtaggccgtgaaccccatcccgagggcaaggttggcccagtgttttcgtaccccagggccttgcagcatttacgttttcaaactctgaaggatttacgtgggtctgaccatagttgatgggaatcgcgccccgggccggtccacctaagtctccgggagctgagccacatcttgcagctcctcagatttgggtggcgggcaggagttggcaccaggtctcccagatccccaaggaaagcacccaggtgctttcatttcagagacctgggttcctagggccacctgggcgaagccttaggcggcagggacaggggcagtcccaggtgtgtctttggcgatgtctggacagctctgtccattagagatgctaaaggacatccctaaagggatgagcatattctgccttcagttccctcccctgctgctcctgtcttttaaccgcgtctgctatccctctttctcctcgccctccagcctcctcggggcggaggggggggggcacgccccatcattagttttagttgttccctctagggacacaacagggagggattccagagtctccagctagccatcctggcactggacataggggagcccaggagactacaactcccagagctctcagggctgcagctttcatctagcctggagtctctccttagtgacaaatcggctggccaatggcttcagaagcctcacactgtctcacgctcagagaccaatcacggggtggttggacggatgtttcctattttgaaggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaaggtgagtgaacttgttaaaccagactgaaaattgattgtctttgctgcatagaaacattgcagacttaagtttcagaaacacttgtagagaagtttgtttcatttcctgcttttactttgtagcattgcaaacttctttaagtttttgaaacacttgtagagaagtttgtttcatttcctgtctttactttgtagcgttgcaaacttctttaagttttagaaacacttgtagagaagtttgattcatttcctgtttttactttgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggaggatgattgttactacattaacaggaggaaacgggtatgtagggagaatgtataaaacattaatttgtttggcattttcattttgccatagtttgcaatcatagacgtaagcaatagcgaatcttggtggaacgaaatttatatttttcagctttgtattgagtcaggttttaaagttctctgccagtggtgctgtgcagctgataaaaattgaaactcacacagctctggctgcccattagggttgtgttgggagctttccagaatgctgctgcttgtgcttcagcccagaaattaagaattaattgatctgtggtggagtccaactgcaggtatacttgaagaagttccccaggttgttctcacagatcactgagattaagaatcactgcttacatctattcaaaaaagtaatattgtaatctacataaggttatgatcagtagagaaaaaaagatcaaagagattgcgaacatatttaagaagttctattcaaacagaattggctttggtttatttttgagttaaaaaatgatacagacatgaccagtgtttcttggaatatgtggtttgttacattaggatgcatacatcagatgtctatgtttttgttaacagttagtgaaacttccatgccagaccaacatcataacgattttggaatcctatgtgaagcattttgctatcaatgcagccttttcagccaatgagaggcctcgtcaccatcacgttatgccac

SEQ ID NO: 4280 - DNA, 8209 bp, human
gcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggaggatgattgttactacattaacaggaggaaacgggtatgtagggagaatgtataaaacattaatttgtttggcattttcattttgccatagtttgcaatcatagacgtaagcaatagcgaatcttggtggaacgaaatttatatttttcagctttgtattgagtcaggttttaaagttctctgccagtggtgctgtgcagctgataaaaattgaaactcacacagctctggctgcccattagggttgtgttgggagctttccagaatgctgctgcttgtgcttcagcccagaaattaagaattaattgatctgtggtggagtccaactgcaggtatacttgaagaagttccccaggttgttctcacagatcactgagattaagaatcactgcttacatctattcaaaaaagtaatattgtaatctacataaggttatgatcagtagagaaaaaaagatcaaagagattgcgaacatatttaagaagttctattcaaacagaattggctttggtttatttttgagttaaaaaatgatacagacatgaccagtgtttcttggaatatgtggtttgttacattaggatgcatacatcagatgtctatgtttttgttaacagttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaagtgagtactggcatgtttggtgttttgtggttctctctgtattagagaggtggcttccatttagaacaggtgacacttgtctctattccgttattttgaattcatttaatatttaataatttattgataattcattgaatcatctaatattaaaaccttgtcacttttgtgaaatcttcagtacttcaataactatttacacatcttacatggatgcattgaaagtgcactgcctcagcactgagacagttttttcagtgatactgtttagggcgagaactttccttgagaagcaccagaatgggcagtgaggatttctcaaagcttgtttacaaacaggttttcattccagtcagagaaagcttccttgtatcctgcctggtacacatgacccagctagatgagaggcagaaaggtggagtgttggagttaaagcaagggttagggattcactagggtcaacccgtttcagcttgcagtgataggggtgtgtccacctgtccacttttgcagcacaggctgctggacacctcgtgtggcctcaaacatatttatttgtgtttaatggggtaagttaaagtgactgctgtattttctgcactttatgttttcctatgtaatcttgacagtagctacaaatccatttcattttgtgtgtatgtaggtgtagtatataatgattagatttaaaactgccctattaaaaatcggcaacttcattgtgaacatttggaaagtacctcttacttgtgtctctaatctcttctttttaatcctcccagtgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggtaagttatatagcctgcactttcaccctcacatgtcagcagtacaatgatcagatccttgttttgaagagttcaatctgatggtgtgggccaacatgtttggaggagggaaggaaatgaaaagtgtgtgtcctggtggttttcttttttcctgggtaagctaagtcatcattcactttcatatggctctggcagattttaccaagtgaagaccccagcatagagaacttaggtgggatgatgagcagctctcccattttggggaagacggtagtgggtggggtgaagagagcacaggccggggagggtggaaggggcaggtttgaattgagtcccctcactggctgtttgtgttagttgcagaggtttcttaggagcctccttcttttgcaggtgtgggatggacggaaggcaggcctagctagtagtattaaatgggaatgttcacacagggcctgcaaactttggccttcagtaaaagttacttctcttcttgctctgcgatgtcaccacttttcctccctcagttaccgagcatgctctgttcttttttgagggggcagggagggggatcctgcaacctaaagtctttcccttaatctctataaggtattgtgctcgctccctcttccctctcttcctgagagagtggtctgttctcatgatttccactcatctgtctcctctgttaaccacttattatctgccttcatctactgctgtgctgcaaaactttgcctgcacgtgaactgataacctcccacttgcagtgtgctgccctttttctcggccaccttgccctgccctccctttctccctctgcttcatggctgtcagctccccagcttctctttccgcctggccgccatctcctctcagccatccttcctttggtagcttctctctctcctttccctttccccatgtcagtttcaccccaggtgagaggcctgcaggactcactggggacctatgtcaaagtccccagggcctacttcaaaccttgagactcctccggggtgggttgtgtgttttcacacagcaaccccaatgcttttcttagtcctgccagtagttacgtttcaacgaggtggtagggtattcttgttctctagaccagcgtttctcagcctcggccctattgatgttttgaatcagatctttctttgttgtggggctgcctgtgcaatataggatgtttagcagaattagtggccttcacccactagatgcggataacacctctttcctcagttgcagcaaccaaaattgtctccagacattgccatctgttccctgtcagggcaacattgctcccacttgagacccactgctctaagacacatataacaggggcatcacaatctttaatgccagcgtgccttgcagagttatggagagggtccaagtgacttcggtacatatttacgaccctcctggagtagagagagcatttcgtgtcttcagaagcactccatgttctggaaaggccctttgagccatgtgtgacatcctccatcttccctaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtttctctttgtactttttattttttatttgtatttattgatgtgaaattcacatataaaattaaccattgtaaagtgaataattcagtggcacttaacagcttcattgacacatccacatatacagttcaatccagtagtttttagtgtattcacagagttgtgcgaccatctgcacagtcaattccagaacattttcagcacccccccacgagaaaccccatacccagtagcaatcactccccacttccccttctgcaagctcctggcaaccactaagctgctttcggtctctctggatttgcctaccctgggtatttcatataaatggaaacatagtatgtggccctttgtgattggctccattcactaagcatagtcttttaaggttcatccacattgtagcatatgtcagtgctttattccttatttttttaaccaaataaaattcaggtgctatctgttaggaaagtcttatcgttaaaggttggtaatttctgagaaccaagtttagatttatgttctgcagtttttaacagtcttgaggcagtctttaattcagttgctgtgtgaataatttcatctttttctttggaagagacacctgtgcatagcagatcatcttcacctattcctctgactcctagcaaggaagggagtgctgtgtttgctggctttgaagggagaagaactaatgaaataaacgaggt

SEQ ID NO: 4281 - DNA, 3637 bp, human
cacgcgcggttgggagcctcgcccatgctttgtcgcgttaccggggctaccgtttgcgcccccgactgcaacggtggccgctgagggaggaggcttctcgaatacggtttctgtcttcgcgttaaatgtctccttctgtgcggcctggtgccgggtgggctcctgtgggacgccctggccgtccgatccaggttctaattcatagttacacggcgctggccgctgacttgcgacgttgtgtccctgggaccctagtccagtttaggccccatcccgcctgtaggccgtgaaccccatcccgagggcaaggttggcccagtgttttcgtaccccagggccttgcagcatttacgttttcaaactctgaaggatttacgtgggtctgaccatagttgatgggaatcgcgccccgggccggtccacctaagtctccgggagctgagccacatcttgcagctcctcagatttgggtggcgggcaggagttggcaccaggtctcccagatccccaaggaaagcacccaggtgctttcatttcagagacctgggttcctagggccacctgggcgaagccttaggcggcagggacaggggcagtcccaggtgtgtctttggcgatgtctggacagctctgtccattagagatgctaaaggacatccctaaagggatgagcatattctgccttcagttccctcccctgctgctcctgtcttttaaccgcgtctgctatccctctttctcctcgccctccagcctcctcggggcggaggggggggggcacgccccatcattagttttagttgttccctctagggacacaacagggagggattccagagtctccagctagccatcctggcactggacataggggagcccaggagactacaactcccagagctctcagggctgcagctttcatctagcctggagtctctccttagtgacaaatcggctggccaatggcttcagaagcctcacactgtctcacgctcagagaccaatcacggggtggttggacggatgtttcctattttgaaggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaaggtgagtgaacttgttaaaccagactgaaaattgattgtctttgctgcatagaaacattgcagacttaagtttcagaaacacttgtagagaagtttgtttcatttcctgcttttactttgtagcattgcaaacttctttaagtttttgaaacacttgtagagaagtttgtttcatttcctgtctttactttgtagcgttgcaaacttctttaagttttagaaacacttgtagagaagtttgattcatttcctgtttttactttgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggag

SEQ ID NO: 4282 - DNA, 2738 bp, human
tatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggaggatgattgttactacattaacaggaggaaacgggtatgtagggagaatgtataaaacattaatttgtttggcattttcattttgccatagtttgcaatcatagacgtaagcaatagcgaatcttggtggaacgaaatttatatttttcagctttgtattgagtcaggttttaaagttctctgccagtggtgctgtgcagctgataaaaattgaaactcacacagctctggctgcccattagggttgtgttgggagctttccagaatgctgctgcttgtgcttcagcccagaaattaagaattaattgatctgtggtggagtccaactgcaggtatacttgaagaagttccccaggttgttctcacagatcactgagattaagaatcactgcttacatctattcaaaaaagtaatattgtaatctacataaggttatgatcagtagagaaaaaaagatcaaagagattgcgaacatatttaagaagttctattcaaacagaattggctttggtttatttttgagttaaaaaatgatacagacatgaccagtgtttcttggaatatgtggtttgttacattaggatgcatacatcagatgtctatgtttttgttaacagttagtgaaacttccatgccagaccaacatcataacgattttggaatcctatgtgaagcattttgctatcaatgcagccttttcagcca

SEQ ID NO: 4283 - DNA, 16940 bp, human
aattccactcaggggagaaagtgctgtgcttcgagcctgaccccaccaaggcgcgagtgctgtacgatgccaaggtgccgccgcggagggacagggaggaggcgcgggctgggggacccgggaccgggggcgggggcgggggcggacggccgcgcggagctgagggaccggccgggctcctcggcctgcgaggagcggtgcggccggcagggggcgctcacagggcgctacgcccgggagtcggggcggggtctgggatgcttccacttccttccgtcaggccgggcggcgcacgcgcggttgggagcctcgcccatgctttgtcgcgttaccggggctaccgtttgcgcccccgactgcaacggtggccgctgagggaggaggcttctcgaatacggtttctgtcttcgcgttaaatgtctccttctgtgcggcctggtgccgggtgggctcctgtgggacgccctggccgtccgatccaggttctaattcatagttacacggcgctggccgctgacttgcgacgttgtgtccctgggaccctagtccagtttaggccccatcccgcctgtaggccgtgaaccccatcccgagggcaaggttggcccagtgttttcgtaccccagggccttgcagcatttacgttttcaaactctgaaggatttacgtgggtctgaccatagttgatgggaatcgcgccccgggccggtccacctaagtctccgggagctgagccacatcttgcagctcctcagatttgggtggcgggcaggagttggcaccaggtctcccagatccccaaggaaagcacccaggtgctttcatttcagagacctgggttcctagggccacctgggcgaagccttaggcggcagggacaggggcagtcccaggtgtgtctttggcgatgtctggacagctctgtccattagagatgctaaaggacatccctaaagggatgagcatattctgccttcagttccctcccctgctgctcctgtcttttaaccgcgtctgctatccctctttctcctcgccctccagcctcctcggggcggaggggggggggcacgccccatcattagttttagttgttccctctagggacacaacagggagggattccagagtctccagctagccatcctggcactggacataggggagcccaggagactacaactcccagagctctcagggctgcagctttcatctagcctggagtctctccttagtgacaaatcggctggccaatggcttcagaagcctcacactgtctcacgctcagagaccaatcacggggtggttggacggatgtttcctattttgaaggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaaggtgagtgaacttgttaaaccagactgaaaattgattgtctttgctgcatagaaacattgcagacttaagtttcagaaacacttgtagagaagtttgtttcatttcctgcttttactttgtagcattgcaaacttctttaagtttttgaaacacttgtagagaagtttgtttcatttcctgtctttactttgtagcgttgcaaacttctttaagttttagaaacacttgtagagaagtttgattcatttcctgtttttactttgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggaggatgattgttactacattaacaggaggaaacgggtatgtagggagaatgtataaaacattaatttgtttggcattttcattttgccatagtttgcaatcatagacgtaagcaatagcgaatcttggtggaacgaaatttatatttttcagctttgtattgagtcaggttttaaagttctctgccagtggtgctgtgcagctgataaaaattgaaactcacacagctctggctgcccattagggttgtgttgggagctttccagaatgctgctgcttgtgcttcagcccagaaattaagaattaattgatctgtggtggagtccaactgcaggtatacttgaagaagttccccaggttgttctcacagatcactgagattaagaatcactgcttacatctattcaaaaaagtaatattgtaatctacataaggttatgatcagtagagaaaaaaagatcaaagagattgcgaacatatttaagaagttctattcaaacagaattggctttggtttatttttgagttaaaaaatgatacagacatgaccagtgtttcttggaatatgtggtttgttacattaggatgcatacatcagatgtctatgtttttgttaacagttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaagtgagtactggcatgtttggtgttttgtggttctctctgtattagagaggtggcttccatttagaacaggtgacacttgtctctattccgttattttgaattcatttaatatttaataatttattgataattcattgaatcatctaatattaaaaccttgtcacttttgtgaaatcttcagtacttcaataactatttacacatcttacatggatgcattgaaagtgcactgcctcagcactgagacagttttttcagtgatactgtttagggcgagaactttccttgagaagcaccagaatgggcagtgaggatttctcaaagcttgtttacaaacaggttttcattccagtcagagaaagcttccttgtatcctgcctggtacacatgacccagctagatgagaggcagaaaggtggagtgttggagttaaagcaagggttagggattcactagggtcaacccgtttcagcttgcagtgataggggtgtgtccacctgtccacttttgcagcacaggctgctggacacctcgtgtggcctcaaacatatttatttgtgtttaatggggtaagttaaagtgactgctgtattttctgcactttatgttttcctatgtaatcttgacagtagctacaaatccatttcattttgtgtgtatgtaggtgtagtatataatgattagatttaaaactgccctattaaaaatcggcaacttcattgtgaacatttggaaagtacctcttacttgtgtctctaatctcttctttttaatcctcccagtgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggtaagttatatagcctgcactttcaccctcacatgtcagcagtacaatgatcagatccttgttttgaagagttcaatctgatggtgtgggccaacatgtttggaggagggaaggaaatgaaaagtgtgtgtcctggtggttttcttttttcctgggtaagctaagtcatcattcactttcatatggctctggcagattttaccaagtgaagaccccagcatagagaacttaggtgggatgatgagcagctctcccattttggggaagacggtagtgggtggggtgaagagagcacaggccggggagggtggaaggggcaggtttgaattgagtcccctcactggctgtttgtgttagttgcagaggtttcttaggagcctccttcttttgcaggtgtgggatggacggaaggcaggcctagctagtagtattaaatgggaatgttcacacagggcctgcaaactttggccttcagtaaaagttacttctcttcttgctctgcgatgtcaccacttttcctccctcagttaccgagcatgctctgttcttttttgagggggcagggagggggatcctgcaacctaaagtctttcccttaatctctataaggtattgtgctcgctccctcttccctctcttcctgagagagtggtctgttctcatgatttccactcatctgtctcctctgttaaccacttattatctgccttcatctactgctgtgctgcaaaactttgcctgcacgtgaactgataacctcccacttgcagtgtgctgccctttttctcggccaccttgccctgccctccctttctccctctgcttcatggctgtcagctccccagcttctctttccgcctggccgccatctcctctcagccatccttcctttggtagcttctctctctcctttccctttccccatgtcagtttcaccccaggtgagaggcctgcaggactcactggggacctatgtcaaagtccccagggcctacttcaaaccttgagactcctccggggtgggttgtgtgttttcacacagcaaccccaatgcttttcttagtcctgccagtagttacgtttcaacgaggtggtagggtattcttgttctctagaccagcgtttctcagcctcggccctattgatgttttgaatcagatctttctttgttgtggggctgcctgtgcaatataggatgtttagcagaattagtggccttcacccactagatgcggataacacctctttcctcagttgcagcaaccaaaattgtctccagacattgccatctgttccctgtcagggcaacattgctcccacttgagacccactgctctaagacacatataacaggggcatcacaatctttaatgccagcgtgccttgcagagttatggagagggtccaagtgacttcggtacatatttacgaccctcctggagtagagagagcatttcgtgtcttcagaagcactccatgttctggaaaggccctttgagccatgtgtgacatcctccatcttccctaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtttctctttgtactttttattttttatttgtatttattgatgtgaaattcacatataaaattaaccattgtaaagtgaataattcagtggcacttaacagcttcattgacacatccacatatacagttcaatccagtagtttttagtgtattcacagagttgtgcgaccatctgcacagtcaattccagaacattttcagcacccccccacgagaaaccccatacccagtagcaatcactccccacttccccttctgcaagctcctggcaaccactaagctgctttcggtctctctggatttgcctaccctgggtatttcatataaatggaaacatagtatgtggccctttgtgattggctccattcactaagcatagtcttttaaggttcatccacattgtagcatatgtcagtgctttattccttatttttttaaccaaataaaattcaggtgctatctgttaggaaagtcttatcgttaaaggttggtaatttctgagaaccaagtttagatttatgttctgcagtttttaacagtcttgaggcagtctttaattcagttgctgtgtgaataatttcatctttttctttggaagagacacctgtgcatagcagatcatcttcacctattcctctgactcctagcaaggaagggagtgctgtgtttgctggctttgaagggagaagaactaatgaaataaacgaggtaaagaatgtttgatgtttgttcccaatggttcctttatttgtgattacttcaattctataggtggaagtcaaggttcttaaagcatcatgttgctgctattactgtaaacattatcaaaattgtacgtaattttatgcttaacactgtgggttttggtttctaaagtgagaaaattgttaggattccagccctacactgacaatcatcttttaaataagtgcaattattgaaataccagtatttttactttatagaacagatgtcaatttccacagagggccagagggtaaatactttcggctttgtgggccatatggtgtctgtcaaggctacttaactccaaaagtagccacagatagtatgtaaataaaatgagtgtgctatattccaataaaacttgatttatggacactgaaatttgactagcatttaattttcatgtgtttgaaaattttttttgtttttcaatcatttaaaaatataacatccactcttagcttgtgggcaatatagaaacaggcagtagttgggcgggatgtgaccagcaggctgtagtttgctgactcctactttaaatccctgattcccctccatcattaacagtaataccaatagccgtcccttcagggatgggctctaggccaccactgtgccagacacttgaaccaaatactttgaattctcgagatcagccttgccaccagatttccacttgatagatgggaaaacttttcattttaaaactatttttaaggcccattaggtgatctgtaggtggtgagtttgtcagggattctgaagacgtctcagtttatcagcatattctgtgaacgtctcctaggaggtgagatttcctctttttttaaggtgagtaggagttgcacaagggaaaatggctttgctaggcaaagaacatttttttctttttttgacacagggtctcactctcatgctgtcacccaggctgcagtgcagtggcaggatgttagctcactgcagcctctgcctcctgggctcaggcgatcctcccacctcagcctcctgagtagctggaactacaggctcatgccaccatggcctggctaatttttgcatttttttgtagagactaagttttgccatgttgcccagcctggtcaccaactcctgagctcaagtgatcctcccgcctctgcctcccaaagtgctggggttacaggcatgagccactgtgcccagcctaggcaaagagcacttgatgatgggaagagaagtcacaaaactttcttccagacgataactgtcttcagtagtgtgtaccctaaggtctcttgagagactgctcaactctgctgttccagcaggaaagccctaaacaaagggacgtggctctgccataaacaaaggggtgtggctctgtgtgctgcccccttaattcattcatggacactgagaatttaatgtcatgtgattttcacatatcacaaaatattattcgtatgattttttttccccaaccattttgaacatatgagcatggggctggatttggcctaggggctacagttggctgaccccatagagaatctagaaagcctaatttgtgttatgatgattgttgagggtaggttaggaaatccctagttcaagcagtccctgacatgcccatttttcagataagaatgcactacgaattttattattgaggggaaatcgtgaatttaaggggcatctgagttgtcaagtaagggctattcccactccggtctgcagtgcgaatgcgccatctagtggttataggtacagctgcaacttatagtttgaaagtgctttctgggaaatggttggggttcaggcggctctcacaaggactcatgagaccttcgtggattcccaccttcttacgtacgtctaccaccgtgttttttgaccagggctctttctctcagttccaatcgctgctccacagtactaggggctggtctgggccagcacatgccagtaaaggtccatcaatgattcccatgcataccccactgggaatcccccgactagaaacctaccatttttccccggaaaatgtgtcttcataaatagaagattataaactgccttgaaacacagaattgagtgagtgagatagagccagatgacctgcttttgtacgtgccaagtgctgttcatgcctctgagattgcaaagtcctgtatgtttcctttgagtcactttcagaatggttccaaagcttcagctgtgtgcactgggcaggtgctggggatgctgtaaagatgctggaacgatcccttccctcagtgctccacagtgcagaagtggggcgctgggggtggagacctaggcgagagtctaggcctgtctaggcaggggccaaagtgaagctaggcctttgttctggatccttcagggccaccttggtgcttattagcttctggcagttccatgttgttaaactgactatatcagtgtttctgagtttgtgggggcatctttctttctgctttgtctgctggtggacttcctccagtctgactgtttccatattgaatatgacgtcccaaaagccaaagtagcagctcagtagagtaggctctggttctataatttgctgaagtacttttacggaaattcatcagagagttttgaaatgcaactctccctttaacaaaagccccaggtccacccacagttctgaaattcagaatgaagacaaatcagttatcaggtttgaagtctatttcagttgattcaaggggttaaaagattcaaattcgtttccataatgaatctaacagcaagaaattaaggaatcttgaaacaacagtaatattattcagaacatctatggattactttttaatgcttcattctctctctagtgcagcaggattttcttttttctgggtggaggggaagggggccagagtttcactcttgttgcccaggctggagtgcagtggcacaaccttggttcactgtaacctctgcctccttggttcaggtgattctcctgcctcagcctcccaagtagctgggattacaggcgtccaccaccacacctggctaattttttgtatttttagtagagatggggtttcaacatgttggccaggctggtctcaagctcccgaccgcagttgatccacacacctcggcctcccaaagtgctgggattacaggtgtgagccaccgcgcctggccatgcagcagaattttcaataaagagaaaggactaaagaacctaaacagttacagttatttatagagaataactgttgcgagttaagaaattaaagactttcttgatctattttaagtgtttttgcctttcatctttgttttttgtaagcttgtgtttattttgatccaatcacttattttttcccctctacgtacaatttactgtcataattgttaggtggttggaagtgtctccattaagaataacaaaagcattcaattcgtgctttttccaggtcctctcctggaagcttgtgcctgacaattaccccccaggtgaccagccgcctccaccctcttacatttatggggcacaacatttgctgcgattgtttggtaagaatcctggttcctgccttctttccatttttcattttgtattctcttgttagctttctgtacaccttgtggtttgggctataattatctaactaagaaatttggggatccaagaaaaattaaaagtaatctatcaaagaaaaggcattgaatgaatcttaaatttcataaaaattatgtttgtaatatttgtactgctactctgtctttgttcagtaagagtttggggatttgtttgataatgtggatgttaatttcagttccagtagagataaggaggggcccagaccttccctgagtgaatcctatgcattgtcagattctgctaattgtaaatggttttgcctttatttttaatgcagtgaaacttccagaaatccttggaaagatgtccttttctgagaagaatctgaaggctttattgaagcactttgatctctttttgaggtatttttattattttgtcaaaacttacacctgttgccatatatgtggcttttctgaacttctctttagcacatggggaagtcagctctgtgatattttaaatagtagaagtattacctaagcatggttggttctaaccgtaatgggaattaggagtgggtttttttggtatttcttttttccataatttctctggtttctgagttaggggcattcattgtacagaggtgaagtttttttgtctcactagaagaatttaatttaaaaaaaccttataaatagaaaataaattttctaaagtagaagtgattgagattgatgataatttagttttacatttttttattcaacagtacctcaagtagtggactttcctttgttgcatgtacataaactaacttaaatagtagcatttataggttggatttcggtgtttactttagaattaagagaaaagaccccttgtctgtgttgtcatgtatgaattcagaccaaggtattgtttcctgcagctgacaaagccagtcatttttttatctaataggatcatttgatctgaggctctgctgtgtcctctcccttccagatgatgtctatggaccactttctctccttggccttcaaggctagttgtccccctgcctcacccagctcatcctagctacctgactttgtttcttccttctctttaaggagtatctcttccttgtatccaggccccaccctgacttatcaagtaggatttaccacagagtggagagtatcccagccagggaaatcgtcttgtggttttaagagatcctttcatgtaggcattttgaataaagtgtccatgagtggaattagacttcacaacattttcttggaaacaagtttccaaaagaccctcttccctcccagcctcttcctcaacaaaacccacaactctgtttggcataaaattttgtaaactgaaatcaaatagtgccaagaaaatatgaagagtcagttgcaggatagcataggaaatcctgctaattttgatgcatgcctaatacaaaatagaaattagaattttaggaagtaacttaggaggacttactaataaacctagtaagaggttttaaaaacgtattcgaagatatcaaccagaatcaatggactcaataatgatcataaaaagagtacactcatagaagaaaaagagttagctatccaatgagttttgactcaatttatactgaagaaggtttgcacatttttaggaatttgggcaggtgggagtcactgggaagcaagcataaggcaaatgtgcttattagtgaatattgcacatgtgagaatgtcttagccctccatggcaaaatcagttgaagtttgagtcaagatatcatatgtatattgaagattcttgaatgaccagcacatttttaacatccgtcttcatacatatgagtctttcctgtgtcttggtactgttagctagaactgtaacatgttttggcatggcaaattaggacaccaaatgccattactagttgttctgttcaatttttgtatgactttgctcatataaatgatgtacatttctgaagtgagatttattgtttataatcgttttttattttttattttgtttatttatttatttttgagacggagtcttgctctgtcgcctgggctggagtgcagtggcgtgatctcggctcactgcaagctctgcctcccaggttcatgccattctcctgcctcagcctcccgagtagctgggactacaggcacccgccaccacgcccagctaattttttgtgtttttagtagagacggggtttcactgtgttagccaggatgttctcgatctcctgacctcgtgaccacctgcctcggcctcccaaagtgctgggattacaggcgtgaaccacagtgcccagcctataatctgttgtttttaatagtttgtttgaacaacagaaaaatgtagaaacattcatgggcttttttttttccgcccccaacagaagtgtttatataaccagactgccacctagtggagtgtaggttctgtttccatttgtacacctgatgatggtgaaggcattcagataagtagtaattcacatagaagctggataagtgcagtgaaaataatcagtatagagagatcaaaattatagtcatttttttcttcctaataccaaaaaacagttgaaatgttagtaggttgaaagtcaatattttgcttgatggtatttagtccttagtatggtgctcattggggctattttttttttccaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagt

SEQ ID NO: 4284 - DNA, 6018 bp, human
cacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaaggtgagtgaacttgttaaaccagactgaaaattgattgtctttgctgcatagaaacattgcagacttaagtttcagaaacacttgtagagaagtttgtttcatttcctgcttttactttgtagcattgcaaacttctttaagtttttgaaacacttgtagagaagtttgtttcatttcctgtctttactttgtagcgttgcaaacttctttaagttttagaaacacttgtagagaagtttgattcatttcctgtttttactttgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggaggatgattgttactacattaacaggaggaaacgggtatgtagggagaatgtataaaacattaatttgtttggcattttcattttgccatagtttgcaatcatagacgtaagcaatagcgaatcttggtggaacgaaatttatatttttcagctttgtattgagtcaggttttaaagttctctgccagtggtgctgtgcagctgataaaaattgaaactcacacagctctggctgcccattagggttgtgttgggagctttccagaatgctgctgcttgtgcttcagcccagaaattaagaattaattgatctgtggtggagtccaactgcaggtatacttgaagaagttccccaggttgttctcacagatcactgagattaagaatcactgcttacatctattcaaaaaagtaatattgtaatctacataaggttatgatcagtagagaaaaaaagatcaaagagattgcgaacatatttaagaagttctattcaaacagaattggctttggtttatttttgagttaaaaaatgatacagacatgaccagtgtttcttggaatatgtggtttgttacattaggatgcatacatcagatgtctatgtttttgttaacagttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaagtgagtactggcatgtttggtgttttgtggttctctctgtattagagaggtggcttccatttagaacaggtgacacttgtctctattccgttattttgaattcatttaatatttaataatttattgataattcattgaatcatctaatattaaaaccttgtcacttttgtgaaatcttcagtacttcaataactatttacacatcttacatggatgcattgaaagtgcactgcctcagcactgagacagttttttcagtgatactgtttagggcgagaactttccttgagaagcaccagaatgggcagtgaggatttctcaaagcttgtttacaaacaggttttcattccagtcagagaaagcttccttgtatcctgcctggtacacatgacccagctagatgagaggcagaaaggtggagtgttggagttaaagcaagggttagggattcactagggtcaacccgtttcagcttgcagtgataggggtgtgtccacctgtccacttttgcagcacaggctgctggacacctcgtgtggcctcaaacatatttatttgtgtttaatggggtaagttaaagtgactgctgtattttctgcactttatgttttcctatgtaatcttgacagtagctacaaatccatttcattttgtgtgtatgtaggtgtagtatataatgattagatttaaaactgccctattaaaaatcggcaacttcattgtgaacatttggaaagtacctcttacttgtgtctctaatctcttctttttaatcctcccagtgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggtaagttatatagcctgcactttcaccctcacatgtcagcagtacaatgatcagatccttgttttgaagagttcaatctgatggtgtgggccaacatgtttggaggagggaaggaaatgaaaagtgtgtgtcctggtggttttcttttttcctgggtaagctaagtcatcattcactttcatatggctctggcagattttaccaagtgaagaccccagcatagagaacttaggtgggatgatgagcagctctcccattttggggaagacggtagtgggtggggtgaagagagcacaggccggggagggtggaaggggcaggtttgaattgagtcccctcactggctgtttgtgttagttgcagaggtttcttaggagcctccttcttttgcaggtgtgggatggacggaaggcaggcctagctagtagtattaaatgggaatgttcacacagggcctgcaaactttggccttcagtaaaagttacttctcttcttgctctgcgatgtcaccacttttcctccctcagttaccgagcatgctctgttcttttttgagggggcagggagggggatcctgcaacctaaagtctttcccttaatctctataaggtattgtgctcgctccctcttccctctcttcctgagagagtggtctgttctcatgatttccactcatctgtctcctctgttaaccacttattatctgccttcatctactgctgtgctgcaaaactttgcctgcacgtgaactgataacctcccacttgcagtgtgctgccctttttctcggccaccttgccctgccctccctttctccctctgcttcatggctgtcagctccccagcttctctttccgcctggccgccatctcctctcagccatccttcctttggtagcttctctctctcctttccctttccccatgtcagtttcaccccaggtgagaggcctgcaggactcactggggacctatgtcaaagtccccagggcctacttcaaaccttgagactcctccggggtgggttgtgtgttttcacacagcaaccccaatgcttttcttagtcctgccagtagttacgtttcaacgaggtggtagggtattcttgttctctagaccagcgtttctcagcctcggccctattgatgttttgaatcagatctttctttgttgtggggctgcctgtgcaatataggatgtttagcagaattagtggccttcacccactagatgcggataacacctctttcctcagttgcagcaaccaaaattgtctccagacattgccatctgttccctgtcagggcaacattgctcccacttgagacccactgctctaagacacatataacaggggcatcacaatctttaatgccagcgtgccttgcagagttatggagagggtccaagtgacttcggtacatatttacgaccctcctggagtagagagagcatttcgtgtcttcagaagcactccatgttctggaaaggccctttgagccatgtgtgacatcctccatcttccctaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctga

SEQ ID NO: 4285 - DNA, 2864 bp, human
tttcatttcctgtctttactttgtagcgttgcaaacttctttaagttttagaaacacttgtagagaagtttgattcatttcctgtttttactttgttaccagaacttgcctattgtgacgaatagttacttttaagtcgattgtatttggattctgtctgggtgattctggaaaccccagttgtttctgtgtctgaatgagttactttttcagtttatttgcctcctctttgtgattttaaaatatttaaatcgttttctaaaaatgtaattctggggcatttctattgctttgaggtacttttagtcgttgtttcatatcaaactaaagtactgaattttccttttttgttcaattagctgggatagatgggcagcagaagatcatgtgcttcgtgataccgatgaaaatcgtagattacagcgtaaattggcaagaaaagctgtagctcgcctgtaagaatacaaaaatcaagatataaatgttatccaatgtgttttctcttagtgttttagatttttatgatataaaagtaatacaatgacaaatatcatttattaaataattttaaatatttaaagtgtgtaaggggaagagtgttcctatggtattctaaataacagtgttttcagagtggttattgtataattttctgaaatggaaattaccatttatgttctaaagtttaataatttttcaaatgtatttcattgtttattatatcttgttttgatctcaagactcacgagttcaatgtcaaaacttatttcagttgtttgctactctttttcaggaggagcacaggaagaaagaagaagcgctgcaggttgcctggtgtggactctgtcttaaaaggcctccccactgaagaaaaagatgaaaatgatgaaaactgtgagtagcttcacttcatttcttttggctgaaagaacttccacctagactgagagaaggattcactgaaattctagacagggaaacacttcaagctcattatgtataatatttgccccatttatttttgacaattaaagtagcagtcaatataagtcagtaaatcagtaatagaacgttagcagagtcatgcttgtgactactgccctctcggccagcatctttgtacaaacccctcatgggtgtgttctcatgggatctgttctctttttggcacctcccaggccttggtcccatttatgaatgcaacaggaaactgtaggatcctaactgacaatacactttccgatcattagctagtgtgatttttgcatccattgaaattggttgtcaaaataaatttctattgtgaaagatacagtatttgtgtttggcatttaaaaatacatggaattgcagtttattatttccagtagcacccacactacacgtgaagatctgtagacataagggttggtgaagtataaaatgcgagtttaccggatgcttttgtttcacctagcattaagcagttcctctgactgtagtgaaaacaaggatgaagaaataagtgaagaaagtgatattgaagaaaagactgaagtggtataaagtttttattgtaaaaactttctctttgttatatattttagtggtaaaaattcacagtgaaatactccagttgtgaattgttttctaaagatacatcttttaaaccaataatgtaaatttttatttgacatttaaagaaaaacaacccttatttatagtcgccgtatgagtctctcagtggctctttatgcccctaaaatgtttccacaaattatagttatctttctttccagtcaaattatttgttttataatgattaattttttaatggagcctacagactgtgatgtcttctgcctgcatccaaagttaatataaatccgagtggtaaactgaaatgggaaagaaatgaaatacatatttgcattgtgtttagtgcccccaaacaagttaacttttggcctttaacatacttttaattagaacacgtggcatactatgattgttgaggattagctgggtttgtttcatagcaggccttccttggatattgactcttctactgttttaaatagttaaaaatggaattttgatattgcagaaagaagaaccagagcttcaaacaagaagggaaatggaagaaagaacaataactatagaaatccctgaagttctgaagaagcagctggaggatgattgttactacattaacaggaggaaacgggtatgtagggagaatgtataaaacattaatttgtttggcattttcattttgccatagtttgcaatcatagacgtaagcaatagcgaatcttggtggaacgaaatttatatttttcagctttgtattgagtcaggttttaaagttctctgccagtggtgctgtgcagctgataaaaattgaaactcacacagctctggctgcccattagggttgtgttgggagctttccagaatgctgctgcttgtgcttcagcccagaaattaagaattaattgatctgtggtggagtccaactgcaggtatacttgaagaagttccccaggttgttctcacagatcactgagattaagaatcactgcttacatctattcaaaaaagtaatattgtaatctacataaggttatgatcagtagagaaaaaaagatcaaagagattgcgaacatatttaagaagttctattcaaacagaattggctttggtttatttttgagttaaaaaatgatacagacatgaccagtgtttcttggaatatgtggtttgttacattaggatgcatacatcagatgtctatgtttttgttaacagttagtgaaacttccatgccagaccaacatcataacgattttggaatcctatgtgaagcattttgctatcaa

SEQ ID NO: 4286 - DNA, 225842 bp, human; identical to SEQ ID NO: 3045

SEQ ID NO: 4287 - DNA, 586057 bp, human; identical to SEQ ID NO: 3046

SEQ ID NO: 4288 - DNA, 220197 bp, human; identical to SEQ ID NO: 3047

SEQ ID NO: 4289 - DNA, 18881 bp, human
cgccccaccatgcccaacatcgtgctgttcagcggcagctcgcatcaggacctgtcccagcgcgtggccgaccgcctgggcctggagctgggcaaggtggtcacgaagaagttcagcaaccaggagaccaggtgggggccgcgccggcggccgggctagggagagcgctgggcacgcggctgcggggccgggttgggggccggcgcctgcccgggccacctccgcggacgccgcgctcccccttccggggcgggacggtggcaacgcggcctccgcgcccccgcgcccgcgcctgcgaagaaaccgaggcggggcgccgcgcgtcccgatgcgcgcctcggctgtgcccccggttgcagggcctccggtcctgggaccgcggcgacccggcggtcccgagccgctcccggcctcccagcggtgccgcccggcctggcgtccccagcccggaagggagacgtctgggcggtcacagaccgtcggggagagagtgggcgcagcgggcgggaaccgcatcgggtcagcgcgcggtggagagacgtcctgggttggctggtcccagtttccgcgtccctacaaagctgaacctcagaccagtgcgtgcgactaaaggtttccccccgtccccaactctggttgcacgctgggtttacctggggacggtccgaacgctgcttcccccgacctgcccccaagggtttgatccaacgggcggaggatcagcgattttacaagcttccctggcttctcctgagcagccagggcgcagaccactgcgttatccagagggtgcagttgtgccaaggtttgaaagactgtgagaaccccaggacgcacgtgctgggctcccctctgctcccactactcttgctgctttaaagatgatggactttcagcttccttcttgttctaggactctgctgtgtccagcaacaacgccgtgattcgactgtaactttcacccatttctcaagtccaggagagcctcaggtggtggccatcctcggaagctgacctggggggctcctttgtctatctgcctgagtccacacagctccttgactcatttcaaattggtctcatttttcccccttcttcctccaatgtctagtaccgttaactgtccacagttactgataatttttatatctttggcaaaggttcaattttaccaacattttctagaaatggtgttggaacagttggacacccatatgccaaaaaatatgaacttccatccatacttttcaccatttgtaaaaattaactttgaagtggatcatagacctaattgtaaaatctagaactataaaatttctagcagaaaatcttgacttggggttaggcaaaaatttcttaaggaggagttatgttaatactgatggggaagatgctatattttggcaagtcagctttttaggatatgtgaatcttacgtgacttcttccaggtggcaaattccagttatggctccgatgataatataagcgaagaaacattgtgaatgagtggcaggtggactttggctaaagaattccactctgcagtgtttaatgcagaagtctgagaggatggtctagggctctggagaaggatagagctaggtttgagtgttgcagtattttgccagtcttgttcaagtttcagtcgctgtaagaacacgagaagaagaatagtttttgttcagaaggtgtcgtcatataagtaaaggagaaatttgttgatgaagtaaattttgaaagcaaatatgttgcccttccaggtactcagtgcagcatgatcttttgctaaggagcatggttaatctagatcagttcactgctaagtcagtgttgagtttctcctaaaaataccacatgtgccactgggcaaaactcactcagacactgaagtatgattgtttatacatttggttcaaatataaagcagactcacttttattttgtttttggcattttataaccatcacttgataattagaaatcgtgggacctcaaaaaccactcagcatgaagtttgggaattgcctatatagctacattttatgtttttaatgtatagagtataaaaggttcactgcctgacttttctcttttccatgaactgtacaagtacagagcttaatttttataaacagccctctctggaccagttactgtgctaggaatccagcttttagctgtgtaatcgtagagaggaaaaactgaagggcaaaatgaagacaaaattgattcagttcatgtaagggccccttcttgaatctgtcactgaactaggatcagaaatctggtttgctgtctcctggccatcaatcctcccattttgcgttttttatatgctactttactgaacatagagccttccaattttaccttcttatccctaaatcatttcagatatgcagggagaggtccgctccagcttcactatagaccatggaaattccatgatgacatcttaggacagcaggtgtctagatgtctctgttgtaacattttactatggtcagttaacctgctggcagaatctttagctatactgtgagacaaggttatgcaaagttatacaaggttatcggttaccatgtaataaataaagagcttaatggcttaaaacagtaattgttgatttggcttacaaatctgcaatttgggaagggctcagtgaagaaagcttgtttttgccgcgtatggtcacagctgaggctggtcacagctgaggcggctaactggggctggagggttcttgaagatggctcacatgactgaagttgttactagcttttgcctgggagcttggttaggaacctcagctcctcttcttgtaggcctctccatggggctgcttgagcttccttacagcatggaagctgggttctaagagcacatgttccaaaagacaggacattgaagccaccagtccattaaggactgggcttgcaagttggtgtatcataatttctgtcatatgctgttgggcaagtacagagccctctcagattcaagggcgggagactagaccctgctccttgatgggaaatgtgttaagagtctgtggctatcttttagttaccatgcccgtttattgttgagtcagtgacgctcttcagcgtttttatttgggggtcaataaagatcctctggcagaatggcaaatggatgctgccttctagccacaattttttaaagacctagaataaaggtagtcatgatcatctttttgagtagaagcaggactagctttaggggaaaagttgccatggtgatgatattctctgtcctcccctggactgctagtcatatgagaactgaggttcctgagtaaaaacaggccaaagaatctaatcttgtgggataaacgtcataagaccaggagttggcaaagtttttctgcaaagggccaaatcgtaaatattttaggcagtgctagcacatgtagtctctgttgctgcggtatcttacagttctgtaagttacggtaatgtctgtcacaggttagcagggctgtattctcttctgaggctctaggggagaatctgttcccgtgccttttccggtttccagaggcagcccacattccttcactattggcctcttcaccttcaatgtcagcaacaaaatgttgctctgaccctgcttctgctgtctccctcttgcatttttaagggccccatgattacaatgggccaatttaaataatccaggataatttccccatgttaaggtcagctgatgagcaacctgaatgctatctgcaaatttacttcccctttgccatataaactcacatattcaaaggattaggatgtagacatctttagggggccattattctgcctaccacgccattcttaactcacaggccatagaaaaacagcctatgtgctgtgttttgtcaacctctcagctatataatactgtacttgatttctgctgtagttcattttgtgctgctataacagaataccagagactggctaatttataaacaatagaaatttgtttctcacaggtctggaggctgggaagtccaatactgaggggctggcatctggcaagggctttcttgctgcatcatcccatggcagaagggtggaagggcaagagagcatatttgagagagagcaatagagggccaaatttgctaatataataaacccattctcaagataatgagcacactctagcaatgatgacgttaatccgtttgtgaggacagagcccttatgacctaatcacctcttaaaggtctcacctgtcaatactcctatactggggattaagctttcaacacatgaactttagggaacacatttaaaccatagcaatttccaaattaagtttatgtcatagttgatgtagtgttcacaaagcagttagatttagctccttagatcttcaaataggagggagcacatagaactctttctatccccctcatcctgtgaggttggcatattttcatccatagtagaaggcgtgcaagaagatgtgtgaatgttatcaaaactaattttcacaacatgtcaacttgaaaaactttatttttattttccttttctttaaaattttttttagagacggggtcttgctatgttgcccaggctggactagaactcctgggctcaaacaatccccttgcctcagtctcccaagtagctgggactgtgggcatgagccaccatgcccagcctgtttttaaattttcattaggtataattggctcttttttttttttttttttttttttgagacagagtttcacttttgttgcccaggctggagtgcaatggtgcgatcccagctcactgcaagctccgcctcccgggttcaagtgattctcctgcctcagcctcccgagtagctgggattacaggcatgcaccaccacacctggctaattttgtattttttagtagagatggggtttctccatgttaggctggtctagaactccagacctcaggtgatcagcccaccttggcctctcaaagtgctgggattacaggcgtgagccaccgcgcccagccttaattggctcttttaagaaaacaatttcattgagtatctgatagcaggagaagagagaaggataattattcatgttccttatttgtaattttaaaatatttcattttgggatgaataaatttacagacaattctgccataatgtgacatatgtattcctaaaaattaccacgctatgcaaaatcaggcaatccaaaaccacagggcttatgagaaaaatggggttagggacataacattcaaaaacttcctcagtgacccattaaaaaatcataggaatgttatatagattgagcatcccttatcagaaatgcctgggacaacaagtatttcagattttttttttttttttttttttttttgcattttggaatatttctattgtacttactggttggacattccaaatctccaaaaatccaaaatccacaatgctccaatgaccatttcctttgagcatgatgtcgacactcagaaagtttcggatttcagaatttcggattagggttcctatcaaaatggtaaaacactgacatgtattacatgctcaaaaaatactggctgggtgcaatggctcacgtctgtaatcccagcactttgggaggctgaggtgggcggatcacttgaggtcaggagttcaaaaccagcctggccaacatggcaaaacctccctccactaaaaatacaacaaattagccaggcgtggtggtgcatgcctgtaatccgagctactcgggaggctgaggcaggataatcacttgaacctgggtggcagaggtcggagtgagctgagatgtcaccactgccctccagcctgggcaacagagtgagactctgtctttaaaaaaaaaaaaaaaattacataaatattatgacagagatggaactttccattgaaaaatgcctgaggtttagggttctctgaaatgacatgaaaagttgtgacaccaaatgtgaatgagtgtggctcattgtcctcgaggtgtgtacatgtgtatgtttgtgtatttctaagtggctccattcagctgggtacactgcagttttctgcagtctcgggataagaggttgtgcataagaaaacatgaaattcatgctatgctcaaattgttccaaataatatcaatcattggaacaaatttgccttttcaaaacatagcagagctgaccatcttcttggtttggacgcagagctctgggaaggacatgcctgagcacacagcactattttctgtttcttcccaccaaaggaatatgccagggatgagctggctctccctctcatgttggacatccagaattctgtacctggaaatacagaaacttccagacatgcaattttcaaaaacttagctgctatttactctttctccagaagctacgcaaggatgccaaccagcaaaacaaggaagtataccaagaaagaggatacagaaaatggcaaatggagtgcaggagagggggcagggaatccccggatggcagctgtgcacaggcagagagataacccaggcctgccacccctgggagggatgcctgcaagacgatgaaatgcagatgggacttgaggcctctgatcttgggagattttgattgttagtgaagggtttagggtggaatctggattcaggattcagaaaacttagcagataaaaaggtaagagaatgacctccagggaaaataaaaagaaaagatgtgcataaaaagaaaatacaagcattcgtttaagttaattgcatggcagagctctgagcagcatttgcgcagttaaaaacgtacagtcaatctttaatgtgaatattgatctatattgggatgatggcgagatgggaagtttacattgcaagtgatggaactgaatggaaatggagttcagtcctcatcttccatagtgagaagtcaatacactttgcctaaaatgaaaaatcaagacacagcaatacacacatagtagctagacttgaaggaaagtatccaaaaaccctatcaagagttgaaattggtggcctctgggcactttctctgttatacgtcttacagaatggtttgaattttttaagcaatatgactgtataactttaataaaaaactaaaactaaatgtagtattttgcagaaaagagttaacattagcaggcctgagacttaggcctgttcgcaaggttggcccttggctggcctctgggagcttacattttgcaagggtacccaccatttcccagtaaggatggctcactgcataaactcttaaacaattgataaacaatgtggttcatgctgaatgcctgtgagtctgacattttggtacgtgctaggcagagggtgcttatatgaccagcccacaatacaaaccctgggacttgagtctctaagcagcttccctggtagagagcccttcacacgtgttgtcacagctcactactggggcattaagctctacctctgactcccctcagggaggagtcttggaagcttgcaccctgtttcccccaacttcaccccatgcacctttttccctttgctgagtttgctctgtgtcctttctctgcaataaattacagccatgagtgcaactattaggctgagtcctataagtcatcctggtgatcatcaaacctaggggtggtctcagggacgcccaagatgcaaatatgcttcgatattaaccgatggcagttttcttttcctagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaaggtaggagaggtgtgtgccctagaaacctgctgtgggccactgtcaatgttgtttttcctcatttatccccttgattagaattatctggaaaatgttggctttttcctttgatgatcaagtaaatatgctttcttattttgtttgttgaagatttggctttgaacctaccctgacattaatattcaaagaaacaggtaatgcatatttttgcaggtattaaaataccattattgtccttgttataatgaaattattgtatgtctttgtggtggtggatagaactaaatacacacacatacatgcacaagagtacaagtcaaactagagcacatctgaatcagatcactggattgtatcaatttcagggtcctggctgtgatactgtgttatagtttcacaagacgttaccacagggaactaggtaaaaggttcacaggatctctgcgttgtttcatacaactgcatgtctatctacaattcccccgaaataaaaagtttaattaaaaaaaaaacccatgatctctttttaaccttttaaaaagaacagaaatagtatcattgaattatgtttttcacaacattagcatcagaggaggctctgtgagtctttagaaaaaaattgaagaaaatgtggttggtctttgcctttcagagcaacagagaaatcggaggttgagaagaactttgaaggagattgtattagttttctaagctgtcataagaaattacataaaccgcgtggcttaaaagagcagaaatttttccctcacagtttcggaggcccagaagtgtgaaatcaaggaatgggcaggggcacgctccctctgaaggctgtaagggaggctgcttcctcgcttcttccaacttctggtgtctccttgcattccttggctgtggctacatcactctggtccctgcctctctcttcacctggcctcttccctgtgtctcttctctgtttcttataaggacactgtcattggatttcaggcctaacctaatccagaatgaactcaacttaatctttaccttggttatatttgcaaagaccctatttccaaaatgaggtcacatgctgaagttgtgggtggacatgagttttggggggatattgtttgacctactacagtggtcaactcccagctgttgtgtgttccgtatcttatggatagatagatgttcagccaggctcagcgagaatcctgccagttttcaagacacactgctgttctgtgatttggtaactcagtgcaagaaaggttttccccaatatgctgctttttatctccataattcatttctgaaacaacacagatttctgaagcagcacacaagatcccctcatatttgaaaaaaaccctttataaatttgaattcatataccaaagtccccctgaattttaatcccagtctcctcaagacatggtttccattccctgtcttgaagatggccagtcagttaatttctcacctaaaatctaattagaagggtccacatactttatctgtaaatggctatatggtctgtgttgcaactattcaactctggttgtacttcaaaaagagcaatagacaatatgtaaatgaatgggtatggctgtgttccaataaaactttatttatggacactgaaatgtgaatttcatattattttcacatgccttgaaatactattttgaatttttttcaaccatttaaacatgtgaaagccattattagctcacaagcagtaccaaaacaagtggctggtggctggtggctagctggatttggcctataggctacagtttgccaacccctgtattagaccattgatagattgcgtgcgcacgtgtgtgtgtgtgtgtgtgtgtgtgtgtgtgtatgtgtgtgtgtgtttatgatctaaacttgaccttgggcagccaaaaccttaggtcacatacactgctgtgaagctgtatcctcccactagctatttatacagacagctccttttattttaaacttgatttaaactgtatttttagctgttaaatttcaattttctaattttgtcccattggtataatctgttgtcttagctattcttcccatctgtgtgtttccacaggattgtttagcatctttctccttgtcatatcacatccatgtcatagaagagctaattttctgccattatttcttccttccttgtggtttagtaaattctcacattgtagctggttttttgttgtttgtttgtttgtttgtttttgagacggagtctcactctgtcacccaggctgaagtgcagtggcacgatctcagctcactgcaacctccgcctcccaggctcaagcaatcctcctacctcagcctcccgagtagctgggactacaggtgtgcaccaccacgcctggctaatttttgtatttttggtagagacgaggtttcaccatgctggccaggctggtctcgaactcctgacctcaagtgatctgcccgccttggcctcccaaagtgctgggattacaggcatgagctaccgcacctggcctgtagctgtatttttaatcaagctctttcactcacaatagattttatattttgtatttggccctaagatattgaatatattgtaacttctttagaaaattactccttttatcattgcacatgccctcctccactattacccgatttgtaaccccattttgttcattaagtgataaaatatcagaagctctacatttttgttagcacatatctgatttgcggtgacctctttttacaaagttgtattttcaaaatgttttcttatttgagttggagaaactagcactgttttttcccaatccttctattgtaggaggtgtgatgcagtccagcctccatcccctagttgccagtagtgctcccagccaccactaacaagagccctatggatttctggaactccagtggctataacttgtgttttgttttgttttgttttgttttgttttgtttgagatggagtttcgctcttgttgcccaagctggagtgcagtggtgccgtctcagctcactgcaacctctgcctcccaggtttaaggattctcctgcctcagcctctcaagtagctgggaagcatgcgccacgacgcctggctaattttttgtatttttagtagagacagggtttcaccgtgtgggccaggctggtctcgaactcctggcctcaagtgatctgcccgcctcagcctcccaaagtactgggattacaggcatgagccatcgcgcccagccggctttaactgttttgtggaactgtgttgtctaactagctagtagcagctttcctgatgttagacagatgtgttttccattttgacccattgtgaaaacatatttcttttctttcttctaccctttctttaatcactttgctgtaagtgtgtttcttggtaataacattgtagctgcttttaattttttatcccagtcagacaattccatgactttctgagcttaactgctgatagaagagaggtctttcatcatcaaccacgcagaggcagggcggttggtaacatttgagagacagtgtgtgtagtggcttaggaagtcatgtggtttctcgttagagaacacagctaggaaagaaggaatcacggtggggtgtattcgtttcctagcactgttataacaaattaccacaaactgggtgacttaaaacaacagaaatatgttctcttaagtgctagaggccagaagtccaacatcaaggtgttggcagaggaatattccttttggaggctgcaggggaggctcctccttccttgcctcttctagctcctggtgactgccagccttgaggccacatcactctaatctctgctggaatcttcgcatggcctcctctttgtctccatcagatctctcgctcactctctcatttttaattttctttttagagacagggtctcgcttcgtcacccaggctgaagtgcggtggcacaatcttagctcactgcagcctcaaacttctgggctcaagtgatcctcccacctcagcctcccaggtagctgggactacaggtgcacaccaccacgcctggctaatattttttgctttttgtagaggcagtgtctcactatgttgcccaggctggtcttgaataggaattctcctgggctcaagagatcctcctgccttggccttccaaagtgttaggattaaaagcattaccaccacacctggcatctctctttaaaggatacatgaggtagcatctagtgttcacctgaataatccaggataatctccccatctcaggatcctcaatgtcatcacatctgcagaaacctttccaaataaggtaacatttacaggttccaaggattgggctctgatatttttggggccaccattcagctcacttcaggaggccttaaaggaagtcactgatgtgttaagagacgaatattttaaggacactttgagctttgagatagtacatatcatttatcatctaggccaggatgctttcaagattgaaagggagctctatggataactgtgttgggaaacaggtgtctgcctagactgtcctgggcaagtgacatagggccaccctctctatagcctctggaggtggccaagacacataagctgttctgacaccattatttctgacatgtctgtgtagtcagtgtgactcattatagtgaggagacaattttgttctttccccaaacttctgaaaggggaattcttaattcttaattttatctagtatttgaggtgtgcctttgctttatttttttaagacagagtctcgctctgtcacccaggctggagtacagtggcacaatcttggctcactgcaacctctgcctccggggttcaagcaattctcctgcctcagcctcccaagtagctaggattataggtttgcgccaccacacctggctaattttagtatttttagtagagacagggttttgctatgttggccaggctggtctcgaactcctgacttcaaatgatctgctcacctcggcctcccaaagtgctgggattacaggtgtgaaccaccgcgcctggcccacctttgcattttttaaatggctgataatacttttcctaactattccttccttaccttggatcacgtggcttggctttgtactgagaaactgtactttggtgaggggaactgggatttagtaagcacctaagagagatggccagagcctgtcagcatacttcatctcttagaatctcttagacaagtgctactgtttaccagtacaggtgaatgatgaggagaccaagcatgattggggtggggggtgagggttaggggaaatgcacttctacctttttgcttcatttaggaaggtataaagccatgtggcgttagattgtgatgagaagctgtgacctacacttgatctctcatcccagaaagaaaatgctcctgcacagccgcaggaggagctctgggcagccctccaagactttctgttgtgctgtttccttcccttagggctgtattacctatgacatctaatgacaatgaaattctgtgtaattgctcttcttggaatgccttgcaaagaagcccagaaaaaaaaaatctggaagcttttaaccagattcaaagctggttttgtttttttctgtaaaccttgctgctgctttttaagcaagccctgcacatatgtaacattttatttggggttttctttgtatgtacaagacaccagggacagattctgatggtgaaggaatggtttcataaattaggacacatccatacaatgtaatgttaacatagaaaaataatgatgatgtaatattaattgtaaaagacatggtgccaagtggtctgagctctggcactgagaatcaagtaggctcagatttgaattccagcccattatttactcagtttatcctttgtaaaagttacttaaactgtctgtatctttagtttccttatctgtaaattaagtacgacactagctactatttatgaagtacctaccatattatgatacatgagtgggcaaactttttctgaaaagagctggatgtcaaacattttgggctttgtgggccgttgggtatctattgcagcagctccactctgccattttagtgtgaaagcagccattagtcaatgtgtacatgaaggggtgcggctgtgttccagtaaaactttatgtgcactgaaatatgaacctcatataatcttcagatgtcacaaaatattgttcttcttttgattgtttttcaaccgtttaaagacgtaaaaaccattgttaactcacaggttatgcaaaaacaggctgtgggctaagtttggcccatggattctaatttgccggtccctgctatagaagacactcaataactgctggttcccttccctggtaaaaacagtaggttgggccgggcatggtggctcacacatgtaatcccagcactttgggaggccaaggcgggcggatcacctgaggtcaggagttcgagaagagcctggccaacatggtgaaaccccatctctactaaaaatacaaaaattagccaggcctggtggcgtgtgcctgtaatcccagctactcagggggctggggcaggagaattgcttgaacccaggaggcagaggttgtagtgcagtgagctgagatctcaccactgcactccagcctgggtgacagagcgggactccgtctcaaaaggaaaaaaaaaaaaaaaggtagattgtgggcaagactgggaataattacttctgaggcgggtaaaggacttgtagtttggggatttcttttttcttttttcaaaatcattttcaagatcatgttctgttttcaataagattttctttttttccttttttgtagcagagaaattgagaacagtttttcctgatgtgaatttctacagtcttgtaatttttttaaaagcctgtcaattttacacttttcaaaaggtgatatttgatgccttgaataacatctggaatagcctgggactctgtcatgattgggctgacttgcaaaacatttgacttttatgcgtttttcactaagggagctgaatgttttatttttggctactgtaccttgacactacctttgtttcagtgctgtacttacttttctttgtataggctagcaagtcagttaactagtaaatcatttttcctgcaagattcagttgggtatgagccaaactctgagacacagaacagaaaccaaatttgtaaacaaggtgtgaagaagaaaatcagaaagcgtgaatttaggaattaccctgtggtttggatcctagaagttaagaaacactggatgccactgaggagagatgagaagggaggattctttttgctggcatcttagtctgtgctactgtaacaaaataccacacactgggtaatttataaagaacagaaatattctttggtgctgggcacggtggctcacgcctgtaattccagcactttgggaggctgaggtgggcggatcacctgaggtcgggagttcgagaccagtctgaccaacatggagaaaccccttctctactaaaaatacaaaattagccggttgtggtggcgcatgcctgtaatcccagccactcgggaggtggaggttgcggtgagccgagatcacaccattgcactccagccagggcaacaagagcgaaactccatctcaaaaaaaaagaaatattctttgaacgtgtgtcctgggaggggggaaaaaaaggacaaaaatatattttctcatagtcctggagactggaagaccaagaccaagcactagcatttggtgtctggtacgggctgcgtcctccagagggaagaatgctgtgtccttacatgatataagacagaagggcaagtttgcaaaatgctgcctgaagcctcctttagaaggaccttaatcccgctctcaagggagcagccctcatggcctaatcaccttttaaaggccccacttcttaatcctatcacattggcaacacctgaattttggaggtgacctttcaacccgtagtaactgattcgacaattgtaggaaaagcacaaaattgattagtattgcaaatcaggttctattacaaagcagttgtagcaactgatttgctctttttattatcctggaactttgttacactaaataattctcacaattagtgaggctaatgagtaagccttggacatttagtgttaatagagattctgttagtaaatatttattgaagaactactgaatgcagagtgtggagctgtgttctgctgcgaaaattcgattttatcccaaaggcaacatggaatatagtacgggggagttaaatgatgaaaacatgagttatgatctataattagtggagaagattgaaaaaataaaaaaacaagaaaaatatattttcctataatctcacattccagaaacatctgttaactttttagagtgttttcctctcattcttttctttctgttttgaacatacatgcataccttttttttttttttttttttgagatggagtctcgctctgtcgcccaggctggagtgcagtagtgccatctcggctcactgcaacctctgtctccagggttcaagcaattctcctgcctcagcctcctaagtagttgggactacaggcgcccgccaccacgcctggctaattttttgtgtttttagtagagacagcgtttcaccatgttagccaggatggtctggatcttctgatctcgtgatccgcccacctcggcctcccaaagtgctgagattacaggcgtgagccaccgcgccccatatatacctatttttgataaaatatatatttctttttaaaaagtggtatattagggaaaacacaaataatctgttaacattttcaatgtaattccttcctgcatgtgtttttacatgaatatactgtgtgtgtgtgtgtgtgtgtgtgtgtaacaaggatcatttgttactattttgaatgaaatctttttttaagcttttattttcttttttgtggctgatatatagaaatactgttgtttacaacaaaatgctgaacgccacctaggtctaatcatgtgtctatataatttcttggatttctttgatgtgggcagttgtattgtccataatttatgatgtggaaaccaaagctatagaaaagttaggtaattttacaaagaacataatatcagtaaatgacactaagtatgaaattaaatagtaactattatcaatccccttacagtattcattctttgaccttgtttttttccatttgtaatagtgttagcgtccaactgtcagctcatgtccaaatgtcggctcatgaattcctctttaatagctggacttcttttagcctctggctgtgtgagggtctcttgacctcagtgatctcacatgtgccactctgtccttctagaacactattctcctcgcctttgctaaacttgccttaaaagtgatttcctcagagggaccgctaataatgatcttgtttaaactttatgcccttcctactactatcatctctctctctcggtaccttttatttctacacacttaccatgatttcagttacacagattgtgacattacatgtacatatgtttaactgtttgcttctttcatatttgttctctatacccagcgtcaagcacttagttttgcagtagtatatgtaaatagtaaatatttgctgaataagatggaatgaatatatcttttgctgtcacaacatgtataattttctttttgatgcttcgttgattgcatctatgatttatccttctcatgtacgtcttagtgggaggaatctaacagtatccatcttttcctgttataaaattaatgttcttacttgtagagtcgtgccccaatttctgcaaaacttgtggccaatatgctgtcggtggctggggcggatcacatcatcaccatggacctgcatgcttctcagatacaggtatccgtgttttccttctgcaaatggttaaatcaagtctgttaaattaaataatcttaggtaacattacttgtgtttgagtttatatatggctactctcttggatttttgtctttactaaacttgaaaatataatttgatattagtacttccagtctctatcaccaccttgccccccagtcaattttggaggagtggggatggctttttggtagtaagctctatatagttccatctcagcttatggaaaataattagaacggcagtcataatgtacactttttaacttcttcataacttattttctttgtctctaaaacaggccaaattatactgtgccactttgtgttatataatgaacgtgaagtatttgatttataataactacttaagagacaacaaaccttttccctcaccgtcctgcatagccattctattcctcagaatataggccatcataagacaatggaatatgtcccaagagacagattggactgaaatatgcccctataacatatctgtcttttgatttaattctgtttaaaattaacaaaagggagtctgttataaaagcttcttttgaacaaaaaatgcaaatgttatttaatgaaagcgattatcgtttaaaaaaacaaaagaaaacaaaacaaaacaaaaccctgcaacatgacactcacttctccctttagggattctttgatattcctgtggataatttgtatgcggagcccgcagtcctgcagtggattcgggaaaacattgccgagtggaagaactgtatcattgtttcacctgacgcagggggagccaaaaggtatcatgcaggctacaccttgcagatttctccatctgctgattggtttttccttttccgatgtattagataaggaagcatgctgtaaattacttaaagctttattttgctaatgagcaagtaagtagaccgcaggcttcacttccagagcagaaacccatcatctttgttaatatttcgtcattcaggaaagaagaaaatacagagacacacatacacaata

SEQ ID NO: 4290 - DNA, 31680 bp, human
ctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctgtcccagcgcgtggccgaccgcctgggcctggagctgggcaaggtggtcacgaagaagttcagcaaccaggagaccaggtgggggccgcgccggcggccgggctagggagagcgctgggcacgcggctgcggggccgggttgggggccggcgcctgcccgggccacctccgcggacgccgcgctcccccttccggggcgggacggtggcaacgcggcctccgcgcccccgcgcccgcgcctgcgaagaaaccgaggcggggcgccgcgcgtcccgatgcgcgcctcggctgtgcccccggttgcagggcctccggtcctgggaccgcggcgacccggcggtcccgagccgctcccggcctcccagcggtgccgcccggcctggcgtccccagcccggaagggagacgtctgggcggtcacagaccgtcggggagagagtgggcgcagcgggcgggaaccgcatcgggtcagcgcgcggtggagagacgtcctgggttggctggtcccagtttccgcgtccctacaaagctgaacctcagaccagtgcgtgcgactaaaggtttccccccgtccccaactctggttgcacgctgggtttacctggggacggtccgaacgctgcttcccccgacctgcccccaagggtttgatccaacgggcggaggatcagcgattttacaagcttccctggcttctcctgagcagccagggcgcagaccactgcgttatccagagggtgcagttgtgccaaggtttgaaagactgtgagaaccccaggacgcacgtgctgggctcccctctgctcccactactcttgctgctttaaagatgatggactttcagcttccttcttgttctaggactctgctgtgtccagcaacaacgccgtgattcgactgtaactttcacccatttctcaagtccaggagagcctcaggtggtggccatcctcggaagctgacctggggggctcctttgtctatctgcctgagtccacacagctccttgactcatttcaaattggtctcatttttcccccttcttcctccaatgtctagtaccgttaactgtccacagttactgataatttttatatctttggcaaaggttcaattttaccaacattttctagaaatggtgttggaacagttggacacccatatgccaaaaaatatgaacttccatccatacttttcaccatttgtaaaaattaactttgaagtggatcatagacctaattgtaaaatctagaactataaaatttctagcagaaaatcttgacttggggttaggcaaaaatttcttaaggaggagttatgttaatactgatggggaagatgctatattttggcaagtcagctttttaggatatgtgaatcttacgtgacttcttccaggtggcaaattccagttatggctccgatgataatataagcgaagaaacattgtgaatgagtggcaggtggactttggctaaagaattccactctgcagtgtttaatgcagaagtctgagaggatggtctagggctctggagaaggatagagctaggtttgagtgttgcagtattttgccagtcttgttcaagtttcagtcgctgtaagaacacgagaagaagaatagtttttgttcagaaggtgtcgtcatataagtaaaggagaaatttgttgatgaagtaaattttgaaagcaaatatgttgcccttccaggtactcagtgcagcatgatcttttgctaaggagcatggttaatctagatcagttcactgctaagtcagtgttgagtttctcctaaaaataccacatgtgccactgggcaaaactcactcagacactgaagtatgattgtttatacatttggttcaaatataaagcagactcacttttattttgtttttggcattttataaccatcacttgataattagaaatcgtgggacctcaaaaaccactcagcatgaagtttgggaattgcctatatagctacattttatgtttttaatgtatagagtataaaaggttcactgcctgacttttctcttttccatgaactgtacaagtacagagcttaatttttataaacagccctctctggaccagttactgtgctaggaatccagcttttagctgtgtaatcgtagagaggaaaaactgaagggcaaaatgaagacaaaattgattcagttcatgtaagggccccttcttgaatctgtcactgaactaggatcagaaatctggtttgctgtctcctggccatcaatcctcccattttgcgttttttatatgctactttactgaacatagagccttccaattttaccttcttatccctaaatcatttcagatatgcagggagaggtccgctccagcttcactatagaccatggaaattccatgatgacatcttaggacagcaggtgtctagatgtctctgttgtaacattttactatggtcagttaacctgctggcagaatctttagctatactgtgagacaaggttatgcaaagttatacaaggttatcggttaccatgtaataaataaagagcttaatggcttaaaacagtaattgttgatttggcttacaaatctgcaatttgggaagggctcagtgaagaaagcttgtttttgccgcgtatggtcacagctgaggctggtcacagctgaggcggctaactggggctggagggttcttgaagatggctcacatgactgaagttgttactagcttttgcctgggagcttggttaggaacctcagctcctcttcttgtaggcctctccatggggctgcttgagcttccttacagcatggaagctgggttctaagagcacatgttccaaaagacaggacattgaagccaccagtccattaaggactgggcttgcaagttggtgtatcataatttctgtcatatgctgttgggcaagtacagagccctctcagattcaagggcgggagactagaccctgctccttgatgggaaatgtgttaagagtctgtggctatcttttagttaccatgcccgtttattgttgagtcagtgacgctcttcagcgtttttatttgggggtcaataaagatcctctggcagaatggcaaatggatgctgccttctagccacaattttttaaagacctagaataaaggtagtcatgatcatctttttgagtagaagcaggactagctttaggggaaaagttgccatggtgatgatattctctgtcctcccctggactgctagtcatatgagaactgaggttcctgagtaaaaacaggccaaagaatctaatcttgtgggataaacgtcataagaccaggagttggcaaagtttttctgcaaagggccaaatcgtaaatattttaggcagtgctagcacatgtagtctctgttgctgcggtatcttacagttctgtaagttacggtaatgtctgtcacaggttagcagggctgtattctcttctgaggctctaggggagaatctgttcccgtgccttttccggtttccagaggcagcccacattccttcactattggcctcttcaccttcaatgtcagcaacaaaatgttgctctgaccctgcttctgctgtctccctcttgcatttttaagggccccatgattacaatgggccaatttaaataatccaggataatttccccatgttaaggtcagctgatgagcaacctgaatgctatctgcaaatttacttcccctttgccatataaactcacatattcaaaggattaggatgtagacatctttagggggccattattctgcctaccacgccattcttaactcacaggccatagaaaaacagcctatgtgctgtgttttgtcaacctctcagctatataatactgtacttgatttctgctgtagttcattttgtgctgctataacagaataccagagactggctaatttataaacaatagaaatttgtttctcacaggtctggaggctgggaagtccaatactgaggggctggcatctggcaagggctttcttgctgcatcatcccatggcagaagggtggaagggcaagagagcatatttgagagagagcaatagagggccaaatttgctaatataataaacccattctcaagataatgagcacactctagcaatgatgacgttaatccgtttgtgaggacagagcccttatgacctaatcacctcttaaaggtctcacctgtcaatactcctatactggggattaagctttcaacacatgaactttagggaacacatttaaaccatagcaatttccaaattaagtttatgtcatagttgatgtagtgttcacaaagcagttagatttagctccttagatcttcaaataggagggagcacatagaactctttctatccccctcatcctgtgaggttggcatattttcatccatagtagaaggcgtgcaagaagatgtgtgaatgttatcaaaactaattttcacaacatgtcaacttgaaaaactttatttttattttccttttctttaaaattttttttagagacggggtcttgctatgttgcccaggctggactagaactcctgggctcaaacaatccccttgcctcagtctcccaagtagctgggactgtgggcatgagccaccatgcccagcctgtttttaaattttcattaggtataattggctcttttttttttttttttttttttttgagacagagtttcacttttgttgcccaggctggagtgcaatggtgcgatcccagctcactgcaagctccgcctcccgggttcaagtgattctcctgcctcagcctcccgagtagctgggattacaggcatgcaccaccacacctggctaattttgtattttttagtagagatggggtttctccatgttaggctggtctagaactccagacctcaggtgatcagcccaccttggcctctcaaagtgctgggattacaggcgtgagccaccgcgcccagccttaattggctcttttaagaaaacaatttcattgagtatctgatagcaggagaagagagaaggataattattcatgttccttatttgtaattttaaaatatttcattttgggatgaataaatttacagacaattctgccataatgtgacatatgtattcctaaaaattaccacgctatgcaaaatcaggcaatccaaaaccacagggcttatgagaaaaatggggttagggacataacattcaaaaacttcctcagtgacccattaaaaaatcataggaatgttatatagattgagcatcccttatcagaaatgcctgggacaacaagtatttcagattttttttttttttttttttttttttgcattttggaatatttctattgtacttactggttggacattccaaatctccaaaaatccaaaatccacaatgctccaatgaccatttcctttgagcatgatgtcgacactcagaaagtttcggatttcagaatttcggattagggttcctatcaaaatggtaaaacactgacatgtattacatgctcaaaaaatactggctgggtgcaatggctcacgtctgtaatcccagcactttgggaggctgaggtgggcggatcacttgaggtcaggagttcaaaaccagcctggccaacatggcaaaacctccctccactaaaaatacaacaaattagccaggcgtggtggtgcatgcctgtaatccgagctactcgggaggctgaggcaggataatcacttgaacctgggtggcagaggtcggagtgagctgagatgtcaccactgccctccagcctgggcaacagagtgagactctgtctttaaaaaaaaaaaaaaaattacataaatattatgacagagatggaactttccattgaaaaatgcctgaggtttagggttctctgaaatgacatgaaaagttgtgacaccaaatgtgaatgagtgtggctcattgtcctcgaggtgtgtacatgtgtatgtttgtgtatttctaagtggctccattcagctgggtacactgcagttttctgcagtctcgggataagaggttgtgcataagaaaacatgaaattcatgctatgctcaaattgttccaaataatatcaatcattggaacaaatttgccttttcaaaacatagcagagctgaccatcttcttggtttggacgcagagctctgggaaggacatgcctgagcacacagcactattttctgtttcttcccaccaaaggaatatgccagggatgagctggctctccctctcatgttggacatccagaattctgtacctggaaatacagaaacttccagacatgcaattttcaaaaacttagctgctatttactctttctccagaagctacgcaaggatgccaaccagcaaaacaaggaagtataccaagaaagaggatacagaaaatggcaaatggagtgcaggagagggggcagggaatccccggatggcagctgtgcacaggcagagagataacccaggcctgccacccctgggagggatgcctgcaagacgatgaaatgcagatgggacttgaggcctctgatcttgggagattttgattgttagtgaagggtttagggtggaatctggattcaggattcagaaaacttagcagataaaaaggtaagagaatgacctccagggaaaataaaaagaaaagatgtgcataaaaagaaaatacaagcattcgtttaagttaattgcatggcagagctctgagcagcatttgcgcagttaaaaacgtacagtcaatctttaatgtgaatattgatctatattgggatgatggcgagatgggaagtttacattgcaagtgatggaactgaatggaaatggagttcagtcctcatcttccatagtgagaagtcaatacactttgcctaaaatgaaaaatcaagacacagcaatacacacatagtagctagacttgaaggaaagtatccaaaaaccctatcaagagttgaaattggtggcctctgggcactttctctgttatacgtcttacagaatggtttgaattttttaagcaatatgactgtataactttaataaaaaactaaaactaaatgtagtattttgcagaaaagagttaacattagcaggcctgagacttaggcctgttcgcaaggttggcccttggctggcctctgggagcttacattttgcaagggtacccaccatttcccagtaaggatggctcactgcataaactcttaaacaattgataaacaatgtggttcatgctgaatgcctgtgagtctgacattttggtacgtgctaggcagagggtgcttatatgaccagcccacaatacaaaccctgggacttgagtctctaagcagcttccctggtagagagcccttcacacgtgttgtcacagctcactactggggcattaagctctacctctgactcccctcagggaggagtcttggaagcttgcaccctgtttcccccaacttcaccccatgcacctttttccctttgctgagtttgctctgtgtcctttctctgcaataaattacagccatgagtgcaactattaggctgagtcctataagtcatcctggtgatcatcaaacctaggggtggtctcagggacgcccaagatgcaaatatgcttcgatattaaccgatggcagttttcttttcctagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaaggtaggagaggtgtgtgccctagaaacctgctgtgggccactgtcaatgttgtttttcctcatttatccccttgattagaattatctggaaaatgttggctttttcctttgatgatcaagtaaatatgctttcttattttgtttgttgaagatttggctttgaacctaccctgacattaatattcaaagaaacaggtaatgcatatttttgcaggtattaaaataccattattgtccttgttataatgaaattattgtatgtctttgtggtggtggatagaactaaatacacacacatacatgcacaagagtacaagtcaaactagagcacatctgaatcagatcactggattgtatcaatttcagggtcctggctgtgatactgtgttatagtttcacaagacgttaccacagggaactaggtaaaaggttcacaggatctctgcgttgtttcatacaactgcatgtctatctacaattcccccgaaataaaaagtttaattaaaaaaaaaacccatgatctctttttaaccttttaaaaagaacagaaatagtatcattgaattatgtttttcacaacattagcatcagaggaggctctgtgagtctttagaaaaaaattgaagaaaatgtggttggtctttgcctttcagagcaacagagaaatcggaggttgagaagaactttgaaggagattgtattagttttctaagctgtcataagaaattacataaaccgcgtggcttaaaagagcagaaatttttccctcacagtttcggaggcccagaagtgtgaaatcaaggaatgggcaggggcacgctccctctgaaggctgtaagggaggctgcttcctcgcttcttccaacttctggtgtctccttgcattccttggctgtggctacatcactctggtccctgcctctctcttcacctggcctcttccctgtgtctcttctctgtttcttataaggacactgtcattggatttcaggcctaacctaatccagaatgaactcaacttaatctttaccttggttatatttgcaaagaccctatttccaaaatgaggtcacatgctgaagttgtgggtggacatgagttttggggggatattgtttgacctactacagtggtcaactcccagctgttgtgtgttccgtatcttatggatagatagatgttcagccaggctcagcgagaatcctgccagttttcaagacacactgctgttctgtgatttggtaactcagtgcaagaaaggttttccccaatatgctgctttttatctccataattcatttctgaaacaacacagatttctgaagcagcacacaagatcccctcatatttgaaaaaaaccctttataaatttgaattcatataccaaagtccccctgaattttaatcccagtctcctcaagacatggtttccattccctgtcttgaagatggccagtcagttaatttctcacctaaaatctaattagaagggtccacatactttatctgtaaatggctatatggtctgtgttgcaactattcaactctggttgtacttcaaaaagagcaatagacaatatgtaaatgaatgggtatggctgtgttccaataaaactttatttatggacactgaaatgtgaatttcatattattttcacatgccttgaaatactattttgaatttttttcaaccatttaaacatgtgaaagccattattagctcacaagcagtaccaaaacaagtggctggtggctggtggctagctggatttggcctataggctacagtttgccaacccctgtattagaccattgatagattgcgtgcgcacgtgtgtgtgtgtgtgtgtgtgtgtgtgtgtgtatgtgtgtgtgtgtttatgatctaaacttgaccttgggcagccaaaaccttaggtcacatacactgctgtgaagctgtatcctcccactagctatttatacagacagctccttttattttaaacttgatttaaactgtatttttagctgttaaatttcaattttctaattttgtcccattggtataatctgttgtcttagctattcttcccatctgtgtgtttccacaggattgtttagcatctttctccttgtcatatcacatccatgtcatagaagagctaattttctgccattatttcttccttccttgtggtttagtaaattctcacattgtagctggttttttgttgtttgtttgtttgtttgtttttgagacggagtctcactctgtcacccaggctgaagtgcagtggcacgatctcagctcactgcaacctccgcctcccaggctcaagcaatcctcctacctcagcctcccgagtagctgggactacaggtgtgcaccaccacgcctggctaatttttgtatttttggtagagacgaggtttcaccatgctggccaggctggtctcgaactcctgacctcaagtgatctgcccgccttggcctcccaaagtgctgggattacaggcatgagctaccgcacctggcctgtagctgtatttttaatcaagctctttcactcacaatagattttatattttgtatttggccctaagatattgaatatattgtaacttctttagaaaattactccttttatcattgcacatgccctcctccactattacccgatttgtaaccccattttgttcattaagtgataaaatatcagaagctctacatttttgttagcacatatctgatttgcggtgacctctttttacaaagttgtattttcaaaatgttttcttatttgagttggagaaactagcactgttttttcccaatccttctattgtaggaggtgtgatgcagtccagcctccatcccctagttgccagtagtgctcccagccaccactaacaagagccctatggatttctggaactccagtggctataacttgtgttttgttttgttttgttttgttttgttttgtttgagatggagtttcgctcttgttgcccaagctggagtgcagtggtgccgtctcagctcactgcaacctctgcctcccaggtttaaggattctcctgcctcagcctctcaagtagctgggaagcatgcgccacgacgcctggctaattttttgtatttttagtagagacagggtttcaccgtgtgggccaggctggtctcgaactcctggcctcaagtgatctgcccgcctcagcctcccaaagtactgggattacaggcatgagccatcgcgcccagccggctttaactgttttgtggaactgtgttgtctaactagctagtagcagctttcctgatgttagacagatgtgttttccattttgacccattgtgaaaacatatttcttttctttcttctaccctttctttaatcactttgctgtaagtgtgtttcttggtaataacattgtagctgcttttaattttttatcccagtcagacaattccatgactttctgagcttaactgctgatagaagagaggtctttcatcatcaaccacgcagaggcagggcggttggtaacatttgagagacagtgtgtgtagtggcttaggaagtcatgtggtttctcgttagagaacacagctaggaaagaaggaatcacggtggggtgtattcgtttcctagcactgttataacaaattaccacaaactgggtgacttaaaacaacagaaatatgttctcttaagtgctagaggccagaagtccaacatcaaggtgttggcagaggaatattccttttggaggctgcaggggaggctcctccttccttgcctcttctagctcctggtgactgccagccttgaggccacatcactctaatctctgctggaatcttcgcatggcctcctctttgtctccatcagatctctcgctcactctctcatttttaattttctttttagagacagggtctcgcttcgtcacccaggctgaagtgcggtggcacaatcttagctcactgcagcctcaaacttctgggctcaagtgatcctcccacctcagcctcccaggtagctgggactacaggtgcacaccaccacgcctggctaatattttttgctttttgtagaggcagtgtctcactatgttgcccaggctggtcttgaataggaattctcctgggctcaagagatcctcctgccttggccttccaaagtgttaggattaaaagcattaccaccacacctggcatctctctttaaaggatacatgaggtagcatctagtgttcacctgaataatccaggataatctccccatctcaggatcctcaatgtcatcacatctgcagaaacctttccaaataaggtaacatttacaggttccaaggattgggctctgatatttttggggccaccattcagctcacttcaggaggccttaaaggaagtcactgatgtgttaagagacgaatattttaaggacactttgagctttgagatagtacatatcatttatcatctaggccaggatgctttcaagattgaaagggagctctatggataactgtgttgggaaacaggtgtctgcctagactgtcctgggcaagtgacatagggccaccctctctatagcctctggaggtggccaagacacataagctgttctgacaccattatttctgacatgtctgtgtagtcagtgtgactcattatagtgaggagacaattttgttctttccccaaacttctgaaaggggaattcttaattcttaattttatctagtatttgaggtgtgcctttgctttatttttttaagacagagtctcgctctgtcacccaggctggagtacagtggcacaatcttggctcactgcaacctctgcctccggggttcaagcaattctcctgcctcagcctcccaagtagctaggattataggtttgcgccaccacacctggctaattttagtatttttagtagagacagggttttgctatgttggccaggctggtctcgaactcctgacttcaaatgatctgctcacctcggcctcccaaagtgctgggattacaggtgtgaaccaccgcgcctggcccacctttgcattttttaaatggctgataatacttttcctaactattccttccttaccttggatcacgtggcttggctttgtactgagaaactgtactttggtgaggggaactgggatttagtaagcacctaagagagatggccagagcctgtcagcatacttcatctcttagaatctcttagacaagtgctactgtttaccagtacaggtgaatgatgaggagaccaagcatgattggggtggggggtgagggttaggggaaatgcacttctacctttttgcttcatttaggaaggtataaagccatgtggcgttagattgtgatgagaagctgtgacctacacttgatctctcatcccagaaagaaaatgctcctgcacagccgcaggaggagctctgggcagccctccaagactttctgttgtgctgtttccttcccttagggctgtattacctatgacatctaatgacaatgaaattctgtgtaattgctcttcttggaatgccttgcaaagaagcccagaaaaaaaaaatctggaagcttttaaccagattcaaagctggttttgtttttttctgtaaaccttgctgctgctttttaagcaagccctgcacatatgtaacattttatttggggttttctttgtatgtacaagacaccagggacagattctgatggtgaaggaatggtttcataaattaggacacatccatacaatgtaatgttaacatagaaaaataatgatgatgtaatattaattgtaaaagacatggtgccaagtggtctgagctctggcactgagaatcaagtaggctcagatttgaattccagcccattatttactcagtttatcctttgtaaaagttacttaaactgtctgtatctttagtttccttatctgtaaattaagtacgacactagctactatttatgaagtacctaccatattatgatacatgagtgggcaaactttttctgaaaagagctggatgtcaaacattttgggctttgtgggccgttgggtatctattgcagcagctccactctgccattttagtgtgaaagcagccattagtcaatgtgtacatgaaggggtgcggctgtgttccagtaaaactttatgtgcactgaaatatgaacctcatataatcttcagatgtcacaaaatattgttcttcttttgattgtttttcaaccgtttaaagacgtaaaaaccattgttaactcacaggttatgcaaaaacaggctgtgggctaagtttggcccatggattctaatttgccggtccctgctatagaagacactcaataactgctggttcccttccctggtaaaaacagtaggttgggccgggcatggtggctcacacatgtaatcccagcactttgggaggccaaggcgggcggatcacctgaggtcaggagttcgagaagagcctggccaacatggtgaaaccccatctctactaaaaatacaaaaattagccaggcctggtggcgtgtgcctgtaatcccagctactcagggggctggggcaggagaattgcttgaacccaggaggcagaggttgtagtgcagtgagctgagatctcaccactgcactccagcctgggtgacagagcgggactccgtctcaaaaggaaaaaaaaaaaaaaaggtagattgtgggcaagactgggaataattacttctgaggcgggtaaaggacttgtagtttggggatttcttttttcttttttcaaaatcattttcaagatcatgttctgttttcaataagattttctttttttccttttttgtagcagagaaattgagaacagtttttcctgatgtgaatttctacagtcttgtaatttttttaaaagcctgtcaattttacacttttcaaaaggtgatatttgatgccttgaataacatctggaatagcctgggactctgtcatgattgggctgacttgcaaaacatttgacttttatgcgtttttcactaagggagctgaatgttttatttttggctactgtaccttgacactacctttgtttcagtgctgtacttacttttctttgtataggctagcaagtcagttaactagtaaatcatttttcctgcaagattcagttgggtatgagccaaactctgagacacagaacagaaaccaaatttgtaaacaaggtgtgaagaagaaaatcagaaagcgtgaatttaggaattaccctgtggtttggatcctagaagttaagaaacactggatgccactgaggagagatgagaagggaggattctttttgctggcatcttagtctgtgctactgtaacaaaataccacacactgggtaatttataaagaacagaaatattctttggtgctgggcacggtggctcacgcctgtaattccagcactttgggaggctgaggtgggcggatcacctgaggtcgggagttcgagaccagtctgaccaacatggagaaaccccttctctactaaaaatacaaaattagccggttgtggtggcgcatgcctgtaatcccagccactcgggaggtggaggttgcggtgagccgagatcacaccattgcactccagccagggcaacaagagcgaaactccatctcaaaaaaaaagaaatattctttgaacgtgtgtcctgggaggggggaaaaaaaggacaaaaatatattttctcatagtcctggagactggaagaccaagaccaagcactagcatttggtgtctggtacgggctgcgtcctccagagggaagaatgctgtgtccttacatgatataagacagaagggcaagtttgcaaaatgctgcctgaagcctcctttagaaggaccttaatcccgctctcaagggagcagccctcatggcctaatcaccttttaaaggccccacttcttaatcctatcacattggcaacacctgaattttggaggtgacctttcaacccgtagtaactgattcgacaattgtaggaaaagcacaaaattgattagtattgcaaatcaggttctattacaaagcagttgtagcaactgatttgctctttttattatcctggaactttgttacactaaataattctcacaattagtgaggctaatgagtaagccttggacatttagtgttaatagagattctgttagtaaatatttattgaagaactactgaatgcagagtgtggagctgtgttctgctgcgaaaattcgattttatcccaaaggcaacatggaatatagtacgggggagttaaatgatgaaaacatgagttatgatctataattagtggagaagattgaaaaaataaaaaaacaagaaaaatatattttcctataatctcacattccagaaacatctgttaactttttagagtgttttcctctcattcttttctttctgttttgaacatacatgcataccttttttttttttttttttttgagatggagtctcgctctgtcgcccaggctggagtgcagtagtgccatctcggctcactgcaacctctgtctccagggttcaagcaattctcctgcctcagcctcctaagtagttgggactacaggcgcccgccaccacgcctggctaattttttgtgtttttagtagagacagcgtttcaccatgttagccaggatggtctggatcttctgatctcgtgatccgcccacctcggcctcccaaagtgctgagattacaggcgtgagccaccgcgccccatatatacctatttttgataaaatatatatttctttttaaaaagtggtatattagggaaaacacaaataatctgttaacattttcaatgtaattccttcctgcatgtgtttttacatgaatatactgtgtgtgtgtgtgtgtgtgtgtgtgtaacaaggatcatttgttactattttgaatgaaatctttttttaagcttttattttcttttttgtggctgatatatagaaatactgttgtttacaacaaaatgctgaacgccacctaggtctaatcatgtgtctatataatttcttggatttctttgatgtgggcagttgtattgtccataatttatgatgtggaaaccaaagctatagaaaagttaggtaattttacaaagaacataatatcagtaaatgacactaagtatgaaattaaatagtaactattatcaatccccttacagtattcattctttgaccttgtttttttccatttgtaatagtgttagcgtccaactgtcagctcatgtccaaatgtcggctcatgaattcctctttaatagctggacttcttttagcctctggctgtgtgagggtctcttgacctcagtgatctcacatgtgccactctgtccttctagaacactattctcctcgcctttgctaaacttgccttaaaagtgatttcctcagagggaccgctaataatgatcttgtttaaactttatgcccttcctactactatcatctctctctctcggtaccttttatttctacacacttaccatgatttcagttacacagattgtgacattacatgtacatatgtttaactgtttgcttctttcatatttgttctctatacccagcgtcaagcacttagttttgcagtagtatatgtaaatagtaaatatttgctgaataagatggaatgaatatatcttttgctgtcacaacatgtataattttctttttgatgcttcgttgattgcatctatgatttatccttctcatgtacgtcttagtgggaggaatctaacagtatccatcttttcctgttataaaattaatgttcttacttgtagagtcgtgccccaatttctgcaaaacttgtggccaatatgctgtcggtggctggggcggatcacatcatcaccatggacctgcatgcttctcagatacaggtatccgtgttttccttctgcaaatggttaaatcaagtctgttaaattaaataatcttaggtaacattacttgtgtttgagtttatatatggctactctcttggatttttgtctttactaaacttgaaaatataatttgatattagtacttccagtctctatcaccaccttgccccccagtcaattttggaggagtggggatggctttttggtagtaagctctatatagttccatctcagcttatggaaaataattagaacggcagtcataatgtacactttttaacttcttcataacttattttctttgtctctaaaacaggccaaattatactgtgccactttgtgttatataatgaacgtgaagtatttgatttataataactacttaagagacaacaaaccttttccctcaccgtcctgcatagccattctattcctcagaatataggccatcataagacaatggaatatgtcccaagagacagattggactgaaatatgcccctataacatatctgtcttttgatttaattctgtttaaaattaacaaaagggagtctgttataaaagcttcttttgaacaaaaaatgcaaatgttatttaatgaaagcgattatcgtttaaaaaaacaaaagaaaacaaaacaaaacaaaaccctgcaacatgacactcacttctccctttagggattctttgatattcctgtggataatttgtatgcggagcccgcagtcctgcagtggattcgggaaaacattgccgagtggaagaactgtatcattgtttcacctgacgcagggggagccaaaaggtatcatgcaggctacaccttgcagatttctccatctgctgattggtttttccttttccgatgtattagataaggaagcatgctgtaaattacttaaagctttattttgctaatgagcaagtaagtagaccgcaggcttcacttccagagcagaaacccatcatctttgttaatatttcgtcattcaggaaagaagaaaatacagagacacacatacacaataggtatatattggtttatttgttttcagcaaagggtagatgtgtttgaggtttttttaagttatcgttttctgattataaaagtaatgagcctaattggaaaataagtcttttaattaacagcacttggaaatggtagccaaaatagaacaatttttttttaaaagaaatctctgtacatagaataccaagaaggaaatatctgagaccaagaaataaagcagaggcggaaagccatgtccaggtggcttgggggatgggcatcagatccagcaagagcctggtggcttgggttttaatactcacctggaaacccccataaagaagggagttaaagccaggcacggtgatgtatgcctgtaatcctagcaccttgggaagccgaggcgggagaatcacttgagcccaggtgctccaggctgcagagagctatgatcacaccactgcactccagcctgggtaacagagtgagaccctgactctaaaaaaaaaaaaaagaagaagaagaagaagagaagagggctgaaggccagatttctagccaaaagccagggggaaagcccatctttacctcggcctttggtttaggggaggaaatagtcacctatgagaagtcaaaccacgagcctgtgccacattcagatgtggagtggaatgcacacgaaaatgtgctccaggctgcagagcccctgcagagggagaatttcacaatcctagctgctcggtgagtgctccctgctcaacctgacccgatgcctgatccaaagttagaaaaccaagagaacacagtccacgcaggcccagcatgtgcagacaacagggcagcaggcagccaatacttggggataagataataattactggactatcaaataagtaagtttaaaaggaaactgaggtgaaggagagttaacaacaacctggtcgtaacagtacggcagtgatgaggcacccagtggtgtgagaacgtggtactaagtagcacctctgaagggcttcacagagatactcgaggcgttaacaagcaatcagggtacagggtgttcagaatcaaggatgagcacaataagagaatgctgcaagctgaggcttggtgacccaatgaccttgtagagctttgcagatgctatctgggaagaaaaaaagctgggaagggagttttattgtgtaggtagagacctccataagggagaagtaggagagacttctaccccccagtccagtgaggaagcaaggaagctctaaatgtgcactaatagaggagtgatgagagtgacaagtgatcagcctttggaatgtctgacatcaaaagcctgtccctcatttggcaccctcatctgcctgcagcccagctgaggacctaggatctaacacaaaagcttagaagtagcccagaaagttgtcttaacactcttgcagggaaacacaggccctgattcttagaagagccttgttcattctgctcaaagctgccttccaacggctgctggggttcccagcacagaagagaaggaacggaccatgcagctggagatcggcctctgccagcagcaggaagtggctgtggccagggaggagacacaaatatataaaagacgggagcagaaagttaacttgcaaagaccctaggtgggcagtcacggggtggagggcagcgctgtgtcacgtagcctattactgtacggtgtgtaatgttcacaaaaatgcccttggccaagaatcaaggttgaatgacgctgagagtcctctgcaaaagattgtgagcaacattttggagtcatatctactagaaatgcttgcagttgacttggaaacttctgcaagtcacatggaatctgcattcaaatgaggcaaatgcactggcccagtggaaggttagaggcaaagaatccagccaaaggggtacaggagcgagcgtcagatgtaactgggttataataacagctttgttacaatgtaattcaaatacgtacaattggccgggtgtggtgactcacacttgtaaccccagcactttgggaggccaaggcaggtggatcgcttgaggtcaggagttcgagaccaacctggccaacagggtgaaaccccgtctctgctgaaaatacaaaaattagctgggcttggtggtgcacgcctgtaattccagctattcaggaagctgaggcaggagaatcacttgaacctgggaggtggaggttgcagtgagccgagatcacgccactgcactccagcgtgggtgacagggcgagagtccgtctcaaaaaagaaaaagaaaataccaaaaaactccaaatacgtacagtttacccatttaaagtgtacagttcagcagtgttttgcatattcagagatttgtgcaaccatcactatctaattccagagcatttttatcaccccaaaaagaaaccctgtacccattagcagtcactccccatttacttccccccaccttatccctggcagccaggaatctactttctatctttatggggttatcttttggagactttgtatatcaattggtagtatagaacatggcctttgtgtctggcagatacctttgtaaaccagaaaatgttattttggcagctactcagcccaaagaatagtagattccacaaatttgtatgaccatctttctttcctcccccaaccttgtttttatatacatagtctaagaatatcatacatgctcttagcagaaattcagacagtacaaaagtgtcccatccctgttctttaaatgccaccgttatttccagtgtcagaattgtgttatttaagcgtatatctgcctatttatttcacgcaaatggcaatgcgatgtacacagttcttcactgtgcttttctgaaaaactcacttgctgtatcttaacaatgattccatagtcgtgttgtgcagctgtgcaatattcccttgtgtgcatgtaccacagctcctgtgaccagtcaggccccctcttccccatttgtaggtgccgttgtttgcactcttaaatgcagttgtgaagcaatatcgttgctttgacattttgtacacgtgtgctagtaggatacgttcctagaagtggaattgccgagtcaaaaggcatgagccattttaggtttgatgggcagtgccaaaatatggtcttttccaaaaaatataccagttgacattccatcatgtatggatgccagtgactttctacacagccttgctcacacagtgggttatcaggcagtttacttccagatcaggtaggtgatctatggcatcctcttcctgtgagctctggttgctgtgggtgagggtagtgccctcaccagggtatgttgattttccatgagatgggtctctattcaaatcttttgcctattgttctcttggctgggacgtttcttgtggattgtctacagttttgcatagacgagatcacagctgtttctcatgtgtgttgcaaatatttctccaagttttttcatttcttctcctattttgtatttttattctctgcaggactttaaaaaccttcttacgtagtcaggtttattttttcttcacattatggcttctgagtttatgtaggagtcatccttctcttaaaatttgtcttctcccatgattctgtatatttttttcttttttaatgtcccaagtttacttccatctgaaatttattttggaataaagaatgaaataagaatccagcccccccacccccgactctactgtctagtttttccaaaactatttattaaataatccacctctattgatttgaaatggcatctttcatcatatacagagttccccatttcaaatagatagctatttgccaactcctacttttaaaaaaatgcagaataaagtaaacagaataaatggctggggttgagatgctgttttgttttgttgagacctcctttcaagcagtctgcactcaatcacccctgctccctctgccaggaaaatcaagctttttagggaagtacatttcagaatttttgtcacctcctttctcttttccaagtgtttctgctacacattattgtcatcctcatattctagcccccaactgacagtctcctcagaacagccttgcgggtaatacatgacatatgcagttgacattatctgtgacttctttgcttgatgcaaaaggtcatagttagcaaaataaaatactgtaaatttctgtctgaccaattggagcttgttgctttagaaaaagctttgaagcttgactcgttccgggtaaaactgaatgttgccacaggaggtcactcttgggtaggctttgtagcttggttgggttgaccacggaaagaaaattaaacctaagaaacctacctaccactgctgagatagcaagtgtcaacctaaaagtggtatgggaagagggtaaaactagataactcagatttaactttttttctgattacataatctttgaagatgctctataggaaatttggaaagtagaaagaagaaaatcttaacactttatatctcaaccagtgatgccactatgaataatttggtgtactatgtatctgtctctcctgggggagctgatatggcacatgcacccacagagaaaagattgtaaatatgtgcccagaagaaatccaaaactgtatgtatataattttcgttctgcctttttctgcctaagatttcagtgtggtatgttgtgtcaacatcatttgttaggagtatgtattaggtctccatgatatacaaggaaaagaagagttacctatagctttttcaggaaatcatagcgttctaacaacccaggaagctgtttgcaggggtattttctcttatcttcttcttctgacattaccattggataccttttagtggctagggctccccactcaagtgagatgtctgtgtcccccactgccaagaaccacagagctcaccttctttcccagtcccacttccatgcctaccctgctgtctgcttgtgagcaggctcgtgagaacaggcgccacctggcagagagatgaaaacaggttctgctttaacttctccggtatagaacttccaccacaaagggcagtgcttcccagtgctgggctgtggattggtatcctgtcatgcccaaatctgcctagtcgttaccaaataagcagacggtaatgtatgtggacattttgtgcgaggtgttcatgtgtcttgggaaaacctgtctcatgttcccagaaagtagctttccttacctggagtttgagtggcttttatgacattggcatgtagataatagaactgtacgtgtttttttgtttgtttgttttttgagatggagtctcgctcagtcgcccaggctggagtgcaatggcgtgatcttggctcactgcaacctccacctcccgggatcaagcgattctcccgcctcagcctcccaagtagctggggttacaggcagccaccatcatgcccggctactttttgtatttttgtagagatggagtttcaccatgttggccaggctcatcttgaactcctaacctcaggtgatccacccacctcggcctcccaaagtgctgggattacagctgtgagccaccgtgcctggctgaactgtaggtgttttaaggtgatgatggagcaaaatttttgttggcctttaaattaatttttttaattaaatctttaagtaaggaaactgttgacagctagacaagtttacaaacaaagggtatctgctagggctactgtggttttggttgcatcctgaagaatgagtgttttaagggtaggatgagtgttctaagggtaggagaaacatggacctcaatatagtaatgattccctttgcttcaaggacgttgatgtcttattctcttatctcacagtctctgtgtttaactggaaagtttggtcccttttcttttatgataattgacatagttggatttatgaccaccaccttactatgtggtttttttgtttttgagacagagtcttgctctgttgcccaggctggagtgtagtggcgcgatcacagctcactgcagcccccgatctcccaggctcaagtaatcctgccaccttagcctcccaagtagctggaactaaaggcgcatgccaccatgcctggctaatttttgtattttttgtagagatggggttttactatgttgcccaggctggtctccaattcctgggctcaagtgatctgcctgcctcggcctcccaaaatgctgggattataggtgtgagccaccatgcttagctactatatgctttagtttttccttctccacaaagtagacattattattattttggttttgtacaatcaacatttgtttagatttgtccacatattgatcaatatctttgcttacctttctctgcccctgcccctcaccacatctcaatgtatctgtggtgattttccttttgcttaagttgcattctttaagtggttatatgttagaaataaattctcaggttgtatagtttggctgaaactatctttattttgctctccttctggaaaggcagttttgctgagtatagactcctagcctgagagttattttctcatatcacattgaagatatgactccataacttctggcttccattggggaagttgaggacttggccatccttactaggtgacttgtctttattctttgtctcttttaagctttcttggtcttctatagttttgttaagattgtttgggaattcatttgttgggtttattggatccgaggatcctcagatccaataaacccaacaaatcatcaggaaacagttgtcagaagacatcattggtcctgtgtttcctacggaaataaaaaacaataaatattgcactgaatgtttgtggtttggtgtccctgaataataaagaaggaacatatttgcaaaaagttgcatagggtttttttatgcagaattttgtcagaagacagtggtgctgccatgtttttctttgagtgcaaatgtacattgctaagatttttttaagatggcatgtgctttgaaaagaggatattgcatttttaagagtttaaaaatcttatgagtgagaaatattaaaaaatcttattttcccctctttacaagaaataaaagatgttcctcataaaaaaaaaaaaaaaaaaaaaggaaatattagccgaataggttatacagagttaccatatgacccagcaattccactctgaggtatattccccaaagacttgaagacagggactcaaacagatacttatacaccagtgttcatagcggcagtattcagtatagccaaaaggtggaaccaacctgagtggccatgaacagatgaatggatgaacgcaatgcgctgtatccacccaatggaatgttattcagacttaaagagagatgaagtactcatctatgcagccgtgtggatggactatgaacagtttatgctaattgaaagaggccagacacaaaaatgcacgtattttatgattccatttatacaaaaagttcagaatagagacagaaaatagattcatgcttggcagggcctggggggaggggagaatagggagtgcctgcttaaggggtgtggggtttccttttgatatcatgaaatgttctggaactagacagagataatagttgtgcaatgttgtgaatgtacttgatgccattgaattaatacactttaaaatggctccaaggataaattctgtgttatgtatattttaccacaattgaaaagaaacactggctgggcacagtggctcatgtccgtaatcccagcactttgggaagctgaggtgggcggatcacctgaggtcaggagttcgagaccagcctggccaacatggagaaaccctgtctctactaaaaatacaaaattagccaggagtggtggtgcatgcctatcaccccagctactcaggaggccgaggcaggagaatcacttgaacccaggaggcagaggttgcagtgagccgagattgtgccattgcactccagcctggtcaacaagagtgaaactgtctcaaaaaaaaaaaaaaaaaagaaaagaaaagaaacactggttgtgttgtgaaaatcctcagaaatagggaggggagcctggagcacctaactgcccttcccactgccttctcagccccagagagtgtcccctctgtccttcatcagagcacgcgaggagctccattcctggtcgtcatctgaggatgacacaatgagtaggactaggactttaaaactagtgtgtggaggttatatcctccatgtactgcgtcttaagttgggccatgtgtgtattggtccccaaagcattttttcagctaaattgcataatgactgttattttaaaaactggaaaaggaaaatcttaatgttacattatacctgtggcattgtcttgaaataagtttcaccatttaaatccactcttcacaggaaaatctgaaatgccccaggctcaccagcaagcgaggcctgcccactttctcttcctgttggcagctcagctcctcctgagctagtgatttttttttttaaagagatgggatcttgctatgttgtccaggctgtattcgaactcagacgcaagccatccttctacctgcgactcctgagtagctgggcctacaggcacgatgccatgcctggcaccattgatgtctgagcatttgccttagatgagcagaggagctggactcacagtttaaagtctccttagaccttgaatgcaatgaagcccatcctgactagcctacatattagatggctgtattaaccaggacttttgtccccactatctgtgccacaaactgggcaaatagtagttcctaaataacttactttaagttgtacctgtcatggttttaaaatgctacccacaaatactaacaaactgaatatcaaattcttacccagtagttctatccagtggccagggtgccctgacggtcattcctagctgccccaattgcaaggtccgccattagcacatttctccctgtggattgctaagtgcctgccccagaccatgcctgggctgatcaagagaggcctgattcttgcatcatctctcgggtgtggttgcctgctacattcccaaaatacaactttaaaggcgagatctctagttgactgtatgaacatgttcatttgtgcctttgccagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagtacgcagggcggtggggaaagcgttaggacttctcactaggaaagggaaacacatcagcttttagaaattgggctcttttttcctgattattgccggtcttggcagtggagttttagaccaaaggagattctaggcccttttatctttatacttctttctctggtagaaaagaaagcacgggccttttcgttttccagggtgagcttgtagtgtacctggaaaaaggtcaaagaaggtgcttccctttgcactgagcacgacaggaaagatggtttttcgggcttcttcaggccctagcttccttccatttggctttcgtgccagccttctcagccacatgggtgtctggaggatttgtagagctgctgcccagtatggaagcccccacccagccacacgtggccgtggagctcttggaatatggccagtctgacttgagatgtgctgagagtataaaaaggccactaggttttggagacttaatatgaaacaatgaatatatatctcatttacatatatgtttttatgttgattacacatcaaaacaatgatgtttggctatattggtttaaacaggtggttctcaaccaggagtgattttgctccctgggagacatgtggcaatgtctagagacattttttgttgtcacggctgaggggtgggttgtcgttagtgggtagaggccagggatgctgttgaattttcccataatgcgtaggacagcccccgtgacaaagaattatcctggctcaagtgccaaggttgatagtccccgatttaatggaatacaaagtgttttgctcatgcttgagtgatcctatcttaggttaataaatgtgagtgaaatttgttgcatttttcttttacggagcacactttgtgcttttaccattcatactaggggagagtattccaagaatatttgcatacccttaatttttatcttctgctgttctacaggctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtactgtctatacaccaaaggcagccaagcagccaggcacctactttagatccttaaaaatagcatcatgtcttgtgtgtgtgtggctccttgctaaggcacatgcttggcagaggcggcagcttctcatgacggcaggatataaatcatattagatccctgaaaaaggccaggaccagcagaggtcaacgttcgctatttagaaatagagagtgaagaaaatcacaatggaaaaacagtcagaaacgggttgtgctaaagctaaacttagaattatcatatgatccaataattccacccctaggtatatgccccccaaatttggaaacatattcaaacagaaacttgtacagacatgttcatagcagcactattcacaataaccaaaaggtagaaccacccaatggccatcaacggacaaacagatggccaaagtgtgctctgtcgctacgatggaatactattcagcctttaaagggaaagaaatcctgacacatgctacagcatggatgaaccttgaaaacatcgtgctaagtgaaaaaagccagatgcaaaaggaggaatattgtgtttccgcttctaggaggtacctgagattggaaaattcatagagacaaagtagaatggtgcctatcagggtctgggggtggggggggcagtggggcgttatctatcatttaatgactatatagtttttgtttgggatgatgaaaacagtttggaaataaacaatggtgatagtttcacacattaggaatgtaattaatgccaataaattgtatacttaaaaatggttaaaatggcaaatttgatgttatatatgtaaattttcaactgataagaacagacactatacttgatcttagccagatagataaatagatagatacatagatagatacatacacactcacacagtgaaaaaatgggggtgggagcagcaggctgagctgaggatcttcagagctttgctccttcccgtccctgctgattggatgccgacgggccagcagagagctggtaatcatatagatagcaattggcctgaaataagtcaaaagggtttgaggcccattttgcctctatgtcgctgtgaaccttggcaagtcatttcattgctccaaagcctcggctcccatcagcgtagcatgaaggtgcatcacagtgatctgcttcatgatttctgattcctcagagagaaaagcaatttgcttgacacaaagcagtaagtctggaaatggtcaggatagcgatgtcatatattttcatgcctgattagcagtagtttaggatgggagttggcacactatggctcgcaagtgaaatccagcctgtcatctgtttctgcaaatttttatcagagcacagccacgtccattcatatatgtattgcccgtggctgctttcacgctacaatgggcaagttgagtatttgtgacagagaccctctggcttccaaggtcaaatatgttaactatttggtcctctatagtttgctgacccctgagttagatgatcacagttgtgctcttaaatgacgcagtcaccgccttttcagaaacagaaagaaaaaccttccgtataatgattaaacttaatttaaaacaacaaatgcccctggaaaaggatgtctctggttaacagtatccctgaaaagccttctgtctctgcattgaaaatctcccttccaggatcccatatgggtctggttcaacgggttgtaatttgaagacataccccaaagctgtctgtcctctcaaaagtgtcggaagttttgatagcaacacatcatgtatgctgcagaaattgtttctcagctttccagcttttcaatgtttaaagaactctaactaagatgtcctgcttcccttctccctttgtttttctcattggcatttaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctt

SEQ ID NO: 4291 - DNA, 32852 bp, human
ctccccttccctacatctagccgccgcgctttcccgctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctgtcccagcgcgtggccgaccgcctgggcctggagctgggcaaggtggtcacgaagaagttcagcaaccaggagaccaggtgggggccgcgccggcggccgggctagggagagcgctgggcacgcggctgcggggccgggttgggggccggcgcctgcccgggccacctccgcggacgccgcgctcccccttccggggcgggacggtggcaacgcggcctccgcgcccccgcgcccgcgcctgcgaagaaaccgaggcggggcgccgcgcgtcccgatgcgcgcctcggctgtgcccccggttgcagggcctccggtcctgggaccgcggcgacccggcggtcccgagccgctcccggcctcccagcggtgccgcccggcctggcgtccccagcccggaagggagacgtctgggcggtcacagaccgtcggggagagagtgggcgcagcgggcgggaaccgcatcgggtcagcgcgcggtggagagacgtcctgggttggctggtcccagtttccgcgtccctacaaagctgaacctcagaccagtgcgtgcgactaaaggtttccccccgtccccaactctggttgcacgctgggtttacctggggacggtccgaacgctgcttcccccgacctgcccccaagggtttgatccaacgggcggaggatcagcgattttacaagcttccctggcttctcctgagcagccagggcgcagaccactgcgttatccagagggtgcagttgtgccaaggtttgaaagactgtgagaaccccaggacgcacgtgctgggctcccctctgctcccactactcttgctgctttaaagatgatggactttcagcttccttcttgttctaggactctgctgtgtccagcaacaacgccgtgattcgactgtaactttcacccatttctcaagtccaggagagcctcaggtggtggccatcctcggaagctgacctggggggctcctttgtctatctgcctgagtccacacagctccttgactcatttcaaattggtctcatttttcccccttcttcctccaatgtctagtaccgttaactgtccacagttactgataatttttatatctttggcaaaggttcaattttaccaacattttctagaaatggtgttggaacagttggacacccatatgccaaaaaatatgaacttccatccatacttttcaccatttgtaaaaattaactttgaagtggatcatagacctaattgtaaaatctagaactataaaatttctagcagaaaatcttgacttggggttaggcaaaaatttcttaaggaggagttatgttaatactgatggggaagatgctatattttggcaagtcagctttttaggatatgtgaatcttacgtgacttcttccaggtggcaaattccagttatggctccgatgataatataagcgaagaaacattgtgaatgagtggcaggtggactttggctaaagaattccactctgcagtgtttaatgcagaagtctgagaggatggtctagggctctggagaaggatagagctaggtttgagtgttgcagtattttgccagtcttgttcaagtttcagtcgctgtaagaacacgagaagaagaatagtttttgttcagaaggtgtcgtcatataagtaaaggagaaatttgttgatgaagtaaattttgaaagcaaatatgttgcccttccaggtactcagtgcagcatgatcttttgctaaggagcatggttaatctagatcagttcactgctaagtcagtgttgagtttctcctaaaaataccacatgtgccactgggcaaaactcactcagacactgaagtatgattgtttatacatttggttcaaatataaagcagactcacttttattttgtttttggcattttataaccatcacttgataattagaaatcgtgggacctcaaaaaccactcagcatgaagtttgggaattgcctatatagctacattttatgtttttaatgtatagagtataaaaggttcactgcctgacttttctcttttccatgaactgtacaagtacagagcttaatttttataaacagccctctctggaccagttactgtgctaggaatccagcttttagctgtgtaatcgtagagaggaaaaactgaagggcaaaatgaagacaaaattgattcagttcatgtaagggccccttcttgaatctgtcactgaactaggatcagaaatctggtttgctgtctcctggccatcaatcctcccattttgcgttttttatatgctactttactgaacatagagccttccaattttaccttcttatccctaaatcatttcagatatgcagggagaggtccgctccagcttcactatagaccatggaaattccatgatgacatcttaggacagcaggtgtctagatgtctctgttgtaacattttactatggtcagttaacctgctggcagaatctttagctatactgtgagacaaggttatgcaaagttatacaaggttatcggttaccatgtaataaataaagagcttaatggcttaaaacagtaattgttgatttggcttacaaatctgcaatttgggaagggctcagtgaagaaagcttgtttttgccgcgtatggtcacagctgaggctggtcacagctgaggcggctaactggggctggagggttcttgaagatggctcacatgactgaagttgttactagcttttgcctgggagcttggttaggaacctcagctcctcttcttgtaggcctctccatggggctgcttgagcttccttacagcatggaagctgggttctaagagcacatgttccaaaagacaggacattgaagccaccagtccattaaggactgggcttgcaagttggtgtatcataatttctgtcatatgctgttgggcaagtacagagccctctcagattcaagggcgggagactagaccctgctccttgatgggaaatgtgttaagagtctgtggctatcttttagttaccatgcccgtttattgttgagtcagtgacgctcttcagcgtttttatttgggggtcaataaagatcctctggcagaatggcaaatggatgctgccttctagccacaattttttaaagacctagaataaaggtagtcatgatcatctttttgagtagaagcaggactagctttaggggaaaagttgccatggtgatgatattctctgtcctcccctggactgctagtcatatgagaactgaggttcctgagtaaaaacaggccaaagaatctaatcttgtgggataaacgtcataagaccaggagttggcaaagtttttctgcaaagggccaaatcgtaaatattttaggcagtgctagcacatgtagtctctgttgctgcggtatcttacagttctgtaagttacggtaatgtctgtcacaggttagcagggctgtattctcttctgaggctctaggggagaatctgttcccgtgccttttccggtttccagaggcagcccacattccttcactattggcctcttcaccttcaatgtcagcaacaaaatgttgctctgaccctgcttctgctgtctccctcttgcatttttaagggccccatgattacaatgggccaatttaaataatccaggataatttccccatgttaaggtcagctgatgagcaacctgaatgctatctgcaaatttacttcccctttgccatataaactcacatattcaaaggattaggatgtagacatctttagggggccattattctgcctaccacgccattcttaactcacaggccatagaaaaacagcctatgtgctgtgttttgtcaacctctcagctatataatactgtacttgatttctgctgtagttcattttgtgctgctataacagaataccagagactggctaatttataaacaatagaaatttgtttctcacaggtctggaggctgggaagtccaatactgaggggctggcatctggcaagggctttcttgctgcatcatcccatggcagaagggtggaagggcaagagagcatatttgagagagagcaatagagggccaaatttgctaatataataaacccattctcaagataatgagcacactctagcaatgatgacgttaatccgtttgtgaggacagagcccttatgacctaatcacctcttaaaggtctcacctgtcaatactcctatactggggattaagctttcaacacatgaactttagggaacacatttaaaccatagcaatttccaaattaagtttatgtcatagttgatgtagtgttcacaaagcagttagatttagctccttagatcttcaaataggagggagcacatagaactctttctatccccctcatcctgtgaggttggcatattttcatccatagtagaaggcgtgcaagaagatgtgtgaatgttatcaaaactaattttcacaacatgtcaacttgaaaaactttatttttattttccttttctttaaaattttttttagagacggggtcttgctatgttgcccaggctggactagaactcctgggctcaaacaatccccttgcctcagtctcccaagtagctgggactgtgggcatgagccaccatgcccagcctgtttttaaattttcattaggtataattggctcttttttttttttttttttttttttgagacagagtttcacttttgttgcccaggctggagtgcaatggtgcgatcccagctcactgcaagctccgcctcccgggttcaagtgattctcctgcctcagcctcccgagtagctgggattacaggcatgcaccaccacacctggctaattttgtattttttagtagagatggggtttctccatgttaggctggtctagaactccagacctcaggtgatcagcccaccttggcctctcaaagtgctgggattacaggcgtgagccaccgcgcccagccttaattggctcttttaagaaaacaatttcattgagtatctgatagcaggagaagagagaaggataattattcatgttccttatttgtaattttaaaatatttcattttgggatgaataaatttacagacaattctgccataatgtgacatatgtattcctaaaaattaccacgctatgcaaaatcaggcaatccaaaaccacagggcttatgagaaaaatggggttagggacataacattcaaaaacttcctcagtgacccattaaaaaatcataggaatgttatatagattgagcatcccttatcagaaatgcctgggacaacaagtatttcagattttttttttttttttttttttttttgcattttggaatatttctattgtacttactggttggacattccaaatctccaaaaatccaaaatccacaatgctccaatgaccatttcctttgagcatgatgtcgacactcagaaagtttcggatttcagaatttcggattagggttcctatcaaaatggtaaaacactgacatgtattacatgctcaaaaaatactggctgggtgcaatggctcacgtctgtaatcccagcactttgggaggctgaggtgggcggatcacttgaggtcaggagttcaaaaccagcctggccaacatggcaaaacctccctccactaaaaatacaacaaattagccaggcgtggtggtgcatgcctgtaatccgagctactcgggaggctgaggcaggataatcacttgaacctgggtggcagaggtcggagtgagctgagatgtcaccactgccctccagcctgggcaacagagtgagactctgtctttaaaaaaaaaaaaaaaattacataaatattatgacagagatggaactttccattgaaaaatgcctgaggtttagggttctctgaaatgacatgaaaagttgtgacaccaaatgtgaatgagtgtggctcattgtcctcgaggtgtgtacatgtgtatgtttgtgtatttctaagtggctccattcagctgggtacactgcagttttctgcagtctcgggataagaggttgtgcataagaaaacatgaaattcatgctatgctcaaattgttccaaataatatcaatcattggaacaaatttgccttttcaaaacatagcagagctgaccatcttcttggtttggacgcagagctctgggaaggacatgcctgagcacacagcactattttctgtttcttcccaccaaaggaatatgccagggatgagctggctctccctctcatgttggacatccagaattctgtacctggaaatacagaaacttccagacatgcaattttcaaaaacttagctgctatttactctttctccagaagctacgcaaggatgccaaccagcaaaacaaggaagtataccaagaaagaggatacagaaaatggcaaatggagtgcaggagagggggcagggaatccccggatggcagctgtgcacaggcagagagataacccaggcctgccacccctgggagggatgcctgcaagacgatgaaatgcagatgggacttgaggcctctgatcttgggagattttgattgttagtgaagggtttagggtggaatctggattcaggattcagaaaacttagcagataaaaaggtaagagaatgacctccagggaaaataaaaagaaaagatgtgcataaaaagaaaatacaagcattcgtttaagttaattgcatggcagagctctgagcagcatttgcgcagttaaaaacgtacagtcaatctttaatgtgaatattgatctatattgggatgatggcgagatgggaagtttacattgcaagtgatggaactgaatggaaatggagttcagtcctcatcttccatagtgagaagtcaatacactttgcctaaaatgaaaaatcaagacacagcaatacacacatagtagctagacttgaaggaaagtatccaaaaaccctatcaagagttgaaattggtggcctctgggcactttctctgttatacgtcttacagaatggtttgaattttttaagcaatatgactgtataactttaataaaaaactaaaactaaatgtagtattttgcagaaaagagttaacattagcaggcctgagacttaggcctgttcgcaaggttggcccttggctggcctctgggagcttacattttgcaagggtacccaccatttcccagtaaggatggctcactgcataaactcttaaacaattgataaacaatgtggttcatgctgaatgcctgtgagtctgacattttggtacgtgctaggcagagggtgcttatatgaccagcccacaatacaaaccctgggacttgagtctctaagcagcttccctggtagagagcccttcacacgtgttgtcacagctcactactggggcattaagctctacctctgactcccctcagggaggagtcttggaagcttgcaccctgtttcccccaacttcaccccatgcacctttttccctttgctgagtttgctctgtgtcctttctctgcaataaattacagccatgagtgcaactattaggctgagtcctataagtcatcctggtgatcatcaaacctaggggtggtctcagggacgcccaagatgcaaatatgcttcgatattaaccgatggcagttttcttttcctagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaaggtaggagaggtgtgtgccctagaaacctgctgtgggccactgtcaatgttgtttttcctcatttatccccttgattagaattatctggaaaatgttggctttttcctttgatgatcaagtaaatatgctttcttattttgtttgttgaagatttggctttgaacctaccctgacattaatattcaaagaaacaggtaatgcatatttttgcaggtattaaaataccattattgtccttgttataatgaaattattgtatgtctttgtggtggtggatagaactaaatacacacacatacatgcacaagagtacaagtcaaactagagcacatctgaatcagatcactggattgtatcaatttcagggtcctggctgtgatactgtgttatagtttcacaagacgttaccacagggaactaggtaaaaggttcacaggatctctgcgttgtttcatacaactgcatgtctatctacaattcccccgaaataaaaagtttaattaaaaaaaaaacccatgatctctttttaaccttttaaaaagaacagaaatagtatcattgaattatgtttttcacaacattagcatcagaggaggctctgtgagtctttagaaaaaaattgaagaaaatgtggttggtctttgcctttcagagcaacagagaaatcggaggttgagaagaactttgaaggagattgtattagttttctaagctgtcataagaaattacataaaccgcgtggcttaaaagagcagaaatttttccctcacagtttcggaggcccagaagtgtgaaatcaaggaatgggcaggggcacgctccctctgaaggctgtaagggaggctgcttcctcgcttcttccaacttctggtgtctccttgcattccttggctgtggctacatcactctggtccctgcctctctcttcacctggcctcttccctgtgtctcttctctgtttcttataaggacactgtcattggatttcaggcctaacctaatccagaatgaactcaacttaatctttaccttggttatatttgcaaagaccctatttccaaaatgaggtcacatgctgaagttgtgggtggacatgagttttggggggatattgtttgacctactacagtggtcaactcccagctgttgtgtgttccgtatcttatggatagatagatgttcagccaggctcagcgagaatcctgccagttttcaagacacactgctgttctgtgatttggtaactcagtgcaagaaaggttttccccaatatgctgctttttatctccataattcatttctgaaacaacacagatttctgaagcagcacacaagatcccctcatatttgaaaaaaaccctttataaatttgaattcatataccaaagtccccctgaattttaatcccagtctcctcaagacatggtttccattccctgtcttgaagatggccagtcagttaatttctcacctaaaatctaattagaagggtccacatactttatctgtaaatggctatatggtctgtgttgcaactattcaactctggttgtacttcaaaaagagcaatagacaatatgtaaatgaatgggtatggctgtgttccaataaaactttatttatggacactgaaatgtgaatttcatattattttcacatgccttgaaatactattttgaatttttttcaaccatttaaacatgtgaaagccattattagctcacaagcagtaccaaaacaagtggctggtggctggtggctagctggatttggcctataggctacagtttgccaacccctgtattagaccattgatagattgcgtgcgcacgtgtgtgtgtgtgtgtgtgtgtgtgtgtgtgtatgtgtgtgtgtgtttatgatctaaacttgaccttgggcagccaaaaccttaggtcacatacactgctgtgaagctgtatcctcccactagctatttatacagacagctccttttattttaaacttgatttaaactgtatttttagctgttaaatttcaattttctaattttgtcccattggtataatctgttgtcttagctattcttcccatctgtgtgtttccacaggattgtttagcatctttctccttgtcatatcacatccatgtcatagaagagctaattttctgccattatttcttccttccttgtggtttagtaaattctcacattgtagctggttttttgttgtttgtttgtttgtttgtttttgagacggagtctcactctgtcacccaggctgaagtgcagtggcacgatctcagctcactgcaacctccgcctcccaggctcaagcaatcctcctacctcagcctcccgagtagctgggactacaggtgtgcaccaccacgcctggctaatttttgtatttttggtagagacgaggtttcaccatgctggccaggctggtctcgaactcctgacctcaagtgatctgcccgccttggcctcccaaagtgctgggattacaggcatgagctaccgcacctggcctgtagctgtatttttaatcaagctctttcactcacaatagattttatattttgtatttggccctaagatattgaatatattgtaacttctttagaaaattactccttttatcattgcacatgccctcctccactattacccgatttgtaaccccattttgttcattaagtgataaaatatcagaagctctacatttttgttagcacatatctgatttgcggtgacctctttttacaaagttgtattttcaaaatgttttcttatttgagttggagaaactagcactgttttttcccaatccttctattgtaggaggtgtgatgcagtccagcctccatcccctagttgccagtagtgctcccagccaccactaacaagagccctatggatttctggaactccagtggctataacttgtgttttgttttgttttgttttgttttgttttgtttgagatggagtttcgctcttgttgcccaagctggagtgcagtggtgccgtctcagctcactgcaacctctgcctcccaggtttaaggattctcctgcctcagcctctcaagtagctgggaagcatgcgccacgacgcctggctaattttttgtatttttagtagagacagggtttcaccgtgtgggccaggctggtctcgaactcctggcctcaagtgatctgcccgcctcagcctcccaaagtactgggattacaggcatgagccatcgcgcccagccggctttaactgttttgtggaactgtgttgtctaactagctagtagcagctttcctgatgttagacagatgtgttttccattttgacccattgtgaaaacatatttcttttctttcttctaccctttctttaatcactttgctgtaagtgtgtttcttggtaataacattgtagctgcttttaattttttatcccagtcagacaattccatgactttctgagcttaactgctgatagaagagaggtctttcatcatcaaccacgcagaggcagggcggttggtaacatttgagagacagtgtgtgtagtggcttaggaagtcatgtggtttctcgttagagaacacagctaggaaagaaggaatcacggtggggtgtattcgtttcctagcactgttataacaaattaccacaaactgggtgacttaaaacaacagaaatatgttctcttaagtgctagaggccagaagtccaacatcaaggtgttggcagaggaatattccttttggaggctgcaggggaggctcctccttccttgcctcttctagctcctggtgactgccagccttgaggccacatcactctaatctctgctggaatcttcgcatggcctcctctttgtctccatcagatctctcgctcactctctcatttttaattttctttttagagacagggtctcgcttcgtcacccaggctgaagtgcggtggcacaatcttagctcactgcagcctcaaacttctgggctcaagtgatcctcccacctcagcctcccaggtagctgggactacaggtgcacaccaccacgcctggctaatattttttgctttttgtagaggcagtgtctcactatgttgcccaggctggtcttgaataggaattctcctgggctcaagagatcctcctgccttggccttccaaagtgttaggattaaaagcattaccaccacacctggcatctctctttaaaggatacatgaggtagcatctagtgttcacctgaataatccaggataatctccccatctcaggatcctcaatgtcatcacatctgcagaaacctttccaaataaggtaacatttacaggttccaaggattgggctctgatatttttggggccaccattcagctcacttcaggaggccttaaaggaagtcactgatgtgttaagagacgaatattttaaggacactttgagctttgagatagtacatatcatttatcatctaggccaggatgctttcaagattgaaagggagctctatggataactgtgttgggaaacaggtgtctgcctagactgtcctgggcaagtgacatagggccaccctctctatagcctctggaggtggccaagacacataagctgttctgacaccattatttctgacatgtctgtgtagtcagtgtgactcattatagtgaggagacaattttgttctttccccaaacttctgaaaggggaattcttaattcttaattttatctagtatttgaggtgtgcctttgctttatttttttaagacagagtctcgctctgtcacccaggctggagtacagtggcacaatcttggctcactgcaacctctgcctccggggttcaagcaattctcctgcctcagcctcccaagtagctaggattataggtttgcgccaccacacctggctaattttagtatttttagtagagacagggttttgctatgttggccaggctggtctcgaactcctgacttcaaatgatctgctcacctcggcctcccaaagtgctgggattacaggtgtgaaccaccgcgcctggcccacctttgcattttttaaatggctgataatacttttcctaactattccttccttaccttggatcacgtggcttggctttgtactgagaaactgtactttggtgaggggaactgggatttagtaagcacctaagagagatggccagagcctgtcagcatacttcatctcttagaatctcttagacaagtgctactgtttaccagtacaggtgaatgatgaggagaccaagcatgattggggtggggggtgagggttaggggaaatgcacttctacctttttgcttcatttaggaaggtataaagccatgtggcgttagattgtgatgagaagctgtgacctacacttgatctctcatcccagaaagaaaatgctcctgcacagccgcaggaggagctctgggcagccctccaagactttctgttgtgctgtttccttcccttagggctgtattacctatgacatctaatgacaatgaaattctgtgtaattgctcttcttggaatgccttgcaaagaagcccagaaaaaaaaaatctggaagcttttaaccagattcaaagctggttttgtttttttctgtaaaccttgctgctgctttttaagcaagccctgcacatatgtaacattttatttggggttttctttgtatgtacaagacaccagggacagattctgatggtgaaggaatggtttcataaattaggacacatccatacaatgtaatgttaacatagaaaaataatgatgatgtaatattaattgtaaaagacatggtgccaagtggtctgagctctggcactgagaatcaagtaggctcagatttgaattccagcccattatttactcagtttatcctttgtaaaagttacttaaactgtctgtatctttagtttccttatctgtaaattaagtacgacactagctactatttatgaagtacctaccatattatgatacatgagtgggcaaactttttctgaaaagagctggatgtcaaacattttgggctttgtgggccgttgggtatctattgcagcagctccactctgccattttagtgtgaaagcagccattagtcaatgtgtacatgaaggggtgcggctgtgttccagtaaaactttatgtgcactgaaatatgaacctcatataatcttcagatgtcacaaaatattgttcttcttttgattgtttttcaaccgtttaaagacgtaaaaaccattgttaactcacaggttatgcaaaaacaggctgtgggctaagtttggcccatggattctaatttgccggtccctgctatagaagacactcaataactgctggttcccttccctggtaaaaacagtaggttgggccgggcatggtggctcacacatgtaatcccagcactttgggaggccaaggcgggcggatcacctgaggtcaggagttcgagaagagcctggccaacatggtgaaaccccatctctactaaaaatacaaaaattagccaggcctggtggcgtgtgcctgtaatcccagctactcagggggctggggcaggagaattgcttgaacccaggaggcagaggttgtagtgcagtgagctgagatctcaccactgcactccagcctgggtgacagagcgggactccgtctcaaaaggaaaaaaaaaaaaaaaggtagattgtgggcaagactgggaataattacttctgaggcgggtaaaggacttgtagtttggggatttcttttttcttttttcaaaatcattttcaagatcatgttctgttttcaataagattttctttttttccttttttgtagcagagaaattgagaacagtttttcctgatgtgaatttctacagtcttgtaatttttttaaaagcctgtcaattttacacttttcaaaaggtgatatttgatgccttgaataacatctggaatagcctgggactctgtcatgattgggctgacttgcaaaacatttgacttttatgcgtttttcactaagggagctgaatgttttatttttggctactgtaccttgacactacctttgtttcagtgctgtacttacttttctttgtataggctagcaagtcagttaactagtaaatcatttttcctgcaagattcagttgggtatgagccaaactctgagacacagaacagaaaccaaatttgtaaacaaggtgtgaagaagaaaatcagaaagcgtgaatttaggaattaccctgtggtttggatcctagaagttaagaaacactggatgccactgaggagagatgagaagggaggattctttttgctggcatcttagtctgtgctactgtaacaaaataccacacactgggtaatttataaagaacagaaatattctttggtgctgggcacggtggctcacgcctgtaattccagcactttgggaggctgaggtgggcggatcacctgaggtcgggagttcgagaccagtctgaccaacatggagaaaccccttctctactaaaaatacaaaattagccggttgtggtggcgcatgcctgtaatcccagccactcgggaggtggaggttgcggtgagccgagatcacaccattgcactccagccagggcaacaagagcgaaactccatctcaaaaaaaaagaaatattctttgaacgtgtgtcctgggaggggggaaaaaaaggacaaaaatatattttctcatagtcctggagactggaagaccaagaccaagcactagcatttggtgtctggtacgggctgcgtcctccagagggaagaatgctgtgtccttacatgatataagacagaagggcaagtttgcaaaatgctgcctgaagcctcctttagaaggaccttaatcccgctctcaagggagcagccctcatggcctaatcaccttttaaaggccccacttcttaatcctatcacattggcaacacctgaattttggaggtgacctttcaacccgtagtaactgattcgacaattgtaggaaaagcacaaaattgattagtattgcaaatcaggttctattacaaagcagttgtagcaactgatttgctctttttattatcctggaactttgttacactaaataattctcacaattagtgaggctaatgagtaagccttggacatttagtgttaatagagattctgttagtaaatatttattgaagaactactgaatgcagagtgtggagctgtgttctgctgcgaaaattcgattttatcccaaaggcaacatggaatatagtacgggggagttaaatgatgaaaacatgagttatgatctataattagtggagaagattgaaaaaataaaaaaacaagaaaaatatattttcctataatctcacattccagaaacatctgttaactttttagagtgttttcctctcattcttttctttctgttttgaacatacatgcataccttttttttttttttttttttgagatggagtctcgctctgtcgcccaggctggagtgcagtagtgccatctcggctcactgcaacctctgtctccagggttcaagcaattctcctgcctcagcctcctaagtagttgggactacaggcgcccgccaccacgcctggctaattttttgtgtttttagtagagacagcgtttcaccatgttagccaggatggtctggatcttctgatctcgtgatccgcccacctcggcctcccaaagtgctgagattacaggcgtgagccaccgcgccccatatatacctatttttgataaaatatatatttctttttaaaaagtggtatattagggaaaacacaaataatctgttaacattttcaatgtaattccttcctgcatgtgtttttacatgaatatactgtgtgtgtgtgtgtgtgtgtgtgtgtaacaaggatcatttgttactattttgaatgaaatctttttttaagcttttattttcttttttgtggctgatatatagaaatactgttgtttacaacaaaatgctgaacgccacctaggtctaatcatgtgtctatataatttcttggatttctttgatgtgggcagttgtattgtccataatttatgatgtggaaaccaaagctatagaaaagttaggtaattttacaaagaacataatatcagtaaatgacactaagtatgaaattaaatagtaactattatcaatccccttacagtattcattctttgaccttgtttttttccatttgtaatagtgttagcgtccaactgtcagctcatgtccaaatgtcggctcatgaattcctctttaatagctggacttcttttagcctctggctgtgtgagggtctcttgacctcagtgatctcacatgtgccactctgtccttctagaacactattctcctcgcctttgctaaacttgccttaaaagtgatttcctcagagggaccgctaataatgatcttgtttaaactttatgcccttcctactactatcatctctctctctcggtaccttttatttctacacacttaccatgatttcagttacacagattgtgacattacatgtacatatgtttaactgtttgcttctttcatatttgttctctatacccagcgtcaagcacttagttttgcagtagtatatgtaaatagtaaatatttgctgaataagatggaatgaatatatcttttgctgtcacaacatgtataattttctttttgatgcttcgttgattgcatctatgatttatccttctcatgtacgtcttagtgggaggaatctaacagtatccatcttttcctgttataaaattaatgttcttacttgtagagtcgtgccccaatttctgcaaaacttgtggccaatatgctgtcggtggctggggcggatcacatcatcaccatggacctgcatgcttctcagatacaggtatccgtgttttccttctgcaaatggttaaatcaagtctgttaaattaaataatcttaggtaacattacttgtgtttgagtttatatatggctactctcttggatttttgtctttactaaacttgaaaatataatttgatattagtacttccagtctctatcaccaccttgccccccagtcaattttggaggagtggggatggctttttggtagtaagctctatatagttccatctcagcttatggaaaataattagaacggcagtcataatgtacactttttaacttcttcataacttattttctttgtctctaaaacaggccaaattatactgtgccactttgtgttatataatgaacgtgaagtatttgatttataataactacttaagagacaacaaaccttttccctcaccgtcctgcatagccattctattcctcagaatataggccatcataagacaatggaatatgtcccaagagacagattggactgaaatatgcccctataacatatctgtcttttgatttaattctgtttaaaattaacaaaagggagtctgttataaaagcttcttttgaacaaaaaatgcaaatgttatttaatgaaagcgattatcgtttaaaaaaacaaaagaaaacaaaacaaaacaaaaccctgcaacatgacactcacttctccctttagggattctttgatattcctgtggataatttgtatgcggagcccgcagtcctgcagtggattcgggaaaacattgccgagtggaagaactgtatcattgtttcacctgacgcagggggagccaaaaggtatcatgcaggctacaccttgcagatttctccatctgctgattggtttttccttttccgatgtattagataaggaagcatgctgtaaattacttaaagctttattttgctaatgagcaagtaagtagaccgcaggcttcacttccagagcagaaacccatcatctttgttaatatttcgtcattcaggaaagaagaaaatacagagacacacatacacaataggtatatattggtttatttgttttcagcaaagggtagatgtgtttgaggtttttttaagttatcgttttctgattataaaagtaatgagcctaattggaaaataagtcttttaattaacagcacttggaaatggtagccaaaatagaacaatttttttttaaaagaaatctctgtacatagaataccaagaaggaaatatctgagaccaagaaataaagcagaggcggaaagccatgtccaggtggcttgggggatgggcatcagatccagcaagagcctggtggcttgggttttaatactcacctggaaacccccataaagaagggagttaaagccaggcacggtgatgtatgcctgtaatcctagcaccttgggaagccgaggcgggagaatcacttgagcccaggtgctccaggctgcagagagctatgatcacaccactgcactccagcctgggtaacagagtgagaccctgactctaaaaaaaaaaaaaagaagaagaagaagaagagaagagggctgaaggccagatttctagccaaaagccagggggaaagcccatctttacctcggcctttggtttaggggaggaaatagtcacctatgagaagtcaaaccacgagcctgtgccacattcagatgtggagtggaatgcacacgaaaatgtgctccaggctgcagagcccctgcagagggagaatttcacaatcctagctgctcggtgagtgctccctgctcaacctgacccgatgcctgatccaaagttagaaaaccaagagaacacagtccacgcaggcccagcatgtgcagacaacagggcagcaggcagccaatacttggggataagataataattactggactatcaaataagtaagtttaaaaggaaactgaggtgaaggagagttaacaacaacctggtcgtaacagtacggcagtgatgaggcacccagtggtgtgagaacgtggtactaagtagcacctctgaagggcttcacagagatactcgaggcgttaacaagcaatcagggtacagggtgttcagaatcaaggatgagcacaataagagaatgctgcaagctgaggcttggtgacccaatgaccttgtagagctttgcagatgctatctgggaagaaaaaaagctgggaagggagttttattgtgtaggtagagacctccataagggagaagtaggagagacttctaccccccagtccagtgaggaagcaaggaagctctaaatgtgcactaatagaggagtgatgagagtgacaagtgatcagcctttggaatgtctgacatcaaaagcctgtccctcatttggcaccctcatctgcctgcagcccagctgaggacctaggatctaacacaaaagcttagaagtagcccagaaagttgtcttaacactcttgcagggaaacacaggccctgattcttagaagagccttgttcattctgctcaaagctgccttccaacggctgctggggttcccagcacagaagagaaggaacggaccatgcagctggagatcggcctctgccagcagcaggaagtggctgtggccagggaggagacacaaatatataaaagacgggagcagaaagttaacttgcaaagaccctaggtgggcagtcacggggtggagggcagcgctgtgtcacgtagcctattactgtacggtgtgtaatgttcacaaaaatgcccttggccaagaatcaaggttgaatgacgctgagagtcctctgcaaaagattgtgagcaacattttggagtcatatctactagaaatgcttgcagttgacttggaaacttctgcaagtcacatggaatctgcattcaaatgaggcaaatgcactggcccagtggaaggttagaggcaaagaatccagccaaaggggtacaggagcgagcgtcagatgtaactgggttataataacagctttgttacaatgtaattcaaatacgtacaattggccgggtgtggtgactcacacttgtaaccccagcactttgggaggccaaggcaggtggatcgcttgaggtcaggagttcgagaccaacctggccaacagggtgaaaccccgtctctgctgaaaatacaaaaattagctgggcttggtggtgcacgcctgtaattccagctattcaggaagctgaggcaggagaatcacttgaacctgggaggtggaggttgcagtgagccgagatcacgccactgcactccagcgtgggtgacagggcgagagtccgtctcaaaaaagaaaaagaaaataccaaaaaactccaaatacgtacagtttacccatttaaagtgtacagttcagcagtgttttgcatattcagagatttgtgcaaccatcactatctaattccagagcatttttatcaccccaaaaagaaaccctgtacccattagcagtcactccccatttacttccccccaccttatccctggcagccaggaatctactttctatctttatggggttatcttttggagactttgtatatcaattggtagtatagaacatggcctttgtgtctggcagatacctttgtaaaccagaaaatgttattttggcagctactcagcccaaagaatagtagattccacaaatttgtatgaccatctttctttcctcccccaaccttgtttttatatacatagtctaagaatatcatacatgctcttagcagaaattcagacagtacaaaagtgtcccatccctgttctttaaatgccaccgttatttccagtgtcagaattgtgttatttaagcgtatatctgcctatttatttcacgcaaatggcaatgcgatgtacacagttcttcactgtgcttttctgaaaaactcacttgctgtatcttaacaatgattccatagtcgtgttgtgcagctgtgcaatattcccttgtgtgcatgtaccacagctcctgtgaccagtcaggccccctcttccccatttgtaggtgccgttgtttgcactcttaaatgcagttgtgaagcaatatcgttgctttgacattttgtacacgtgtgctagtaggatacgttcctagaagtggaattgccgagtcaaaaggcatgagccattttaggtttgatgggcagtgccaaaatatggtcttttccaaaaaatataccagttgacattccatcatgtatggatgccagtgactttctacacagccttgctcacacagtgggttatcaggcagtttacttccagatcaggtaggtgatctatggcatcctcttcctgtgagctctggttgctgtgggtgagggtagtgccctcaccagggtatgttgattttccatgagatgggtctctattcaaatcttttgcctattgttctcttggctgggacgtttcttgtggattgtctacagttttgcatagacgagatcacagctgtttctcatgtgtgttgcaaatatttctccaagttttttcatttcttctcctattttgtatttttattctctgcaggactttaaaaaccttcttacgtagtcaggtttattttttcttcacattatggcttctgagtttatgtaggagtcatccttctcttaaaatttgtcttctcccatgattctgtatatttttttcttttttaatgtcccaagtttacttccatctgaaatttattttggaataaagaatgaaataagaatccagcccccccacccccgactctactgtctagtttttccaaaactatttattaaataatccacctctattgatttgaaatggcatctttcatcatatacagagttccccatttcaaatagatagctatttgccaactcctacttttaaaaaaatgcagaataaagtaaacagaataaatggctggggttgagatgctgttttgttttgttgagacctcctttcaagcagtctgcactcaatcacccctgctccctctgccaggaaaatcaagctttttagggaagtacatttcagaatttttgtcacctcctttctcttttccaagtgtttctgctacacattattgtcatcctcatattctagcccccaactgacagtctcctcagaacagccttgcgggtaatacatgacatatgcagttgacattatctgtgacttctttgcttgatgcaaaaggtcatagttagcaaaataaaatactgtaaatttctgtctgaccaattggagcttgttgctttagaaaaagctttgaagcttgactcgttccgggtaaaactgaatgttgccacaggaggtcactcttgggtaggctttgtagcttggttgggttgaccacggaaagaaaattaaacctaagaaacctacctaccactgctgagatagcaagtgtcaacctaaaagtggtatgggaagagggtaaaactagataactcagatttaactttttttctgattacataatctttgaagatgctctataggaaatttggaaagtagaaagaagaaaatcttaacactttatatctcaaccagtgatgccactatgaataatttggtgtactatgtatctgtctctcctgggggagctgatatggcacatgcacccacagagaaaagattgtaaatatgtgcccagaagaaatccaaaactgtatgtatataattttcgttctgcctttttctgcctaagatttcagtgtggtatgttgtgtcaacatcatttgttaggagtatgtattaggtctccatgatatacaaggaaaagaagagttacctatagctttttcaggaaatcatagcgttctaacaacccaggaagctgtttgcaggggtattttctcttatcttcttcttctgacattaccattggataccttttagtggctagggctccccactcaagtgagatgtctgtgtcccccactgccaagaaccacagagctcaccttctttcccagtcccacttccatgcctaccctgctgtctgcttgtgagcaggctcgtgagaacaggcgccacctggcagagagatgaaaacaggttctgctttaacttctccggtatagaacttccaccacaaagggcagtgcttcccagtgctgggctgtggattggtatcctgtcatgcccaaatctgcctagtcgttaccaaataagcagacggtaatgtatgtggacattttgtgcgaggtgttcatgtgtcttgggaaaacctgtctcatgttcccagaaagtagctttccttacctggagtttgagtggcttttatgacattggcatgtagataatagaactgtacgtgtttttttgtttgtttgttttttgagatggagtctcgctcagtcgcccaggctggagtgcaatggcgtgatcttggctcactgcaacctccacctcccgggatcaagcgattctcccgcctcagcctcccaagtagctggggttacaggcagccaccatcatgcccggctactttttgtatttttgtagagatggagtttcaccatgttggccaggctcatcttgaactcctaacctcaggtgatccacccacctcggcctcccaaagtgctgggattacagctgtgagccaccgtgcctggctgaactgtaggtgttttaaggtgatgatggagcaaaatttttgttggcctttaaattaatttttttaattaaatctttaagtaaggaaactgttgacagctagacaagtttacaaacaaagggtatctgctagggctactgtggttttggttgcatcctgaagaatgagtgttttaagggtaggatgagtgttctaagggtaggagaaacatggacctcaatatagtaatgattccctttgcttcaaggacgttgatgtcttattctcttatctcacagtctctgtgtttaactggaaagtttggtcccttttcttttatgataattgacatagttggatttatgaccaccaccttactatgtggtttttttgtttttgagacagagtcttgctctgttgcccaggctggagtgtagtggcgcgatcacagctcactgcagcccccgatctcccaggctcaagtaatcctgccaccttagcctcccaagtagctggaactaaaggcgcatgccaccatgcctggctaatttttgtattttttgtagagatggggttttactatgttgcccaggctggtctccaattcctgggctcaagtgatctgcctgcctcggcctcccaaaatgctgggattataggtgtgagccaccatgcttagctactatatgctttagtttttccttctccacaaagtagacattattattattttggttttgtacaatcaacatttgtttagatttgtccacatattgatcaatatctttgcttacctttctctgcccctgcccctcaccacatctcaatgtatctgtggtgattttccttttgcttaagttgcattctttaagtggttatatgttagaaataaattctcaggttgtatagtttggctgaaactatctttattttgctctccttctggaaaggcagttttgctgagtatagactcctagcctgagagttattttctcatatcacattgaagatatgactccataacttctggcttccattggggaagttgaggacttggccatccttactaggtgacttgtctttattctttgtctcttttaagctttcttggtcttctatagttttgttaagattgtttgggaattcatttgttgggtttattggatccgaggatcctcagatccaataaacccaacaaatcatcaggaaacagttgtcagaagacatcattggtcctgtgtttcctacggaaataaaaaacaataaatattgcactgaatgtttgtggtttggtgtccctgaataataaagaaggaacatatttgcaaaaagttgcatagggtttttttatgcagaattttgtcagaagacagtggtgctgccatgtttttctttgagtgcaaatgtacattgctaagatttttttaagatggcatgtgctttgaaaagaggatattgcatttttaagagtttaaaaatcttatgagtgagaaatattaaaaaatcttattttcccctctttacaagaaataaaagatgttcctcataaaaaaaaaaaaaaaaaaaaaggaaatattagccgaataggttatacagagttaccatatgacccagcaattccactctgaggtatattccccaaagacttgaagacagggactcaaacagatacttatacaccagtgttcatagcggcagtattcagtatagccaaaaggtggaaccaacctgagtggccatgaacagatgaatggatgaacgcaatgcgctgtatccacccaatggaatgttattcagacttaaagagagatgaagtactcatctatgcagccgtgtggatggactatgaacagtttatgctaattgaaagaggccagacacaaaaatgcacgtattttatgattccatttatacaaaaagttcagaatagagacagaaaatagattcatgcttggcagggcctggggggaggggagaatagggagtgcctgcttaaggggtgtggggtttccttttgatatcatgaaatgttctggaactagacagagataatagttgtgcaatgttgtgaatgtacttgatgccattgaattaatacactttaaaatggctccaaggataaattctgtgttatgtatattttaccacaattgaaaagaaacactggctgggcacagtggctcatgtccgtaatcccagcactttgggaagctgaggtgggcggatcacctgaggtcaggagttcgagaccagcctggccaacatggagaaaccctgtctctactaaaaatacaaaattagccaggagtggtggtgcatgcctatcaccccagctactcaggaggccgaggcaggagaatcacttgaacccaggaggcagaggttgcagtgagccgagattgtgccattgcactccagcctggtcaacaagagtgaaactgtctcaaaaaaaaaaaaaaaaaagaaaagaaaagaaacactggttgtgttgtgaaaatcctcagaaatagggaggggagcctggagcacctaactgcccttcccactgccttctcagccccagagagtgtcccctctgtccttcatcagagcacgcgaggagctccattcctggtcgtcatctgaggatgacacaatgagtaggactaggactttaaaactagtgtgtggaggttatatcctccatgtactgcgtcttaagttgggccatgtgtgtattggtccccaaagcattttttcagctaaattgcataatgactgttattttaaaaactggaaaaggaaaatcttaatgttacattatacctgtggcattgtcttgaaataagtttcaccatttaaatccactcttcacaggaaaatctgaaatgccccaggctcaccagcaagcgaggcctgcccactttctcttcctgttggcagctcagctcctcctgagctagtgatttttttttttaaagagatgggatcttgctatgttgtccaggctgtattcgaactcagacgcaagccatccttctacctgcgactcctgagtagctgggcctacaggcacgatgccatgcctggcaccattgatgtctgagcatttgccttagatgagcagaggagctggactcacagtttaaagtctccttagaccttgaatgcaatgaagcccatcctgactagcctacatattagatggctgtattaaccaggacttttgtccccactatctgtgccacaaactgggcaaatagtagttcctaaataacttactttaagttgtacctgtcatggttttaaaatgctacccacaaatactaacaaactgaatatcaaattcttacccagtagttctatccagtggccagggtgccctgacggtcattcctagctgccccaattgcaaggtccgccattagcacatttctccctgtggattgctaagtgcctgccccagaccatgcctgggctgatcaagagaggcctgattcttgcatcatctctcgggtgtggttgcctgctacattcccaaaatacaactttaaaggcgagatctctagttgactgtatgaacatgttcatttgtgcctttgccagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagtacgcagggcggtggggaaagcgttaggacttctcactaggaaagggaaacacatcagcttttagaaattgggctcttttttcctgattattgccggtcttggcagtggagttttagaccaaaggagattctaggcccttttatctttatacttctttctctggtagaaaagaaagcacgggccttttcgttttccagggtgagcttgtagtgtacctggaaaaaggtcaaagaaggtgcttccctttgcactgagcacgacaggaaagatggtttttcgggcttcttcaggccctagcttccttccatttggctttcgtgccagccttctcagccacatgggtgtctggaggatttgtagagctgctgcccagtatggaagcccccacccagccacacgtggccgtggagctcttggaatatggccagtctgacttgagatgtgctgagagtataaaaaggccactaggttttggagacttaatatgaaacaatgaatatatatctcatttacatatatgtttttatgttgattacacatcaaaacaatgatgtttggctatattggtttaaacaggtggttctcaaccaggagtgattttgctccctgggagacatgtggcaatgtctagagacattttttgttgtcacggctgaggggtgggttgtcgttagtgggtagaggccagggatgctgttgaattttcccataatgcgtaggacagcccccgtgacaaagaattatcctggctcaagtgccaaggttgatagtccccgatttaatggaatacaaagtgttttgctcatgcttgagtgatcctatcttaggttaataaatgtgagtgaaatttgttgcatttttcttttacggagcacactttgtgcttttaccattcatactaggggagagtattccaagaatatttgcatacccttaatttttatcttctgctgttctacaggctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtactgtctatacaccaaaggcagccaagcagccaggcacctactttagatccttaaaaatagcatcatgtcttgtgtgtgtgtggctccttgctaaggcacatgcttggcagaggcggcagcttctcatgacggcaggatataaatcatattagatccctgaaaaaggccaggaccagcagaggtcaacgttcgctatttagaaatagagagtgaagaaaatcacaatggaaaaacagtcagaaacgggttgtgctaaagctaaacttagaattatcatatgatccaataattccacccctaggtatatgccccccaaatttggaaacatattcaaacagaaacttgtacagacatgttcatagcagcactattcacaataaccaaaaggtagaaccacccaatggccatcaacggacaaacagatggccaaagtgtgctctgtcgctacgatggaatactattcagcctttaaagggaaagaaatcctgacacatgctacagcatggatgaaccttgaaaacatcgtgctaagtgaaaaaagccagatgcaaaaggaggaatattgtgtttccgcttctaggaggtacctgagattggaaaattcatagagacaaagtagaatggtgcctatcagggtctgggggtggggggggcagtggggcgttatctatcatttaatgactatatagtttttgtttgggatgatgaaaacagtttggaaataaacaatggtgatagtttcacacattaggaatgtaattaatgccaataaattgtatacttaaaaatggttaaaatggcaaatttgatgttatatatgtaaattttcaactgataagaacagacactatacttgatcttagccagatagataaatagatagatacatagatagatacatacacactcacacagtgaaaaaatgggggtgggagcagcaggctgagctgaggatcttcagagctttgctccttcccgtccctgctgattggatgccgacgggccagcagagagctggtaatcatatagatagcaattggcctgaaataagtcaaaagggtttgaggcccattttgcctctatgtcgctgtgaaccttggcaagtcatttcattgctccaaagcctcggctcccatcagcgtagcatgaaggtgcatcacagtgatctgcttcatgatttctgattcctcagagagaaaagcaatttgcttgacacaaagcagtaagtctggaaatggtcaggatagcgatgtcatatattttcatgcctgattagcagtagtttaggatgggagttggcacactatggctcgcaagtgaaatccagcctgtcatctgtttctgcaaatttttatcagagcacagccacgtccattcatatatgtattgcccgtggctgctttcacgctacaatgggcaagttgagtatttgtgacagagaccctctggcttccaaggtcaaatatgttaactatttggtcctctatagtttgctgacccctgagttagatgatcacagttgtgctcttaaatgacgcagtcaccgccttttcagaaacagaaagaaaaaccttccgtataatgattaaacttaatttaaaacaacaaatgcccctggaaaaggatgtctctggttaacagtatccctgaaaagccttctgtctctgcattgaaaatctcccttccaggatcccatatgggtctggttcaacgggttgtaatttgaagacataccccaaagctgtctgtcctctcaaaagtgtcggaagttttgatagcaacacatcatgtatgctgcagaaattgtttctcagctttccagcttttcaatgtttaaagaactctaactaagatgtcctgcttcccttctccctttgtttttctcattggcatttaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctttcagtactttgaggcgacaactttcaagtatataatttcattgtggaagtcatagtttatatatttcgaggttgccaaaggtgacttcagattaaagccttctgtgtaaatatatactgataatgcctatggacatttgggtaaaaccctgtatagaattaattatccttttactttggagtgaaccttggaaaatttataattataataccatggattttgaattttccttttttttttttttttggataactcagtttcagataaaccatcttggttactgtgcttaatttggaccaaattttatttagcttaatatggacactgacacattttggggggtatacattagacatatcagagcagtgtatttctggatcattttttaaatgacctcttctaaaacataactgtcacttacctgaaatgctgcatcctaaaattccaaaattatattgagcaatcgccaaggcctaaagccaactgacttaaaggtaatcatttcagctaagattaaatttaaagcctaagaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccaatgcgactggacttagccacacacaatggaaattcagaccttgactatttggtgtttccagttcacaaaggtgatgaagactgtcttgggagcagcttaatcccaaaatttgtacatttcttgctgctcctggcgtggaaacttaagtgagaccaccaaatacattggtcctgtccaattctactgaatgggggtggacctggcatttatctggccaaaaacaggagccagagaaatatgaatataccaaagttgtttgtttagcctccaacttaaattacattagtcaacttatagatactcatatgatcacttttctttttagatactacatcaactagattcaggagtatatcatttgcagtgcttgtattggtttaaaatgtaagattttaagatcctctaacactgtactaaaacatttcaataaaatcattctgactgcgttca

SEQ ID NO: 4292 - DNA, 18764 bp, human
cctccccctccgctcctccccttccctacatctagccgccgcgctttcccgctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctgtcccagcgcgtggccgaccgcctgggcctggagctgggcaaggtggtcacgaagaagttcagcaaccaggagaccaggtgggggccgcgccggcggccgggctagggagagcgctgggcacgcggctgcggggccgggttgggggccggcgcctgcccgggccacctccgcggacgccgcgctcccccttccggggcgggacggtggcaacgcggcctccgcgcccccgcgcccgcgcctgcgaagaaaccgaggcggggcgccgcgcgtcccgatgcgcgcctcggctgtgcccccggttgcagggcctccggtcctgggaccgcggcgacccggcggtcccgagccgctcccggcctcccagcggtgccgcccggcctggcgtccccagcccggaagggagacgtctgggcggtcacagaccgtcggggagagagtgggcgcagcgggcgggaaccgcatcgggtcagcgcgcggtggagagacgtcctgggttggctggtcccagtttccgcgtccctacaaagctgaacctcagaccagtgcgtgcgactaaaggtttccccccgtccccaactctggttgcacgctgggtttacctggggacggtccgaacgctgcttcccccgacctgcccccaagggtttgatccaacgggcggaggatcagcgattttacaagcttccctggcttctcctgagcagccagggcgcagaccactgcgttatccagagggtgcagttgtgccaaggtttgaaagactgtgagaaccccaggacgcacgtgctgggctcccctctgctcccactactcttgctgctttaaagatgatggactttcagcttccttcttgttctaggactctgctgtgtccagcaacaacgccgtgattcgactgtaactttcacccatttctcaagtccaggagagcctcaggtggtggccatcctcggaagctgacctggggggctcctttgtctatctgcctgagtccacacagctccttgactcatttcaaattggtctcatttttcccccttcttcctccaatgtctagtaccgttaactgtccacagttactgataatttttatatctttggcaaaggttcaattttaccaacattttctagaaatggtgttggaacagttggacacccatatgccaaaaaatatgaacttccatccatacttttcaccatttgtaaaaattaactttgaagtggatcatagacctaattgtaaaatctagaactataaaatttctagcagaaaatcttgacttggggttaggcaaaaatttcttaaggaggagttatgttaatactgatggggaagatgctatattttggcaagtcagctttttaggatatgtgaatcttacgtgacttcttccaggtggcaaattccagttatggctccgatgataatataagcgaagaaacattgtgaatgagtggcaggtggactttggctaaagaattccactctgcagtgtttaatgcagaagtctgagaggatggtctagggctctggagaaggatagagctaggtttgagtgttgcagtattttgccagtcttgttcaagtttcagtcgctgtaagaacacgagaagaagaatagtttttgttcagaaggtgtcgtcatataagtaaaggagaaatttgttgatgaagtaaattttgaaagcaaatatgttgcccttccaggtactcagtgcagcatgatcttttgctaaggagcatggttaatctagatcagttcactgctaagtcagtgttgagtttctcctaaaaataccacatgtgccactgggcaaaactcactcagacactgaagtatgattgtttatacatttggttcaaatataaagcagactcacttttattttgtttttggcattttataaccatcacttgataattagaaatcgtgggacctcaaaaaccactcagcatgaagtttgggaattgcctatatagctacattttatgtttttaatgtatagagtataaaaggttcactgcctgacttttctcttttccatgaactgtacaagtacagagcttaatttttataaacagccctctctggaccagttactgtgctaggaatccagcttttagctgtgtaatcgtagagaggaaaaactgaagggcaaaatgaagacaaaattgattcagttcatgtaagggccccttcttgaatctgtcactgaactaggatcagaaatctggtttgctgtctcctggccatcaatcctcccattttgcgttttttatatgctactttactgaacatagagccttccaattttaccttcttatccctaaatcatttcagatatgcagggagaggtccgctccagcttcactatagaccatggaaattccatgatgacatcttaggacagcaggtgtctagatgtctctgttgtaacattttactatggtcagttaacctgctggcagaatctttagctatactgtgagacaaggttatgcaaagttatacaaggttatcggttaccatgtaataaataaagagcttaatggcttaaaacagtaattgttgatttggcttacaaatctgcaatttgggaagggctcagtgaagaaagcttgtttttgccgcgtatggtcacagctgaggctggtcacagctgaggcggctaactggggctggagggttcttgaagatggctcacatgactgaagttgttactagcttttgcctgggagcttggttaggaacctcagctcctcttcttgtaggcctctccatggggctgcttgagcttccttacagcatggaagctgggttctaagagcacatgttccaaaagacaggacattgaagccaccagtccattaaggactgggcttgcaagttggtgtatcataatttctgtcatatgctgttgggcaagtacagagccctctcagattcaagggcgggagactagaccctgctccttgatgggaaatgtgttaagagtctgtggctatcttttagttaccatgcccgtttattgttgagtcagtgacgctcttcagcgtttttatttgggggtcaataaagatcctctggcagaatggcaaatggatgctgccttctagccacaattttttaaagacctagaataaaggtagtcatgatcatctttttgagtagaagcaggactagctttaggggaaaagttgccatggtgatgatattctctgtcctcccctggactgctagtcatatgagaactgaggttcctgagtaaaaacaggccaaagaatctaatcttgtgggataaacgtcataagaccaggagttggcaaagtttttctgcaaagggccaaatcgtaaatattttaggcagtgctagcacatgtagtctctgttgctgcggtatcttacagttctgtaagttacggtaatgtctgtcacaggttagcagggctgtattctcttctgaggctctaggggagaatctgttcccgtgccttttccggtttccagaggcagcccacattccttcactattggcctcttcaccttcaatgtcagcaacaaaatgttgctctgaccctgcttctgctgtctccctcttgcatttttaagggccccatgattacaatgggccaatttaaataatccaggataatttccccatgttaaggtcagctgatgagcaacctgaatgctatctgcaaatttacttcccctttgccatataaactcacatattcaaaggattaggatgtagacatctttagggggccattattctgcctaccacgccattcttaactcacaggccatagaaaaacagcctatgtgctgtgttttgtcaacctctcagctatataatactgtacttgatttctgctgtagttcattttgtgctgctataacagaataccagagactggctaatttataaacaatagaaatttgtttctcacaggtctggaggctgggaagtccaatactgaggggctggcatctggcaagggctttcttgctgcatcatcccatggcagaagggtggaagggcaagagagcatatttgagagagagcaatagagggccaaatttgctaatataataaacccattctcaagataatgagcacactctagcaatgatgacgttaatccgtttgtgaggacagagcccttatgacctaatcacctcttaaaggtctcacctgtcaatactcctatactggggattaagctttcaacacatgaactttagggaacacatttaaaccatagcaatttccaaattaagtttatgtcatagttgatgtagtgttcacaaagcagttagatttagctccttagatcttcaaataggagggagcacatagaactctttctatccccctcatcctgtgaggttggcatattttcatccatagtagaaggcgtgcaagaagatgtgtgaatgttatcaaaactaattttcacaacatgtcaacttgaaaaactttatttttattttccttttctttaaaattttttttagagacggggtcttgctatgttgcccaggctggactagaactcctgggctcaaacaatccccttgcctcagtctcccaagtagctgggactgtgggcatgagccaccatgcccagcctgtttttaaattttcattaggtataattggctcttttttttttttttttttttttttgagacagagtttcacttttgttgcccaggctggagtgcaatggtgcgatcccagctcactgcaagctccgcctcccgggttcaagtgattctcctgcctcagcctcccgagtagctgggattacaggcatgcaccaccacacctggctaattttgtattttttagtagagatggggtttctccatgttaggctggtctagaactccagacctcaggtgatcagcccaccttggcctctcaaagtgctgggattacaggcgtgagccaccgcgcccagccttaattggctcttttaagaaaacaatttcattgagtatctgatagcaggagaagagagaaggataattattcatgttccttatttgtaattttaaaatatttcattttgggatgaataaatttacagacaattctgccataatgtgacatatgtattcctaaaaattaccacgctatgcaaaatcaggcaatccaaaaccacagggcttatgagaaaaatggggttagggacataacattcaaaaacttcctcagtgacccattaaaaaatcataggaatgttatatagattgagcatcccttatcagaaatgcctgggacaacaagtatttcagattttttttttttttttttttttttttgcattttggaatatttctattgtacttactggttggacattccaaatctccaaaaatccaaaatccacaatgctccaatgaccatttcctttgagcatgatgtcgacactcagaaagtttcggatttcagaatttcggattagggttcctatcaaaatggtaaaacactgacatgtattacatgctcaaaaaatactggctgggtgcaatggctcacgtctgtaatcccagcactttgggaggctgaggtgggcggatcacttgaggtcaggagttcaaaaccagcctggccaacatggcaaaacctccctccactaaaaatacaacaaattagccaggcgtggtggtgcatgcctgtaatccgagctactcgggaggctgaggcaggataatcacttgaacctgggtggcagaggtcggagtgagctgagatgtcaccactgccctccagcctgggcaacagagtgagactctgtctttaaaaaaaaaaaaaaaattacataaatattatgacagagatggaactttccattgaaaaatgcctgaggtttagggttctctgaaatgacatgaaaagttgtgacaccaaatgtgaatgagtgtggctcattgtcctcgaggtgtgtacatgtgtatgtttgtgtatttctaagtggctccattcagctgggtacactgcagttttctgcagtctcgggataagaggttgtgcataagaaaacatgaaattcatgctatgctcaaattgttccaaataatatcaatcattggaacaaatttgccttttcaaaacatagcagagctgaccatcttcttggtttggacgcagagctctgggaaggacatgcctgagcacacagcactattttctgtttcttcccaccaaaggaatatgccagggatgagctggctctccctctcatgttggacatccagaattctgtacctggaaatacagaaacttccagacatgcaattttcaaaaacttagctgctatttactctttctccagaagctacgcaaggatgccaaccagcaaaacaaggaagtataccaagaaagaggatacagaaaatggcaaatggagtgcaggagagggggcagggaatccccggatggcagctgtgcacaggcagagagataacccaggcctgccacccctgggagggatgcctgcaagacgatgaaatgcagatgggacttgaggcctctgatcttgggagattttgattgttagtgaagggtttagggtggaatctggattcaggattcagaaaacttagcagataaaaaggtaagagaatgacctccagggaaaataaaaagaaaagatgtgcataaaaagaaaatacaagcattcgtttaagttaattgcatggcagagctctgagcagcatttgcgcagttaaaaacgtacagtcaatctttaatgtgaatattgatctatattgggatgatggcgagatgggaagtttacattgcaagtgatggaactgaatggaaatggagttcagtcctcatcttccatagtgagaagtcaatacactttgcctaaaatgaaaaatcaagacacagcaatacacacatagtagctagacttgaaggaaagtatccaaaaaccctatcaagagttgaaattggtggcctctgggcactttctctgttatacgtcttacagaatggtttgaattttttaagcaatatgactgtataactttaataaaaaactaaaactaaatgtagtattttgcagaaaagagttaacattagcaggcctgagacttaggcctgttcgcaaggttggcccttggctggcctctgggagcttacattttgcaagggtacccaccatttcccagtaaggatggctcactgcataaactcttaaacaattgataaacaatgtggttcatgctgaatgcctgtgagtctgacattttggtacgtgctaggcagagggtgcttatatgaccagcccacaatacaaaccctgggacttgagtctctaagcagcttccctggtagagagcccttcacacgtgttgtcacagctcactactggggcattaagctctacctctgactcccctcagggaggagtcttggaagcttgcaccctgtttcccccaacttcaccccatgcacctttttccctttgctgagtttgctctgtgtcctttctctgcaataaattacagccatgagtgcaactattaggctgagtcctataagtcatcctggtgatcatcaaacctaggggtggtctcagggacgcccaagatgcaaatatgcttcgatattaaccgatggcagttttcttttcctagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaaggtaggagaggtgtgtgccctagaaacctgctgtgggccactgtcaatgttgtttttcctcatttatccccttgattagaattatctggaaaatgttggctttttcctttgatgatcaagtaaatatgctttcttattttgtttgttgaagatttggctttgaacctaccctgacattaatattcaaagaaacaggtaatgcatatttttgcaggtattaaaataccattattgtccttgttataatgaaattattgtatgtctttgtggtggtggatagaactaaatacacacacatacatgcacaagagtacaagtcaaactagagcacatctgaatcagatcactggattgtatcaatttcagggtcctggctgtgatactgtgttatagtttcacaagacgttaccacagggaactaggtaaaaggttcacaggatctctgcgttgtttcatacaactgcatgtctatctacaattcccccgaaataaaaagtttaattaaaaaaaaaacccatgatctctttttaaccttttaaaaagaacagaaatagtatcattgaattatgtttttcacaacattagcatcagaggaggctctgtgagtctttagaaaaaaattgaagaaaatgtggttggtctttgcctttcagagcaacagagaaatcggaggttgagaagaactttgaaggagattgtattagttttctaagctgtcataagaaattacataaaccgcgtggcttaaaagagcagaaatttttccctcacagtttcggaggcccagaagtgtgaaatcaaggaatgggcaggggcacgctccctctgaaggctgtaagggaggctgcttcctcgcttcttccaacttctggtgtctccttgcattccttggctgtggctacatcactctggtccctgcctctctcttcacctggcctcttccctgtgtctcttctctgtttcttataaggacactgtcattggatttcaggcctaacctaatccagaatgaactcaacttaatctttaccttggttatatttgcaaagaccctatttccaaaatgaggtcacatgctgaagttgtgggtggacatgagttttggggggatattgtttgacctactacagtggtcaactcccagctgttgtgtgttccgtatcttatggatagatagatgttcagccaggctcagcgagaatcctgccagttttcaagacacactgctgttctgtgatttggtaactcagtgcaagaaaggttttccccaatatgctgctttttatctccataattcatttctgaaacaacacagatttctgaagcagcacacaagatcccctcatatttgaaaaaaaccctttataaatttgaattcatataccaaagtccccctgaattttaatcccagtctcctcaagacatggtttccattccctgtcttgaagatggccagtcagttaatttctcacctaaaatctaattagaagggtccacatactttatctgtaaatggctatatggtctgtgttgcaactattcaactctggttgtacttcaaaaagagcaatagacaatatgtaaatgaatgggtatggctgtgttccaataaaactttatttatggacactgaaatgtgaatttcatattattttcacatgccttgaaatactattttgaatttttttcaaccatttaaacatgtgaaagccattattagctcacaagcagtaccaaaacaagtggctggtggctggtggctagctggatttggcctataggctacagtttgccaacccctgtattagaccattgatagattgcgtgcgcacgtgtgtgtgtgtgtgtgtgtgtgtgtgtgtgtatgtgtgtgtgtgtttatgatctaaacttgaccttgggcagccaaaaccttaggtcacatacactgctgtgaagctgtatcctcccactagctatttatacagacagctccttttattttaaacttgatttaaactgtatttttagctgttaaatttcaattttctaattttgtcccattggtataatctgttgtcttagctattcttcccatctgtgtgtttccacaggattgtttagcatctttctccttgtcatatcacatccatgtcatagaagagctaattttctgccattatttcttccttccttgtggtttagtaaattctcacattgtagctggttttttgttgtttgtttgtttgtttgtttttgagacggagtctcactctgtcacccaggctgaagtgcagtggcacgatctcagctcactgcaacctccgcctcccaggctcaagcaatcctcctacctcagcctcccgagtagctgggactacaggtgtgcaccaccacgcctggctaatttttgtatttttggtagagacgaggtttcaccatgctggccaggctggtctcgaactcctgacctcaagtgatctgcccgccttggcctcccaaagtgctgggattacaggcatgagctaccgcacctggcctgtagctgtatttttaatcaagctctttcactcacaatagattttatattttgtatttggccctaagatattgaatatattgtaacttctttagaaaattactccttttatcattgcacatgccctcctccactattacccgatttgtaaccccattttgttcattaagtgataaaatatcagaagctctacatttttgttagcacatatctgatttgcggtgacctctttttacaaagttgtattttcaaaatgttttcttatttgagttggagaaactagcactgttttttcccaatccttctattgtaggaggtgtgatgcagtccagcctccatcccctagttgccagtagtgctcccagccaccactaacaagagccctatggatttctggaactccagtggctataacttgtgttttgttttgttttgttttgttttgttttgtttgagatggagtttcgctcttgttgcccaagctggagtgcagtggtgccgtctcagctcactgcaacctctgcctcccaggtttaaggattctcctgcctcagcctctcaagtagctgggaagcatgcgccacgacgcctggctaattttttgtatttttagtagagacagggtttcaccgtgtgggccaggctggtctcgaactcctggcctcaagtgatctgcccgcctcagcctcccaaagtactgggattacaggcatgagccatcgcgcccagccggctttaactgttttgtggaactgtgttgtctaactagctagtagcagctttcctgatgttagacagatgtgttttccattttgacccattgtgaaaacatatttcttttctttcttctaccctttctttaatcactttgctgtaagtgtgtttcttggtaataacattgtagctgcttttaattttttatcccagtcagacaattccatgactttctgagcttaactgctgatagaagagaggtctttcatcatcaaccacgcagaggcagggcggttggtaacatttgagagacagtgtgtgtagtggcttaggaagtcatgtggtttctcgttagagaacacagctaggaaagaaggaatcacggtggggtgtattcgtttcctagcactgttataacaaattaccacaaactgggtgacttaaaacaacagaaatatgttctcttaagtgctagaggccagaagtccaacatcaaggtgttggcagaggaatattccttttggaggctgcaggggaggctcctccttccttgcctcttctagctcctggtgactgccagccttgaggccacatcactctaatctctgctggaatcttcgcatggcctcctctttgtctccatcagatctctcgctcactctctcatttttaattttctttttagagacagggtctcgcttcgtcacccaggctgaagtgcggtggcacaatcttagctcactgcagcctcaaacttctgggctcaagtgatcctcccacctcagcctcccaggtagctgggactacaggtgcacaccaccacgcctggctaatattttttgctttttgtagaggcagtgtctcactatgttgcccaggctggtcttgaataggaattctcctgggctcaagagatcctcctgccttggccttccaaagtgttaggattaaaagcattaccaccacacctggcatctctctttaaaggatacatgaggtagcatctagtgttcacctgaataatccaggataatctccccatctcaggatcctcaatgtcatcacatctgcagaaacctttccaaataaggtaacatttacaggttccaaggattgggctctgatatttttggggccaccattcagctcacttcaggaggccttaaaggaagtcactgatgtgttaagagacgaatattttaaggacactttgagctttgagatagtacatatcatttatcatctaggccaggatgctttcaagattgaaagggagctctatggataactgtgttgggaaacaggtgtctgcctagactgtcctgggcaagtgacatagggccaccctctctatagcctctggaggtggccaagacacataagctgttctgacaccattatttctgacatgtctgtgtagtcagtgtgactcattatagtgaggagacaattttgttctttccccaaacttctgaaaggggaattcttaattcttaattttatctagtatttgaggtgtgcctttgctttatttttttaagacagagtctcgctctgtcacccaggctggagtacagtggcacaatcttggctcactgcaacctctgcctccggggttcaagcaattctcctgcctcagcctcccaagtagctaggattataggtttgcgccaccacacctggctaattttagtatttttagtagagacagggttttgctatgttggccaggctggtctcgaactcctgacttcaaatgatctgctcacctcggcctcccaaagtgctgggattacaggtgtgaaccaccgcgcctggcccacctttgcattttttaaatggctgataatacttttcctaactattccttccttaccttggatcacgtggcttggctttgtactgagaaactgtactttggtgaggggaactgggatttagtaagcacctaagagagatggccagagcctgtcagcatacttcatctcttagaatctcttagacaagtgctactgtttaccagtacaggtgaatgatgaggagaccaagcatgattggggtggggggtgagggttaggggaaatgcacttctacctttttgcttcatttaggaaggtataaagccatgtggcgttagattgtgatgagaagctgtgacctacacttgatctctcatcccagaaagaaaatgctcctgcacagccgcaggaggagctctgggcagccctccaagactttctgttgtgctgtttccttcccttagggctgtattacctatgacatctaatgacaatgaaattctgtgtaattgctcttcttggaatgccttgcaaagaagcccagaaaaaaaaaatctggaagcttttaaccagattcaaagctggttttgtttttttctgtaaaccttgctgctgctttttaagcaagccctgcacatatgtaacattttatttggggttttctttgtatgtacaagacaccagggacagattctgatggtgaaggaatggtttcataaattaggacacatccatacaatgtaatgttaacatagaaaaataatgatgatgtaatattaattgtaaaagacatggtgccaagtggtctgagctctggcactgagaatcaagtaggctcagatttgaattccagcccattatttactcagtttatcctttgtaaaagttacttaaactgtctgtatctttagtttccttatctgtaaattaagtacgacactagctactatttatgaagtacctaccatattatgatacatgagtgggcaaactttttctgaaaagagctggatgtcaaacattttgggctttgtgggccgttgggtatctattgcagcagctccactctgccattttagtgtgaaagcagccattagtcaatgtgtacatgaaggggtgcggctgtgttccagtaaaactttatgtgcactgaaatatgaacctcatataatcttcagatgtcacaaaatattgttcttcttttgattgtttttcaaccgtttaaagacgtaaaaaccattgttaactcacaggttatgcaaaaacaggctgtgggctaagtttggcccatggattctaatttgccggtccctgctatagaagacactcaataactgctggttcccttccctggtaaaaacagtaggttgggccgggcatggtggctcacacatgtaatcccagcactttgggaggccaaggcgggcggatcacctgaggtcaggagttcgagaagagcctggccaacatggtgaaaccccatctctactaaaaatacaaaaattagccaggcctggtggcgtgtgcctgtaatcccagctactcagggggctggggcaggagaattgcttgaacccaggaggcagaggttgtagtgcagtgagctgagatctcaccactgcactccagcctgggtgacagagcgggactccgtctcaaaaggaaaaaaaaaaaaaaaggtagattgtgggcaagactgggaataattacttctgaggcgggtaaaggacttgtagtttggggatttcttttttcttttttcaaaatcattttcaagatcatgttctgttttcaataagattttctttttttccttttttgtagcagagaaattgagaacagtttttcctgatgtgaatttctacagtcttgtaatttttttaaaagcctgtcaattttacacttttcaaaaggtgatatttgatgccttgaataacatctggaatagcctgggactctgtcatgattgggctgacttgcaaaacatttgacttttatgcgtttttcactaagggagctgaatgttttatttttggctactgtaccttgacactacctttgtttcagtgctgtacttacttttctttgtataggctagcaagtcagttaactagtaaatcatttttcctgcaagattcagttgggtatgagccaaactctgagacacagaacagaaaccaaatttgtaaacaaggtgtgaagaagaaaatcagaaagcgtgaatttaggaattaccctgtggtttggatcctagaagttaagaaacactggatgccactgaggagagatgagaagggaggattctttttgctggcatcttagtctgtgctactgtaacaaaataccacacactgggtaatttataaagaacagaaatattctttggtgctgggcacggtggctcacgcctgtaattccagcactttgggaggctgaggtgggcggatcacctgaggtcgggagttcgagaccagtctgaccaacatggagaaaccccttctctactaaaaatacaaaattagccggttgtggtggcgcatgcctgtaatcccagccactcgggaggtggaggttgcggtgagccgagatcacaccattgcactccagccagggcaacaagagcgaaactccatctcaaaaaaaaagaaatattctttgaacgtgtgtcctgggaggggggaaaaaaaggacaaaaatatattttctcatagtcctggagactggaagaccaagaccaagcactagcatttggtgtctggtacgggctgcgtcctccagagggaagaatgctgtgtccttacatgatataagacagaagggcaagtttgcaaaatgctgcctgaagcctcctttagaaggaccttaatcccgctctcaagggagcagccctcatggcctaatcaccttttaaaggccccacttcttaatcctatcacattggcaacacctgaattttggaggtgacctttcaacccgtagtaactgattcgacaattgtaggaaaagcacaaaattgattagtattgcaaatcaggttctattacaaagcagttgtagcaactgatttgctctttttattatcctggaactttgttacactaaataattctcacaattagtgaggctaatgagtaagccttggacatttagtgttaatagagattctgttagtaaatatttattgaagaactactgaatgcagagtgtggagctgtgttctgctgcgaaaattcgattttatcccaaaggcaacatggaatatagtacgggggagttaaatgatgaaaacatgagttatgatctataattagtggagaagattgaaaaaataaaaaaacaagaaaaatatattttcctataatctcacattccagaaacatctgttaactttttagagtgttttcctctcattcttttctttctgttttgaacatacatgcataccttttttttttttttttttttgagatggagtctcgctctgtcgcccaggctggagtgcagtagtgccatctcggctcactgcaacctctgtctccagggttcaagcaattctcctgcctcagcctcctaagtagttgggactacaggcgcccgccaccacgcctggctaattttttgtgtttttagtagagacagcgtttcaccatgttagccaggatggtctggatcttctgatctcgtgatccgcccacctcggcctcccaaagtgctgagattacaggcgtgagccaccgcgccccatatatacctatttttgataaaatatatatttctttttaaaaagtggtatattagggaaaacacaaataatctgttaacattttcaatgtaattccttcctgcatgtgtttttacatgaatatactgtgtgtgtgtgtgtgtgtgtgtgtgtaacaaggatcatttgttactattttgaatgaaatctttttttaagcttttattttcttttttgtggctgatatatagaaatactgttgtttacaacaaaatgctgaacgccacctaggtctaatcatgtgtctatataatttcttggatttctttgatgtgggcagttgtattgtccataatttatgatgtggaaaccaaagctatagaaaagttaggtaattttacaaagaacataatatcagtaaatgacactaagtatgaaattaaatagtaactattatcaatccccttacagtattcattctttgaccttgtttttttccatttgtaatagtgttagcgtccaactgtcagctcatgtccaaatgtcggctcatgaattcctctttaatagctggacttcttttagcctctggctgtgtgagggtctcttgacctcagtgatctcacatgtgccactctgtccttctagaacactattctcctcgcctttgctaaacttgccttaaaagtgatttcctcagagggaccgctaataatgatcttgtttaaactttatgcccttcctactactatcatctctctctctcggtaccttttatttctacacacttaccatgatttcagttacacagattgtgacattacatgtacatatgtttaactgtttgcttctttcatatttgttctctatacccagcgtcaagcacttagttttgcagtagtatatgtaaatagtaaatatttgctgaataagatggaatgaatatatcttttgctgtcacaacatgtataattttctttttgatgcttcgttgattgcatctatgatttatccttctcatgtacgtcttagtgggaggaatctaacagtatccatcttttcctgttataaaattaatgttcttacttgtagagtcgtgccccaatttctgcaaaacttgtggccaatatgctgtcggtggctggggcggatcacatcatcaccatggacctgcatgcttctcagatacaggtatccgtgttttccttctgcaaatggttaaatcaagtctgttaaattaaataatcttaggtaacattacttgtgtttgagtttatatatggctactctcttggatttttgtctttactaaacttgaaaatataatttgatattagtacttccagtctctatcaccaccttgccccccagtcaattttggaggagtggggatggctttttggtagtaagctctatatagttccatctcagcttatggaaaataattagaacggcagtcataatgtacactttttaacttcttcataacttattttctttgtctctaaaacaggccaaattatactgtgccactttgtgttatataatgaacgtgaagtatttgatttataataactacttaagagacaacaaaccttttccctcaccgtcctgcatagccattctattcctcagaatataggccatcataagacaatggaatatgtcccaagagacagattggactgaaatatgcccctataacatatctgtcttttgatttaattctgtttaaaattaacaaaagggagtctgttataaaagcttcttttgaacaaaaaatgcaaatgttatttaatgaaagcgattatcgtttaaaaaaacaaaagaaaacaaaacaaaacaaaaccctgcaacatgacactcacttctccctttagggattctttgatattcctgtggataatttgtatgcggagcccgcagtcctgcagtggattcgggaaaacattgccgagtggaagaactgtatcattgt

SEQ ID NO: 4293 - DNA, 23297 bp, human
aagactccagatataggatcactccatgccatcaagaaaggtattttaaacattggaacacatatagataatttaagtaggtagatgtatgtgctgttataaggaagtggggaggagagaagagggaaccgaaatcatatgcacaaaaattttttttagaatataaataaaaaatgtggtagtctaaaatgtcaattcttcaaagataaagttaggctttcagtaacgttagaaatggttttctggaatatgtctccagtctacctaactttgaggaagtaaatactgtaaatagatgtttcaaacgcattttaaagcaatgatcctagcatgtctttaagctacagtattgtgctgtctttgaaatgtaaactttgatgtcttctctttctcttagttgatgctattgggcccatctcaagctgatcttggcacctctcatgctctgctctcttcaaccagacctctacattccattttggaagaagactaaaaatggtaagaacagctcagagaaccttaaaaagtgttatctgtaatctttgtggaaacaactgaaaccagctggcaagagcaatattgaagaatctgtacttaggttatttgctgggggaaagtgcttcctgatatttcacaattggcattaatgaagggggcatgtcacaatttcagattaatcaacgcttgctctgttcaacttcctacaagaattaaatatgtgctgtggggaggaggagcagatgtttgaattggggacatagcttctatgtatctcatttcttcagcctacaattttggctttaaagccataacaaatcactgaattactgaagttactttgtgctttttccagcatatggtgttgtcttaatgactgtgtggatgaaagtgtgtgggcaggctcatagcaataaaatacgggaaatccccgggcttgagtgctgtcaaagaaaactaaatttggacagtagataaagatactatcaggactattgcaatcggcagaaagagacctcagtatagaaaggggctcaattccaaatacagccaaagaccagtaaagatttctggccaaggagtagagtgggggtcagtggatggaaaattactaagaggaaacatcaagggtaaaaggattctggctaaaccgacctgacaggattcttgctgaagacaggccagggtgatcagacctcacctgtggatggtgggagatgaggaatttgatcagatattgagggtgatcacataccaagaggagtggattatcaataaaatgacttagcaggattcctgcttgaactgggcaatgcaaagatggacatgaagccaaaggccgaagcctaggggtgtagtagagcctgattaagttgaattaaggagagtctttgtcagcgctggctctcccagtcactagttgggggggccttgtgcctgtcatcaaagtcctctgaaactcaatttctctgactatgaaataggcattagaatccctcccctgttgccttccagggccactgtgaggctcaaataatagactatttttcaagtcctttgcaagtggtatgatgcaagtgtgagttattaggtatgccaaaacttagtcggaaaaagacgtcaagggcctttttctgaaattattttgtcacttaaatcagacacattctagatccgaatgttagctcctaggctcattttgtgtcaaagttctaatgaagcattaaccatggggctattgttacaaaggaaacaactgcttacggtttcatttcctagaaacccagatgtctattttaatgcaaacctatgcccacatctgtctttgccccttgatgggtggcataatgggaatgatagtaatacagagagctcacatttcttgaccactcaactatcatgctgagggctagatagacatgattctattttggcctcaaagtagccctataaggtagagataacgaaactggggctttgagaggttaaggagcttgggtggctctgaaagctgtgctgaagactcttctgttcttcctagaccaagcccagcacacacgcaataaagatgaggttggatatgatggcttcctactcaagtacaaaggggaaatagtatatcttttctaagaaaagacgtgaaaataattttcaatataagaaattcaaaaggcaaaaaagcacagggaaaatattcaactgtattgagtcatatggcagatcctttgatctagagattacacttttagaaactcttcttaaagaagtgaccatgagactggataaaaaaatgtggcacatatacaccatggaatactatgcagccataaaaaggaatgagatcatgtcctttgcagggacattgatgaagctggaagccattatcctcagcaaactaacacaggaacaaaaaaccaaacaccgcatgttctcacttataagtgggagctgaacagtgagaacacatggacacagggaggggaacaacactcactgaggcctgtaggaggagggtggggcaggagagagcattagggtaaaaagctaatgcatgctgggcttaatacctaggtgatgggttgatctgtgcagcaaaccaccatggcacgtttaactatgtaacaaacctgcacatcctgcacatgtaccccagaacttaaaaaaacaagcaataaaataattttaaaaaaacaaaagaagtgatcgtggacatggaaaactatttaccaagatggtcagtgcagccaggcaaaaaaaaaaaaaaaaaaaaaatcatgtcccatgttgggaaggggtgaattaattgtagtagactcattaaatggaatattatgtaatcatcaaatcatgttttttaaaataatactgaatgacctaagaaagcactcatggtataatgttaaatgaaaaaagcaagctagaaatggataagtaccgtgtattcctcatgtttttactgcacctgctaggcaaatactagatgctcactaaatgttggataatctgtgatgatggtttacataaacacatgtgttgcatattctaatttcattcaacatccctactttataaccattttacagttggcaaatcagaggctcatgaggtcaagtgatttatgaaagtcagagagctcttacatgacagaacaaggacttaaaaccaaatttttgtactgacaaagccttggctgttactagaatgcttctcaccatgtgaaatagatgcagggatgggaaattactattagaagggaccatctcccaaaatgtcaatagtggttcagcaaatttaaaagtaaaaatattattctgctcttaacctataggaaatttctttatggctaaaaaaaggttattaagtaatcaatttattaaattaatacaatctgattatttaaaaatttggaacgctgtactaaaattaaaaatcatcattacagattaaccagccagtacctctgcaccccaagaataaataatgtatatccccgaaactcaccgaagtttagggctggggttggcaaactatggcccatgggctatatcccacctgctgtacagctcatgagctaaggggtttttttttaattgttgtttttaaaagactgaaaaatatcagagcaaaattactattttgtgacatataaaagttacattcaagtttcagtgtttacaaatggttttattgtttgagtatttgtttacttattgttgataagtgcttttgcactacgatggcaaactattcaaggagttgggtagtgtgacagagaacctgatggcctgcaaagattaaaccatttactaactggccctttacagaaaaagtacgtcaggccggggcttatagaaaacaaagggataaggtataaggtcaaataggtttgagagccctatggtctttggtgactgttgtgatgcataatagctgttgagttcctaatttatgtaagacaactttatatccttttattcttttagtttgaaaactaagtctgttgggctaaaatgataggaagtaaatgataactctctcctttttttaaaaaaaagcaagtggtttacaaccttgtacttaaacgttttggtgacataatgaaactgatattcatggtatttgtactttacagagattaaactaaaattaaaaatatttcaaaattcacaaataggggatatttgttaataaatctatttgggaaattcctagcagaggctcagtctataaaatgaatagcatttcagcaacttcccttattcacagtgcttggttattctctagggagacatacacaacacatctctagttaccaaacaattcagtgtgatataaacatggcaaaaagtcaatgaatttgagggcaaggtttccagcaatcgccccggccattgcttacttcttccatgccctttctaagttttcttcagccaggcagccatcccctctggtttctcccagacccccgctgcaggctccccgccatcacagaaagcccctcgctcacacgtcttggctcaagcaactctttgtcttagaaatgcagatcccaacatttccttttaaactcaggcaacttggcttttttctgctctgtgatcttgaaagtcgcttggaggaacagctgagtgcatggggctgttgtcctctcagggctaacatgttgtagcccagggggtgcccaggggcctttctgactggttggttagttgggtaaaagagtagagtcaggagagcaggaaatcctttcttaactcactataaaaataaaagcgttccccaggcctcaaatagtctcatctcaagataaatttccttttgccaagattgctgctgaaaataatccattgtagccagataatagctatgcaaagaatatataatagactggcaggggcatgcctaccgattcaatacagaaaggtgagggtttcatttgctggggtgtagtgggtgggagaattccttattgcaatcacactctacttctccatccagaaaactctccaaccctcctggaggactctccattttctcctctttctcctccttgtgtacctacctagaccatctgctcccatatgtcctgtctgacttcctgttccagttacctatcactgcgtaagagatcacctcaaaatgcaatggcttcaaacaacaacaatcatatactgctttctatcatgggtccaggagttgactggactcattaggcagctctcccacagggtctctcttggggtggcagtcaggcggtgactgcgactggaatcacctgaagactcactctccaggtctgatgcctgggctaggagactcaacagctaggtgccgaagcagctgcagctcctcaagtgtctctgtctccatgtggtctctctaatatggtggttgtcgtatagccaggcttcttacaagggtgatgactcaggactccaaagcaagtgggtgagagaaagggagagagggagaaacagggagagagagagagaaagtgtgtgtgtgccagtacgcgcgaggtgaaagctgtattgcctgtgaactacccaccatgtctttcgtcctcttgacaggaaacctcctagaaatgtttgctgtctccaaatccctctccttacgttcttccaagaactttgaagtcatattttatgtagctactccttcaaaacatatctggtgttcggccagttcttacgccctccagcactgctacctgggacttctgcttgaatgactgtaatagcctctcaactagtctccctgctttcacccttgcccctcactgtctattctcaacacagcagccagcagcatccttctcaaatgtaagtcagaccaactgattgtcagctcaaaaatttgcaatgcatctgcattccacccagagcagagaccgccatccatggaatggtagagaaagcccaacatgctcagggacactccctctctgacttcatctcctattgttctcctacaccccctgcttcagcaatattggccccgttgccatttttgtgaatattctagcatgttttcaccttggggcctttgctccaggctaatccatctgtctggaatgcatttcccctggatgtctgttatggatgactttgtcctttccttgaggtctttgtttagatatcaacttcttaatgatgcctatccaagctgccctatttatcgtcacaatcctaccccacattcctgatccttttcactctgccctgttttctttttcagtaacacttatcacttgacatgcaatatcatttctgacagttatatatttttgtgattatttagagaacataagctatagttgagtggaaatcttttctattttgtccactgatgtcccaaacacctagagaagtacctggcatgttgcaggcatcaataaatacttgttgaatttttcctttttcacaatttccttctacgttgttatgatgagatcttatttcctctgtaatttgattttaaaagttttaataaaaaacaatacatattatttatgataaaaagtcaaagagtagagaagggtataacataaaaatagaagtccccctcttcccagggaaggcccctttataccactgcccagaagaaattgctattaaaggtttcttgtgtattctttcctacttttctctgcaaatacaaatatatgcatatatatttatcataaatgcattatatgttatatgttattttaatgctgctttaaaaatcccctttattttttgtaacttagtagtagatcatgcatagctttttatgtcgatacccacagctctaccacattctttttaagggacatttgatattttactattggtagtttcccatttttaaccattctctcaaatcaatggattgtcatgtaattcttcctattcttactatttcagaaagctgaatcaaactagcaaaatagttttatctaaagacatataaggccgggcgtagtggctcttgcctgtaatcccagcactttgggaggctgaggcaggcagaccacctgaagtcaggagtttgagaccagcctggccaacatggtgaaaccccgtctctgctaaaaatacaaaaattagctgggagtggtggcggctgtctgtaatcccagatactcaggaggctgaggcaggagaatcacttgaaccgggtaggcagaggttgcggtgatccaagatcgggccagtgtactccagcctgggcgacagagtgagactctgtctcaaaataaataaataaataaataataaagacatataatgcttactttaaagaaaaacaaaacaaaacatgtactagttatttttttcctccctctgtggaattcttagaaggtttatggtagtttgaagctttgcatggaccattttgaaacagcagcagcctgaggttccagggggttatgaagactcccagctgaggacagaccctggcagataagtttcagggggctctacaccaaccattagagtcatagaataagcacaatagaaaaggaccattaaggtcagttagccaaactccagagtttgttgatgagaaagtcaaggttcaggataattcagttggtagccctgtagcagacagagagactgaaaacaaatctgactttcagttcacgtggtgctaacccctagaataaataaacacgaggagaaatcagactaatcccagtcttcttctaacttgtcacaagacacaaaccacttaccttcacttcctcattttttccatctaatagttcccagttatatacatgtccttctcactcctctgattgcaaccagacatctcttacaagtttacaaagttttgaagataaaaacgctatttggaaagcgtaaagttaaaaacagcttggtaaatgtttttttttttttctattagtaattcgatctctacaactgtaaatattgtggtaggaatctaatacagatctaaaatcagtaaaattcaatcttgaatatgggcttcagtcctgccatcaaaatagtgcatccaggtggataggttttgccaccttgaagagttgtttattcaaacttttgtttgaagagtaggaaagcagtgttacctttaggcctgacttagcccttgccccacaatctattgttttttctcaccatagatttccctgacagcagagagagagttctgtgctcaagagatacacacagcttctgacaatagagcagcagagtatttggttcctaattgagcaggaatggtgtttgactcatcatcatttccctactttgtctagcacagtaccttgcacagagtagattctcaataatgtttgttgaatgactgtgggagcatataattcataatggagacaaagctcaatgaggctttaaatttctaaatccacaaaatgccctcatgtaacattgctggatgatatggtttagctgtgtccccacctaaatctcaccttgaattgtagctcccataatccccacgtgttgtgggagggacccagtgggaggtaattgaatcatgggggcgggtttttcccatgctgttctcatgatagtggataagtctcacaagatctgatggtttcataaacggcagttcccctgcacatgctctcttgcctgacgccatgtaagacgtaattttgctcctccttcaccttccaccatgattgtgaggcctcctcagtcatgtggaactgtgagtccattaaatctctttttctttataaattacccaaactcggatatgtttttattagcagcatgagaacagactaatacaatggacattggatgcaattcatttaaaaaatcatcttaaaaatatctttcttttttctccctcaagttggtcccactcaaaacataaacacaccatttttttttttttttgtcttgagacagagtcttgctctgtcacccaggctggagtgcagtggtatgatcgtggcttactgcaacctctgcctcccgagttcaagcaattctcctgcgtcagcctcctgagtagctgggattacaggtgcatgccaccatgcccggctaattttgtatttttagtagaaatagggtttcaccatgttggccatgctggtctcaaactcctcacctcaggtgatcctcccgccttggactcccaaagtgctgggatttcatgtgtgagccagtgtgcccagccaccattttttaatacttgtaaatttttcctataaaaacaaaccaatttctctatgccccaaaaccgctaagtagcacaaaatagaaacattagagtaccaagaatacttgaactgaaaaggaaattaatcaaaatgcagacacacattataccaagtgcatttgctgtagctgtgtaaggcaacttgaatagaattggtcaacaatgagtctgaatcttggtttgaaattgcctgtctgatctctgcttcctcatcagtaaaatgagaatatttatatggcctttcaacttcagtgtgagggatcaatgatgtaatataaacaacaagtctgccttagaacctggcacaccataagtaataaaaggcagccaatattttaaaaaatacacaaatcatggtctgatggctgtccaatataaattctctattttccattttaactaaagagacgatatattgagaaaatagaaacacctgtgtgtatgaaatcacccattcccatttttacaataattagtttgctaattgagcatccaaatttacccagtgtatttgcatgtgtaattagctgtgattcaataccaaagccaggcctatcatggtatactatgctattttacaagtcaaattactgaaagatgcatgtctttaggcaatcattacaaataaaaaaaaaaaaaccgaagcaaaacaaaataacatagattatttgtatcagatggacaaaacagacctggcttgatgccgaacccttaaatctcaaaataacgatagttgaagctaaggttccagcttaagtctgaagcaggtagtttccaatggcttgaaaggagaaatttctacactgaaggaaatttccattggaataaaggaatatttcacacttttaagtcatcttctctagatggtcttttgggtatactttctctttaaataacagatttagaagcactttgttcatttgtttagaattaattccattcacaagtttaacacagcctaaggtttggtctagaccaggggtctgccagctatgacctctgggctaaatctgtcccttcacctgctttttttttttttttttttccaacctgtgagctaagaatgggttttactattctaataaatagtgagttcatttttctccctcacctgcttgatcagagcccaactttctcattgcagttaatcttccttctggcatggatcttggaatgcaaacttgctgggatctccgagttccaggcttcccgtgcagccggtgtggagagccaagagatgttttgtttggcataaagcattccaagggtcagtgggcttgggctcaactattgagcataggacaagggcagccccatcctgactgtgactcttcccacaagagacaaacgagctctgtgctttcactggggtttcaggttcaaagggacagagcgtctgagaaaaaggattatgaaagagtccgtctgcagctccacttcccgtgcccttccaatgataccatcctcgtttcttctgtggcatgctccccacttcaatccttccttcagaggccccaaaccctcctggtctctccttgtcaccttgtgaaaatctgatcttcagggaaaaattccttactatttatactagtataatgtgaatcttctatgggattttaagaaagttcaaagccttggtttactcagcaaatatttagcttgcactcactatgtggcgggcatcctaatgatggagtatatgtaaagacaaaaaaagtttccggacctcaaagtgttctccatctataggggcagatgactgagttgacatctcgagaagtagaatagcagagtggctaagagtgccagctctgtctcaatcacctaggtctcacctcagcattaatttcactttcctcattgtaaatgagcatatctcttagaattgggataagcattaaataatatagacttggaatgaatttgcttagaactaattccatgcacaagtttatcacagcctaaggtttggtctagaccagaggtctgccaagtatgacctgtgggctcaatctgtcccactacctattgttgttgttgctgttgttttttaatgacctgtgagctaagaatgggttttactattctaattagttacattctcaatggttatttaagtacctccataatatcctcaattttgcctaaaatatttaccatctggccctttacagaataagtttgctgacttattggtctggaccaatgctatctaataaaactttctgcaatgatgaaaatggtctctatctgtacccttgaatacagcagccactagcctaatgtggctttttgagctcttgaaatatagttagtgtgactaagagattgaattttaattaatttaaatttatggagccacatgtgactatgacattagagcagctctagacagcctgaagtctaaagactctatgctttgtcggtgctcccctctctcaattgaatcaactaccctgaggctgcatgagtcaaggggaaggccacactcttcaatcagattttttgccctggactggctttcattgtctactagaaaatgcttaatgggaagtgcttagaaaatgtacatgggcatacacttaattaatctaagttgctgctttgtctgtatccattaaatctgctttattttggggtaaactacagtagaagttggctttttcaaccctgcaaagccttaaaattcaggatgtcttactcaacttaaagtgtagagttgcagccagagcacaactgtatttccttctagccctgcttgcagaatggctaacttcagtcctatttcatttctcttgtaagactgctaaaaacagtaagaagccaccaacatcattatgaatattgccaaatcatttcgcctaagagtaaagtcacagttggcatgtgttctgccctccaagacaagatagcataggtgacagttttatcagatatcttgtgatggcataatataggccacccagctttccagcctctgatatctgagtcttcccaatagcctgatgacatccgcatcacatattttaggttcgctcatggacagtaacttatttccaaattctatactggttaaaattaggtttgcatttgtgcaatagaaaatccaattgacattggcttagcataacaattttttgatttctcataaactcttggcagtcagcaggtccaagccattatttctgctctgctctctgaggtcatataaggaaggatctggatgctctgggtcatctacgtcatctaactggttgctgtgccatccctagctcatttttctcatgtgcattgcccaagatggctggctacaacatccacattacaagaagccaggtggaagcagacaggagaaagaggagaaaggggaactgccccaccgtttaaggacatgtcccagaaactgtacacctcacttcctcccaaatttcactggctatcacttagtcatatagccacacttagctgcaagtgtgtctgggagatataattatttttcacagtggtatatgcccaactacaaatggaggttctgtcattatgagatgagagaaaggcagaaaacatgttgagagatgtgtagcaatctctggactccacggggataaaaaagaattgagagtatcaaaattcaggatcaaaatcaaaattaaagataaaaaatatcaataactatcacctggaataagaacaacgtacagttcagctacacatatacaagtggcagcatcttgtctggaaggaactaatggtctttctacattgtattttagatatgtatttttttttctcccttccacaggattttgagctccttaagggcagagactttgtgtctcctgctcctagtaggcatccaacacgtatctgtcaactgaaagaatgaatatgagtcagtagatacatattagaattctaatatccactggctgggtccttggtgtgtcccatattgttgtttctgtgtccatcattcttttgcagggtatcttctactgggcacagaacctgcctcagaggggcatatgggtaatgaactaccaagaaaggagtagaacccagttcttccaaccctccacccagagtgcttttcacaacctcatgtgtaataagtgcagtaggagatgagaggagggagtgattacttctgtctggtttgatcccagaaggttttttgaagaaagtgtttttgaatgagacattatgaaaacagagcttcttaaaccttttcccccaaggaatccctgggcagatagaagagacagaaatctgacctctgcttagtctgggggtatagactgaaggaacctactcaaaggagaaatttttctcatttttctttacttcacgattcatatatgcaggcattcattctttcattcatgtatctcacagacataacgaggtcctaattaagtgccaggcattgttttacatgagaccacaagaggccctaccctcttgcagcttacattcttgtacagaatagacatcatacgaataagcaacataaatcatcaagataatttctgaccgtggtaagggctatgaccgaaatcaaacagggtagtcagttacagagtgcatatacctctctgtgcctcagttgactcatctgtaaaatggagataataatagaggtctaggctaggcatggtggctcatgcctgtaatcccagcactttgggaggccgaggtgggtggttcacttggggtcaggcattccagaccagcctaaccaacatggtgaaaccccgtctctactaaaaatacaaaaattagccaggcctggtggtgcatacctgtaatcccagctacttgggaggctgaagcaggagaatcgcttgaacccgggaggtggaggttgcagtgaaccgagattatgccattgcactccagcctgggcaataagagcgaaactcagtctcaaataataataataataataataataataataatagtctataattccaaaacccaaaactgaaagctttgtcctaactcagttgattgcaaacataatatgatctgaatgcatttggaggtagatcttgacctgaactgaagttatttattctttttaataaataaatgagttatttattctttttaataaataaatgagtcatttattctttttaataaatgagttattctttttaataaataataaactgagttatttattctttttaataaataataaataactgagttatttattctttttaataaataataaatgagttatttattctttttaataaataataaataactgagttatttattcttttttttttaataattccacttagagtggacaatcctatatgtcactgcagaaattttgtgtgtttgattatggaatgctgccccaggcctcaatagttattacataatttagggtacatgtagcgtattaccttctaaaatttgaaaaattccgaattccaaaacacatgtagcaccaaaggtttcggataagggattgaagacctgtagtatccattattgtgaggattaaatgaatgaatatatggaaaacacttaaaatgatgcctggcatgtggtaagtgctacgtaagttaactactattactattattatcactattcttacatgagaagatatttagataagttggtcagggaaagcctctctgaggatgtgtcacttgaataggcaactaaggggtggtaatgaccgggctgtgggaagaggaggagaaagatgatttcaggaataggaaacagcaagtgccaagactgtggtggttacaaggctggcttgaatgcagaacagaaaacagaccagatggctgatatgtggtaaaggaggggaaagatggctcaaggtcagagaggtaggctgaagtcagaacacccttgatataagcaatggtagagactttggatttcatttaaagtgtaataggaagacattatagttgatctgattcaggtttataaagaacgctctgatgctgttggatgaatgaattatagaggagaagggggagcagggagagcaatttggagtctagcatagtggtccagatgagacctaatgactaattggagttgggaggtggtaatagtcaaagagaaaagtggacaggtgcgagaaaaaagtttagaaataagtggggggcgggggaggttttctgattaatttgcattctaatttataatatgtcactgtgtagaggctaaaaatttcacagtcattgtctcaggtgtgttaaggccagtggcgtgctggaccccacttgaaattggccatggagggaatatttacactatagaaattgacaaatgctacaaatcaagacaacaaatcaggcaaagcttcttgttaaacatttaccatcacaccactggtgaaggtgacttgatttttccacaactaaacttccttcatttcacagcctccattttccctgatcacgaaaacacttaaactaggcacatcctcggaaacgcagtatgaggactgctgtgtcaatcacttcatgtttttaactcaattcagcgatcctcccacttcttcccaggctctcatttaggtacatgggaatgggatgggaagagggacctggttcatgattgtcatttacccaccttggccccctctgaagtacaactccactctctgctttacaatatcactctgggcagcattaccaattgcctcctgatagtgggatctatgaacccattatgtctttggacaaaagcatagccaggggttgggtccagggcctgggatcctataaccgtacaaatcctattatcagggactataaaatcctattatcagggaccatagccatccctctatcttgactcaactcctcctccctgagtagtgaacatttttcctaaatctctgagaaagactggtgctctagaaagatgtaccatatttatttaagggcttcctgtacccactggcatattgccatatattctgaggtatctgagtgctccttttgagaaacatagccttaaaggataagtagaaatctggtgggtgaaaatggtagggaagaggacttctaacggagggacttgcaagtcagggaacttgggtttatcgactagtgaggctagtagaggaattcaatcaggtaagccggacaagtagacagggtacaaattatggaagactttggatgccatgataaaaagcttcagctcatactgtaaaaaataaaataaaataagaaggttgggtgcagtggctcatgactgtaatttcagcactttgggaggctgaggtgggacgatcgcttgagcctgggaaacaatttcaaggagttcacagcaagaaactgactgattaaggtttgggaagcttgatagatagggtagactgggaaagtgagagaggaggctttggagtggaccaaggatagagggatctcagctgatattatgtcagctaaaacctcaaagcaaggaggatgttaagaacaatgaaggaggtcagctggactctcaatgtttttaacgatagggaggaaaagataggggggtgacaagaagaagagacaattttgtacctctaactccaacaaactttagacctgaaaaatcccttctgagccatcttgcattggagaaaaaaaattgcttatttacctccaattagaggaattaagggaagtaggatttttttgtttttcttttgagacagggtcttgctctgtcaccctggctggggtgcagtggtgtgatcacggctcactgcaacctcaaactcttgggcttaagaggtcctcccaactcaacctcccgagtagctgaactacagttgtgtgccaccatgcccagctaattttttattttctgtagagagaggggtctcacgctatgttgcccaggctagtcttgaactctggcctcaagcgatccgcctgccttgtcctcccaaagcgttggtattagaggcatgagccaccacatctggtggaagtaggcatttggtttcttagataacaacatgattggttgattcagtcacttgggaagataaaagcattaactgagctagatccctatggtagagacacaggctggaccactccatgcgtaagtactaaactaaaaccagtgttctggagtagacattgctagaaatcctgaaacttgagagccagtccacggttaaagcattctgtaaggcagagccagtggaaggtaataaggtgatttttaaagctcttctgcacttcccatattcccttttagggcctttctccctagggtcccagtgtctgtcatgctaaacctagatgcacaacaatcatctttatgggtagtttcccatatgtcccagtttgcctgacagactcttggtttatgcctatagtcttggtgtaattattaccagccccacttcattcttgtaagtatactaatggatcagttatacggttcctctgattatgtatcacctaggcagtgccctgactctactactatctcctctccaaatttatgtaatgtaaacccaatgtgtagggaaaatgctcatcctaaaatctccttggaggggataatttgcaagattctttgcaaaaacaatccaagacaagagccagattatggaatgtcagtgccagaatggcaggaatgtatgttttctaatcaaatgccacttactactgggtaaccttgggctaatcagttaatattgctgagcgatgtcttcatttgtaaaacgggaatcttagaatattctgagactcaaatactatgaaagactcatgtaatgtgtaccagggcaggtttagcaggccgacataaattgcactaaagtcttcatgtgttatttttcatgggtgtatccatattctaacatttcttcaccctccaaatttcagactttggcagtgaatctatggctctgcaattttagtgttccatgtaacaacgaataggaaaatgctgcttctaccctctcgaaagctattttgctaaagagctaagatgctaaaagctaaatatgtaactaaatagttgcaaatctcagtaactgacaaatacagtcatggggttggggatgctgtttagacagctgaaaataagacctgaattgtttatttttaaaatgttgcaaaagagaggcagcaaatgggaatttttaattctgattcttggtatgttttagaacaatgatttgttctttcttatactttcaggtgtttccaatgtggacactgaagagacaaattcttatcctttttaacataatcctaatttccaaactccttggggctagatggtttcctaaaactctgccctgtgatgtcactctggatgttccaaagaaccatgtgatcgtggactgcacagacaagcatttgacagaaattcctggaggtattcccacgaacaccacgaacctcaccctcaccattaaccacataccagacatctccccagcgtcctttcacagactggaccatctggtagagatcgatttcagatgcaactgtgtacctattccactggggtcaaaaaacaacatgtgcatcaagaggctgcagattaaacccagaagctttagtggactcacttatttaaaatccctttacctggatggaaaccagctactagagataccgcagggcctcccgcctagcttacagcttctcagccttgaggccaacaacatcttttccatcagaaaagagaatctaacagaactggccaacatagaaatactctacctgggccaaaactgttattatcgaaatccttgttatgtttcatattcaatagagaaagatgccttcctaaacttgacaaagttaaaagtgctctccctgaaagataacaatgtcacagccgtccctactgttttgccatctactttaacagaactatatctctacaacaacatgattgcaaaaatccaagaagatgattttaataacctcaaccaattacaaattcttgacctaagtggaaattgccctcgttgttataatgccccatttccttgtgcgccgtgtaaaaataattctcccctacagatccctgtaaatgcttttgatgcgctgacagaattaaaagttttacgtctacacagtaactctcttcagcatgtgcccccaagatggtttaagaacatcaacaaactccaggaactggatctgtcccaaaacttcttggccaaagaaattggggatgctaaatttctgcattttctccccagcctcatccaattggatctgtctttcaattttgaacttcaggtctatcgtgcatctatgaatctatcacaagcattttcttcactgaaaagcctgaaaattctgcggatcagaggatatgtctttaaagagttgaaaagctttaacctctcgccattacataatcttcaaaatcttgaagttcttgatcttggcactaactttataaaaattgctaacctcagcatgtttaaacaatttaaaagactgaaagtcatagatctttcagtgaataaaatatcaccttcaggagattcaagtgaagttggcttctgctcaaatgccagaacttctgtagaaagttatgaaccccaggtcctggaacaattacattatttcagatatgataagtatgcaaggagttgcagattcaaaaacaaagaggcttctttcatgtctgttaatgaaagctgctacaagtatgggcagaccttggatctaagtaaaaatagtatattttttgtcaagtcctctgattttcagcatctttctttcctcaaatgcctgaatctgtcaggaaatctcattagccaaactcttaatggcagtgaattccaacctttagcagagctgagatatttggacttctccaacaaccggcttgatttactccattcaacagcatttgaagagcttcacaaactggaagttctggatataagcagtaatagccattattttcaatcagaaggaattactcatatgctaaactttaccaagaacctaaaggttctgcagaaactgatgatgaacgacaatgacatctcttcctccaccagcaggaccatggagagtgagtctcttagaactctggaattcagaggaaatcacttagatgttttatggagagaaggtgataacagatacttacaattattcaagaatctgctaaaattagaggaattagacatctctaaaaattccctaagtttcttgccttctggagtttttgatggtatgcctccaaatctaaagaatctctctttggccaaaaatgggctcaaatctttcagttggaagaaactccagtgtctaaagaacctggaaactttggacctcagccacaaccaactgaccactgtccctgagagattatccaactgttccagaagcctcaagaatctgattcttaagaataatcaaatcaggagtctgacgaagtattttctacaagatgccttccagttgcgatatctggatctcagctcaaataaaatccagatgatccaaaagaccagcttcccagaaaatgtcctcaacaatctgaagatgttgcttttgcatcataatcggtttctgtgcacctgtgatgctgtgtggtttgtctggtgggttaaccatacggaggtgactattccttacctggccacagatgtgacttgtgtggggccaggagcacacaagggccaaagtgtgatctccctggatctgtacacctgtgagttagatctgactaacctgattctgttctcactttccatatctgtatctctctttctcatggtgatgatgacagcaagtcacctctatttctgggatgtgtggtatatttaccatttctgtaaggccaagataaaggggtatcagcgtctaatatcaccagactgttgctatgatgcttttattgtgtatgacactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtgattatcttgatatttcttgagaagccctttcagaagtccaagttcctccagctccggaaaaggctctgtgggagttctgtccttgagtggccaacaaacccgcaagctcacccatacttctggcagtgtctaaagaacgccctggccacagacaatcatgtggcctatagtcaggtgttcaaggaaacggtctagcccttctttgcaaaacacaactgcctagtttaccaaggagaggcctggctgtttaaattgttttcatatatatcacaccaaaagcgtgttttgaaattcttcaagaaatgagattgcccatatttcaggggagccaccaacgtctgtcacaggagttggaaagatggggtttatataatgcatcaagtcttctttcttatctctctgtgtctctatttgcacttgagtctctcacctcagctcctgtaaaagagtggcaagtaaaaaacatggggctctgattctcctgtaattgtgataattaaatatacacacaatcatgacattgagaagaactgcatttctacccttaaaaagtactggtatatacagaaatagggttaaaaaaaactcaagctctctctatatgagaccaaaatgtactagagttagtttagtgaaataaaaaaccagtcagctggccgggcatggtggctcatgcttgtaatcccagcactttgggaggccgaggcaggtggatcacgaggtcaggagtttgagaccagtctggccaacatggtgaaaccccgtctgtactaaaaatacaaaaattagctgggcgtggtggtgggtgcctgtaatcccagctacttgggaggctgaggcaggagaatcgcttgaacccgggaggtggaggtggcagtgagccgagatcacgccactgcaatgcagcccgggcaacagagctagactgtctcaaaagaacaaaaaaaaaaaaacacaaaaaaactcagtcagcttcttaaccaattgcttccgtgtcatccagggccccattctgtgcagattgagtgtgggcaccacacaggtggttgctgcttcagtgcttcctgctctttttccttgggcctgcttctgggttccatagggaaacagtaagaaagaaagacacatccttaccataaatgcatatggtccacctacaaatagaaaaatatttaaatgatctgcctttatacaaagtgatattctctacctttgataatttacctgcttaaatgtttttatctgcactgcaaagtactgtatccaaagtaaaatttcctcatccaatatctttcaaactgttttgttaactaatgccatatatttgtaagtatctgcacacttgatacagcaacgttagatggttttgatggtaaaccctaaaggaggactccaagagtgtgtatttatttatagttttatcagagatgacaattatttgaatgccaattatatggattcctttcattttttgctggaggatgggagaagaaaccaaagtttatagaccttcacattgagaaagcttcagttttgaacttcagctatcagattcaaaaacaacagaaagaaccaagacattcttaagatgcctgtactttcagctgggtataaattcatgagttcaaagattgaaacctgaccaatttgctttatttcatggaagaagtgatctacaaaggtgtttgtgccatttggaaaacagcgtgcatgtgttcaagccttagattggcgatgtcgtattttcctcacgtgtggcaatgccaaaggctttactttacctgtgagtacacactatatgaattatttccaacgtacatttaatcaataagggtcacaaattcccaaatcaatctctggaataaatagagaggtaattaaattgctggagccaactatttcacaacttctgtaagc

SEQ ID NO: 4294 - DNA, 2119 bp, human; identical to SEQ ID NO: 3048

SEQ ID NO: 4295 - DNA, 1423 bp, human
gcaagaccggcttcggggcgcgcggcggccgctttgtgtgcggggctgcattgtgacgcgggcgatgaagccggtagggcggtggtcggaagctccagccgcggccgccgcctttgtgagaggactagaaagccggatccggcccgcatccttgcggagaggccgcggctaggaaatggaaacgcttttcctacctgggctccattttaggaattcttgccgatttttcccacttgaatttggaagtggctttcctcttctttccttgtcctagccagcctttaattttaaacgctgtaattaacaattcgcagtggtcaatttcctttattctgcaagattcggctttgagaggcatccgccctctttggtccacagcgttttgaaatatggggaggaggggcgcggggggtgtcgcctctttttctgtagaaagaggaagctcgtgagcgcggaacggcagcagtaggagagcgagaagggtttttttcaggctgcgggtcggagggcagaagtgcagttcccagcccagagacagcggggcgggtggctcttcctcacgctcgctcttggcttgctccctgcagcttttcctccgcaaccatgtctgacaaacccgatatggctgagatcgagaaattcgataagtcgaaactgaagaagacagagacgcaagagaaaaatccactgccttccaaagaaagtgagctccgacccacccccatctttagaaaggctgggtgggagcggccggtgggagggcgggaggctgggagcggccgcgggaagaattcgggaggggggagtgcgggggaagagccgacagttgatgaatgtggcttgcaaaggttaattaaaaatggttttgcagccaacaaacacggggctttagtaatttagtaatggaatatttaatatgccatattaatatacaaacatttatccattaaaatgtatttctatttagtatattcaatatacatattttattccattgtggaataccgtgtagaatgtttatgatttgaaaagatgctttaaatgaaagccctttagtctgtactgaatcctttaatcatctccctccatcttttttttttttttttttctggtcacagcgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaa

SEQ ID NO: 4296 - DNA, 1983 bp, human; identical to SEQ ID NO: 3049

SEQ ID NO: 4297 - DNA, 2116 bp, human; identical to SEQ ID NO: 3050

SEQ ID NO: 4298 - DNA, 63953 bp, human; identical to SEQ ID NO: 3052

SEQ ID NO: 4299 - DNA, 63969 bp, human; identical to SEQ ID NO: 3053

SEQ ID NO: 4300 - DNA, 44370 bp, human; identical to SEQ ID NO: 3056

SEQ ID NO: 4301 - DNA, 43115 bp, human; identical to SEQ ID NO: 3057

SEQ ID NO: 4302 - DNA, 46311 bp, human; identical to SEQ ID NO: 3058

SEQ ID NO: 4303 - DNA, 43392 bp, human; identical to SEQ ID NO: 3060

SEQ ID NO: 4304 - DNA, 33874 bp, human; identical to SEQ ID NO: 3061

SEQ ID NO: 4305 - DNA, 109204 bp, human; identical to SEQ ID NO: 3062

SEQ ID NO: 4306 - DNA, 164078 bp, human; identical to SEQ ID NO: 3063

SEQ ID NO: 4307 - DNA, 109704 bp, human; identical to SEQ ID NO: 3064

SEQ ID NO: 4308 - DNA, 167182 bp, human; identical to SEQ ID NO: 3065

SEQ ID NO: 4309 - DNA, 44370 bp, human; identical to SEQ ID NO: 3056

SEQ ID NO: 4310 - DNA, 43115 bp, human; identical to SEQ ID NO: 3057

SEQ ID NO: 4311 - DNA, 46311 bp, human; identical to SEQ ID NO: 3058

SEQ ID NO: 4312 - DNA, 43392 bp, human; identical to SEQ ID NO: 3060

SEQ ID NO: 4313 - DNA, 33874 bp, human; identical to SEQ ID NO: 3061

SEQ ID NO: 4314 - DNA, 109204 bp, human; identical to SEQ ID NO: 3062

SEQ ID NO: 4315 - DNA, 164078 bp, human; identical to SEQ ID NO: 3063

SEQ ID NO: 4316 - DNA, 109704 bp, human; identical to SEQ ID NO: 3064

SEQ ID NO: 4317 - DNA, 167182 bp, human; identical to SEQ ID NO: 3065

SEQ ID NO: 4318 - DNA, 109204 bp, human; identical to SEQ ID NO: 3062

SEQ ID NO: 4319 - DNA, 164078 bp, human; identical to SEQ ID NO: 3063

SEQ ID NO: 4320 - DNA, 109704 bp, human; identical to SEQ ID NO: 3064

SEQ ID NO: 4321 - DNA, 167182 bp, human; identical to SEQ ID NO: 3065

SEQ ID NO: 4322 - DNA, 164078 bp, human; identical to SEQ ID NO: 3063

SEQ ID NO: 4323 - DNA, 167182 bp, human; identical to SEQ ID NO: 3065

SEQ ID NO: 4324 - DNA, 76101 bp, human
ttgattaatcagatgaatctgcatatgagaatgtgagtatttatgcatgctcatatcaatttttaactcctacaaaatatttatatcatctttgcacttattttgaataccccttctttgaaaagctggcaagaatgtggtattttcttagtgatagaattcataagacactatttgttaaactattgaaaacaaagcttataaaatacatactttagggaagaaatttcagttaaccactatgtattgtgaaataattaattttgctacaaaccaaatatgctatgtttaataagctctttattacttttaacaggaaaatgaaaatctgagaaatttttcaccaactttcagtgttttggtgataaaaagtcaaaatgatttagaagtgtgttttcatcaatattttttagagagtcaacaatttaaatgcttatataagcatttaatatataagcatataaataactgataaaataatagaagtcatatacatgctcattgttgacctattttaaaaagaaatgaaatgtccaaatgaaggttctcttttagatatcacattgaaaaatattaatagttgatagttggattagaactagcagatgggaaaaataagcaatgaaataataagtttgttctgcccatcttattatatatttcttataaaaggtagatgacttatatttagggccgaaatgctgaaacaatttttttaagtcagatagaaatgattttaagacaatcacatgaatttaaaaaaatatcatctcatttctctgaatagttttaactatatatacataaaatctacaacctaaaactaaatacattgtctgttctcaaacatcttatggttaaagtttggaaacctgggtgacgcgactcaggatttatagttctcatcatttaaagttaactttagaacatgtacaagttcagaagttggccaaagagtttggatttttctagttttcttcatactaacatatcaaatatctttaccaaaatgtaaagttaaaaatgcagtgagcgttagctctcaagggatgcaaatgaaattgttgctaaaagagttaatgatgtgtttaggacggctttctgcaaagaccatgactccaggtctggaaaacaaccttcacagaccctatctccttcagatttcttggacaagttaatgggaaggacatcaggatatgatgcaagaatcaggccaaattttaaaggtaggttccacttaaacttacgttaagcctttgagaaatcttctagatgtttgaatagttaactgaaaaacattttcagggcttttaattataaaatgaaaatgacaagtatagtgttcattttattttggtattcttttgcgttagttactgatattttcattttacctgtcacttcccacatttgaaaactttccttgtttgtgttctatttcacaaataaaactagtgtcataaattatggccacagtccttattttttcgtaagtgggagtgtggctgaaagtgaatacaagagcaagtgatagacttgacttgcttgaatatctaccaggatgcatgcaagattcagtggttactccaaaatatttggttttgattttaaatacctacatcaaagtagagtttaaatctctataaaatatgccactttacatactttcaggcctctttaatttttagacttcgtaagaagaggttctaattttttgttcctttttgtttaagcattctcattgtttatttgaaattgtttatttgaaatcaacaaagatcacagaattttaaagtgcacatgtcaaagatggtggatactttctttgttcaattagaagcaaaccaatattttttgtttttatttgttgaacattacaaaaatatacttaatagtctgcagaaatgctttttaaatatatttagtttatttttattctgaatcagaaaaaaagaataagaatcaattactaataactgaatcatgttgatgctttaatttttaaatacatagtttaagtgatgttgtctttttcttgtaatgaaatttaacataatgcattgtgaagtgtttataacattttataaaaggagaaacctataatgttctggatattatgtagcaattcatgcattgcttacttttgtttattagcaatttaatggcacacttttcttcagtgttgatttttattattggcaaatataagcatgaaaactaaattttaaattcatttcttctttaaatgttacacctctgaatatacccaggtatgggcatattttataaagaaatatgtcagaattttggtgaaatagtattttttaagtatctccaagagagataactgaactacattcagagataaatttttctgaaaaaaaaaaaaagatggtcatgttcatcccatttcttaattttgtggtcattgctttggaagtcaatatttgaaataaaatcttgtgagtaacaaactgagaaccagctttcaatgggattgctcattcatatatttatccactaagtcattgaacaacttttgagtctggactatctgcaaaatactaactgttgggtgctttgtaaaattgggagatgaaacagtttaggtgcttctatcaaaaattttagtggagggaggagatgttacatgaatacttttactattagatggaaataggaaagtaccattaggaaatacaggtaaatcactacaggattccaagaaatggaaagataatttcctattaagatattaatggaaagctttatagagaaggtccagagatggaaaattgtttcaagtttacaagcatcttctttcatagctgttattcatttctttctagaaatactttttcaaaagggcaggaaagtacaaagagtaataaaacacacccatgttgacattgctactttaagtgaccacacaagaatgagccatcatttccacatccaattttttcctggttcttccggggatatcacctttgggaaatgatatttatcatggttccaaaggataaataaatgaggagaatgtcaggttcagcaaagtgtggccatgtttttttttttttttgatctatctactactttaaagtctaagtacaggatattttaatgacttataaaaaagaaatggggtggatatcacagaagactctaacattagtgggattcattgagttttatctccctctccctttaactctccaattcaatgaacactgctaccttttcataaaatttatttacatagaccatttatatcagatcaattatctgacatctcccaaagttctcttcatttgggggagcttgattattcctggatttaaaacactccccattattttagactacaataattttttcttgatgttcccatggaattttatatgtctaatatgatccttctacatatgtatattttattgatccattctcacaccacatctgagagggcagggaagtaccttattttatatatacatacatacataaaatattggtagtgtagggaaaataagtgatccttttctccaggataaggaaattagaaccaagacagagaggaaaaggtagatcaattaatgaagattagtgcttccaactggttgttgtagtagaatgtgagggtggtaacttttgagagaccagccagtagtcatagtggcaagcaaagatgatcttagctgaggtgaagagaaggaaagaaaagacagagaaaatagggaacttgtaacaaggaggaggcttagataaacactataatacttaccatagttgattagcaatgtaccaatgaggaatttaatatagtcagtagaaatgaagggagattaggaaatgtgaatgcatacagaatagtaacggtctccctgtaaatgtgaaaaagcaattttctgtgataactataaacatgatagtgatgatgatgttgacaattaaaataacggtgactgttaagaagatagaagggcaaaatttgaccaccagaataaaatcaagagccaaatatgggccactgaggtaaacagaatggttattctagaattcttattaaatattagcatatttctctgttttccttgctgccctgcattggcaagggaaaaagaagtgcataagtataatttttcttattggaaagaatttttcctgtatactttcaagtcagtaaaatattgcatgtctattccatattcctgatgggctttgaaagatgtcataatgggcatatatataagaaggaaaaatggatgtaagctagaaaagataaccaccagaaatgattcagacttagactctgtaattgagagacattcttagaaactacagggaaaaaatagcttttctgatgtgttgaagcacaagtgtataaacaaagtcatgagtcagagttgtcaattgaattttatctataagatccatagagacgtgtttcagatcttgtcaaaacatacatttaatgaaaatcctcaattcagataaaaacacaagctatatccattcacaattacctggttctgaaaccatggtaaatgttgattctatatcaagagatgaacctctttccccacttaggtgatttgtctcattttcagttgatttatcatggtgttattccatcatcctatcagatattcttctgtcagtattattgtatcttgaaaatgcactttaaacattaggcttttaatgaaatgttcaaatctgggcaaaatgcattagttccatttctttctttttgaaacaaagcctttatctattttaatgaaattttctttgaaaataaaattaacttagcgttacatcctagttttcatcccaatgtgaataaatacatttcactaaaacattctttttgggatagaatctagagtagataatgccaggagataattattcattccacttctttgtgcctgccatgcacactatttttttcccacatctagagacctaagttagaaagtgtaatgtgtgacattaaaacctacatttgcctgaaatatgtttttctgcaatttccaaagagctagcagttcaagaggtgtttcaagtatcatagatccacttccatgaaaccagaggttttcagattttgcccctggaaaatgatcatgtctgtagtcaagtggagctaaagttcaaatgttgtgaataccaacccctgtagaaggtgcttgagcacaagcgtccaccagggacacttggaaagggtgcttctttaagttagtgacaatgcaaccccagcatcgccatttctttgatcagcctggttggcatcagacattactatggaacctgagaaagaagaccaaaatgcttgcaagtatcagaagcattgtgcctgagtgcagaaagtagcagaagcctacaggcacctgaaaaagtaacttcatggccatgctgacattgtggttttattaggaaatacagacagtaattggttcaattataaatcaccttggaagtgattatggaattatctggattatctgcttgacagttaccttcctcacagaagaattcttattctcccttaattctaggtctcccttaattaatcaagaggcctgaggtaaatcactctttaatggctgagatgaaaaaaagccctaatggcactaagcccacattgaaaaatatgagagtcattattaaaaagtatacagaaaaaaagagttttcaggtgtctacgaatgtcaagtatgagtcagagttgtcaattataaaacttttaaaatgataagaatacagcatatgattttttgagacattatcttttaattatgaaagcagtcattttaaaatggcctagaactaagcccaattccaagacagttgacactcccattagggcaattactcttggctaaatacataggctatagttatcagtgggaaccattcattgaagaaattaaaggacaactaagggagaatagaaagaaggaaaggaagaatagatttattttaggacaaattattataaaattaccttgcaaagtacatatagcatgggggactatgtatatattagtatgtctatatatatgcacaaatgttgtgtttgtatatgcaatagaatgtccctaaaagatacacaaaagagtggaaatatcaggtgcttctgagaaaggtgactggatgccagggagatgggtaggaagaaaagttacttttctctgcatgcttcttgaatgctcatcattatatgtatttccaattcaaaagggtaattaattgttaagcacttctagagaggtaaagctcaaggaagcgcctctcttgggtagtatggtccatggtggcagattagagtcagtgtcactcttactttaagtgcagtaacatgcacgtggcctgatttcaatagtacccaagcccttgaaagaaatcccttgtccaataactattctaacctagcttgctattataatggctaaaattacagcactgttgcttctgttcttggattaaagattttatttcatattaaaactacttgatggaaatgacagtaagcccaattagtattttactccataatttgaatgagagtatttggttgtagtctggcactggggaagaatattgatggtgcaaggcattataaaacaaggcattataaaacattatcaataaggaaataaaatattgtttccttattgaaaggaaaggctgggagtaacaaagggaaacatatatgatagtttcattcagagacaatattgatgaagatttttgaacatcaaaaatcactggctgtgtcacaatttattatacaaatgtgttggttggtgttcatacagcttttgtgtgctgtatgaacaccaaacaacacatttgtatatactaggctcctactatggacccacaaggtttttcagggatttgaagtggcatcaagagggcatctacagcattctaatgcaccctggtaaagcatattgcaataagtttgtcagcatgtctttcattccatggtgacagggtagtatagtggaaagagccctgaacttggatctagaagacctaggttcaagttctggttcagccatttttgagaaaagatgtcttcacctatctgtgcctcaggttttcttctgcctttacctacctcacttgggttgtactgaggatcaaatgatatcatgagcatgaattatttgttttcaactgttactattatacagataatttgagttattattgcaattccaccatttttctttcatagccaacacttactgtgtattgtgaaaacagctgcttgattttctaaatggaaagaaacaagttagagaaattcgggcatcttagattcctaccagagtaaccataatgtagaggtcataagcctcagttggttttccttatattagttcagtggggaaatttccaacctgaaacggctatttcatattcctaaatataaaacaatgagggagccatttgtgggaaggaattatctttacccattcaaatcccatctctgattattttcttggactcattttaaaaaataaaccaaataagagaaatagaacaaatttaacttagtcctataaaggaggaccttaaatttaactgaagataatatgactgccatttctgatgtattttcttgtccagttactatagttgcaaggttcactgcacaatagtactgagatgatttcctattttagaattagtatttaaaagagagcatttggtctcacaacatggcaggttaagcgtaccagaaatggaagcccataatttagtctttgagaaagtactgcattgctccttggttgattctgggcgaccccatatccttaattttcattattgaatgaacttaaatattttatccttagtttatagaccttgctggtcctccacatcctgaaggataattcagtcaattttgctgataatctgagacttaaatggcatcaatattcaggtctcttggtgctcaatgaatggacagtataatgtgttcagttggggcagttaggtttagagtgagaaaaaaaataagtcattagtttgttcttgatggtgttggatatttttcttggtgtgttgctcagacactgtggaacagggtcttaaaaatgtaactatgtttgacgaagcctcaataacaaggtctttggaagcattctgggctccctttggaattaacgcctaggatgctgtcctgactgttgtatgaagcgtttgctcattgatttctttcctgagagagctactctgcacacttatgactgactacagacactttcagccatgcagaagccactaaagggagcatatgagcaaaaggcataggcctcaaatggatattctaatgtgtgcagtacatgtaagaacaaagtcaccaggttactcacttggagtctagtttggccagccaaccaaagtggttatgaggtaaatacaagagagaagctggaccctttctttgactcatgctatggtttgtgtatccaccattccattattaatatgatacaccaaatagtggctctgtatactcatccaaagggcaaaataaattctggattcagtaaaagtatgaaaagtccataggcaattatcatttgagaaaaggcatcttcacctatctgtgaagtatatatatgactggataagtcttgttttctattttttctttttttctgatgatggtggaacatattttcttgtggggaagaaaagccacacttgcctatgcactgtcaaagcaatagaataaatttgtggcaagggagcataaatgtaggcacaaagaattacatgtaatggttttacatctttatagttgagtctaaaaacacagttaatttgttaattattttaataaataattagtgactagtcaccatgtgccaggtaccattgttaggtgctaagtatagagtggtaaatagaaatttaagcttttaaatgtcagttcttactattactatctcacttaaataaaaactggaatataatttgtaggttgaatgcttattatccaggatatttgcaggaaagagaccacacatttcaatggtgtgagagaaaaaaacaacccttaaagggagagtgtagtattctgggactatcaacagaactgaagaagcaagggagggagtgattaccagaacctggtgaaggcagctatacagaagggtcacctaatgaaacctgtggaggaatgtagtcaatttgtgctatcctagcaggaagtaagcctgggaataaatatccagaccttgccctcctcctgttttccattctcctgtggaagcctttcattagccagattcaactaacagtcagagagcaagggagcccattgatacaaaccctgaaggacagtttcctagggtacagagaatagaagagaagagaggggttggggtggggaaatggaagacaaccagcacaaatgtcaacttaagagcaaactcaccccttaccattcaggtggttgagcagacatctccaacactgatgacaaatttagtaagccttctttgatcagtctggagaccatttggatatattatcccaatagataagtgctatccccaaaagcagagaagagagagaaatatagtgtaatgtgattgttctgtctcctaaatagaaaacaggaagaggtgcaataaatggattggagtatacgtgtgtgcgagagaaagagaaagaaggacggaactggggagggtgcaaggtggggaggaaagggagggggcactagaaataaagggagagagacaggaagagacagaggggagagaaagagagaaaggaaaaagagagcaagggatagagagagacgcggagggagaaaaaaaaagagagatcttcctgtggagcttacgaaaataattaatacagtttcctttctgtctgatttaacatatttgctaatattaatgtgcttgtccctacagtaattccctccaggctccccatgctgggatgtgttgtgggtttggatttgagcagaagatttaatgccaagtctctctggggaagcatttttgagataaattctttcccttcatgctcttctgctctgcatagaccttgagaaagggtgttagaagaaaagattgggtaaggggttaaaaaggcatgaagaccaggggcagagtagtgtgcatttccaggaaatggagagttctgggaacagttgctcatttcccactccttggctggtttgattatcacacttgaaatacagctactcatcttggcaattctcctacgttaggaaaagcccaggactactttaccacacaatttttacttcatttttaaaccaaacatacacagaaggtaatacaatgtatcttcttctaatttatttgcatttaaatacttcaagatgttgatttctaataaccacttcatgaccaacaagacagtcaagatttcttttatcaggctttctattagaaaaagcattttgcccatttcccaccacccaaataaatgtattcagaaaacaagggatccgtttatttatatttgaatctcagagtctctgaaaagtgaatgaggcacacatttggcaaaccaaacttaagttagattatgtgattcaggaaaatttataaatataatgtacggtgctgacaatggatttctcatattctactttttcctttgaattaactctggtttattacataagtttgtatatagtatgccaaatcaaaggatttaggatttaatactaaaacaaattaacaaccaaccagatgtgtttctcaagccatgtttttcagaagacctgattcaaagccacctgagagtctggttaaaaaggcaaatcctgggccccacacctctccatctacagaatatatggatgatgggatcttggagtattcattttgtcaacttaaatctataaatttggaaaaggaaaggagactttatttcttgtaaagggttatagtctgcaaagtgaccatcctgcagcctgggaagcatgtctttggacaagaccagagacaggcacttcaaaggaggaacggttggtataggagctttatgttgaacaggttggctaaacatacatattcaacaggttatagaaggctacgaatattcacaaaggtggttctgatgcatgtgtataaagcaaacatgcatgtaacatacaacccatgttcactttgaggtggagacttaacatttaaatgtcttacaattagggcctgtatgtcaaaaggcctttttaggacacagaggcatgcaagagtgatctctttaaaccagccagaatcatcagtccatggttggtggtcttcttattaggagaaagttactgacatcagtctcttgtccggtcaaagctgtagttatggttgatggaacaggggatcagttagcatctgtgaactggatgagttgtaattgttttaatattgcttatcttgagaccagtccttatttaactgctagagaagaaaaaaaaaaaaccctgtggcagttagaacatagtttattctttaagtgtaggggtgcatgatttaccccttgcctagcatggtttcaggtcctgtatataatttcatatctcattgccacaaagagtctgttctgtcagtcttatgatctctactttaacattagtgctggtcagttgttgtgtctaaacgccaaaagagaggaggtataatgagttgtgtctaacctcctgtcccattgtggctgggaactcaattttaagatttttctggagtccccttggctacaagagggcccattcagtcagtaggggcttaggattttaagtttacaactttaacaaagtcattactccctacaggttaagacctacaggactagaataagacatttttgcccttatatcagaaggatgataccttctttatagtatttttcccaagatcctatgtgcctatattgttttacgaaatgaagggggaaaatcccacaagagaaaaaaatatctaaatcgagactcatgaggcctgattttaactccagttttgacaattatgacctggagcatgccacttaacctctttgggagtcactcttgtcatctgcaaaaaaaaaaaaaaaaaaaaaaaaaggacttagaacaagatgtctctctacttcacttctaactttgatggtccctggttctaatagtctaaattaatatctttgggtatatccttttgtaaattgttgactcacccagagaacttggatgcacccaatcttcctagataatgtttcctttcttggaaattattaattctgtccagcatttttaacagttgtctctaccttatttcaagtcccagtatttcattcagaattgttattgcagggaagaccctggaaacttatgaggagattactgaagaaataagctattacaatttttgccttgctcttggtttggaggtagcaaattcatgtacaaaggctgcttctgggaaatgtagctaccaagtttctttaattcagcatctggccaaagatgtttcccaaaactgtagtccatgaaatgttctctaagtttttaaatgtaaaataagtataggaaattctgcaaaacatcctctgagagagacttaatatccattagcatattaaaaagttgtgagaaaatatgtagtaaaaataaatacacaaataaatattttaaaaacttttttttacacaggggtttgcttgatattcacttgatcacagattccttatcatgagtaacatcctggagaaccagtgttttatggaatattttggaaaatgtagttttggtaaaatccagaaacctaaacaaattttgccatgaaaatagatgatggggaacttaaacatacataaaatataataatttgccagaaagagaatattcataagagtgagaagggcccagcattcagtaaatgaggctttcattttgattcatggtcaacattagcattatgatgccacaagagaattactctacaagttagaatattattgcagtctatttttctcctgcttcatctacatgaataaataaacaaacagtggcattttgaaaagcatagagaaaagaaattagtcaatacatcaaaatacttggatctaataatcacctactgttttagtctttatgatttacaaaagctgacaaatatatacatttaaacaagtgacctttaaccttgaattagagatatttcttcagcagtatatgacaaagtttcatacctgtatgaagaattttcttttggattgctatcttctttctcaggcagctttcaaaaaatgggtaaatcttgtagttgtgcaatttccactcatttgctgagaatagtttttccatcacttccttgcaatgaaattttaaaaatttaaatctataccaaaaatctcatttaaaattgaaattatgcaatatttatcttaacttgtgcagatttaagattaacttcctatttattagtattaaatcactctaagtttctctgtttaaaaatgataatgtttcatatacttcaatatataaattccaaggaaaaactattgaaaattgtttgcaatgaagatggatgcagaaaatgaaatgtctttgaaatatcactaaatgtcttggggaaaggatgattatatatagatattcttaaatataatatatacttttaaattactagttcctcctccatgctttctctgagagtgtttgtcaagtaagcaagcatgattttttttcttccttcttctcaatccaagctcttaggaagagataaataacggagtaggggtagggaaatagtgatgccacctcagacttaatcaatggctcctgattcatgtcatttattttacacactaggtgaaaacacattggtgatggagcccctacacattctatatcaaactaatcctttatttgagacaaagtatccacagtgatgacattagcattgctagtattccactgtacagcccacagataatgggataccaattgtcttagtgcattttgtgttgctatgacagaataccatagactgggtaattttgaagattcgagatttatttcttacagttctggaggcttgggagtccaaggctgaggagtctgcatctggcgagggtcttcttgctgcatcatcccacggtagaaagcagaagggcaagagggcataaggaagaaggggaaggggactgaattcatccttttatcaggaagccattccagtgagaactaacccactcctatgacaatgacattaatccattcatgagggcacagccctcatgacctaatcatctcttagaggcatcacctctcaacattattgaattggggattaaattttcaacacatgagctttgggggacacattaaaaccacagcactgattaagtttgtcttttgattgaggttggcagtcttagatacactgcatcttgaagaagaactgaataaaggttaactataaagaagttatttgggcatgcacacatttgcttactttgagttcaaattttgttttatataatctgagtgcctgacttagatcctttgctatcatttgcttccagggtcacagcttctccatttccaagggacagacggtgtcattagatattggggtatgagaaggtggctttgctgaattattagttatagatgtcaaggaatatgaacaagaggataagattttctttggaatcctgagatttgctttccaaaggaagtatatacagtgtgttcccaaaatataaaaatttaagacatcatccctgtttgaaaggaaatgttacatatgcccagggtcatgccttgtgaataggaagccctggcactgaaaatttcacttttttcagaggcctttttaaatagatgaatgccaggctacctgttctctccaaaatctaaggtcacagtttgttaataaggttgccatactattcagtatttattttatctgaaatattaccatttcatttcctagaatccgtgcccactctgtaaccagtggcatgcttaacctgatctttatcaaactaatcctatattatcagatgtatttctctagctctcccaacataaaaggaattatccacagtctggaatatgtgttccttttatttcccccaagtttctgactcacgtttgtttatcatgcacatatgcctcatttaagtgcatcctttaatcaaatattctgagcaaatattcccacttaaaacccagcaggcggcttcctgttccatagatctcctgaatgccaacaaagtttataacatgcagggctttccgcagagtgtatgaatttgtgacttggggcaaatatcctaaaccctattaaaaaaaagatttccttggcaaaagaatacacttatctcaaggagaaaactccacgattctacttgtcaaccagctctgcaaataggataattacacacgtgggatttttttttttttctgcctacagttgaaactgggtttgcaaatggctcctgggtaaaaagtattctatagcacctccatctcccagaatgagttcatttaagaggtgccaatgtatagttaacagcactgtagtttggctgaaggaatctttgtgatgctcagtaagagtggattgacatgtgaagctttcatgattgagttattccttcatcatggggcctctctcattcccccacatattgaaaagaatataattattacataaaaatttggagccatgtgctaacaatatgtgccataataaaccatgcatacataaagtctcaaataagcaggtaccctctcagtgtctaacttttcatataaatgccagaataaattatctgcttcagtgatagagcaaagcacttgagggtattaacaaaaagtatccatcagtgacatcatgtaatatgctatatacatcacagaatgacacctttaaaaaatattattgactttagatgggtgatgtggcaggtgcaaagaaggcaaagaaataaagatgacataataaatagatcctaaaggaaagctaagatcaaaaataaactcctgtactttttttagaaaatccatagtgcagctgctctggggtgcctgattgcctatatctttatctgaatgcacagaaaaaggaagctgagctgtcacccaagggagtgcagagctcaaaatactagtatccttgatattctaggtctctcatgacccttgaaactctcctaggccttctcatcatttttggataaagtgcttgcacttgtacatgtctcacaaagatctctgtgtttaggttctttactacatctgtctgaggttgagtttccaagaagcagaccctgtgcaaaagagatttattaagaataagcaatcaggggagacatataagagagtgaggaaatgagacaaagaagtgggaaagccaagcatctatattgtcaatttcaacatcttcattccacatctcaagccacaccttcccactctatgttccagcctcgatgccccatttgccattcctcaaaccttttatttctggtgcttggcacttgcatttctctctaccatccctgcctttccaacagcttactctctactctgacttcaggttaatgtcatttcctctagaaagcctctcttaaactacaaatcccaacctttcctacgtgctcagtctagagtctatcttgtgattagttgcttctctatttctttccatcctagactagttcaagaaggttaggattgagcttatctcattctacattgtatctccaacacgtgacagtaggtaggttgtcaatagacatttatcaagtaaatttaaaaattgataacactaatccttaatctcagaatctgtaccaatgcaaacttgaatattaagaactgaactaagttattattatctgctaattattgtgattcacttaaaattcatgaagtccctccatatgtatcatctcatttgactcctcactgcattttcttgaatagaaaacagccagaattttatcattcttgttatttaggggaagaaaaagttatcctgctgccaaataggacttggacaaacactacctttccttatatataacctaggatggaggggagtataagtcattagaaaatgacaacagggacactcattccccatctgcaatactttattgaatatatttgtaacacagctgctgccctttctattacaggttgaattgaatttatctttgaagccccaggtttttgtgcactttctgtttatctaggagcttaataaatatttaatgttgagtaagtggatttatttacatgtagacatgtatcacgcatttattatgcataggacactgcgctaagtacaaagtagagggtgattcaaaggagaattgttaacttatcagcattctaacctgcaactttactatcccaccttcttctactttaccactatttcagtaccaatatcccatttataaaaagttttcttttccatgcctaataccgaacatggatggatagtgacatctaacttatccaaatagaatccctggcctaaggcactctcctactcagtgtctgcagtgttcagtaaataaaaccaaaggcgcataaatcatacatgttgataatattggatatacctgaattgccagggagttctgactgctaaagtaatttcaggttcacttcatggttatggcccatacttccttccaaccagtgagtctgtggttgggcatcttctgaaattctcctcttgagcttcatcttccagctttacaaaaaaattgagtagttctcaagtacaggattctcccagattatgaggcagtgaaccaaaaatctttacaaaagactaggggggctaactaaggtatccactaatagtgatgacctttatttttctctagagggcccgtggtacaggagaactcagttcactgaggaggaaaaagaagtagctctaggctttataaaagaggaggtacttgaatttggtattgagagcaaataggtgttcaatgaatgaaaaggggaatttcagatagagaactgtccatgtctggaaagaacattgctagtttgggggataataaaagatgagtatctctagaggaagtgaaagggataaatcatagaagataagcctacagaataaagttagttaaggccagaatgtaaagaagattattgaagcatagatttaaccacaggtaacaggaaggcaatcaaggtttttaagcagaagaggagcataattacataagatttctaagaagataactcaagatacctttcaaaggatatacgaaaaaggtaagggaccagggttccaggacaatcatccacaaaagagagatgatgaaggtttgggcttagggagtggcaatgggttagaaaacgggcaagattcacaagataaacttaaggtaaaattgcatcagacaagatgtagcgggtacaatagaaagagtaatgtttgactcaaggttccattttgagcaactgagcagacagtgattttgtttattcatgtcagggacacacgaggatatctaatctacagttgaaaattttaatctggagccaagaacagataccagagctataaatgtaggaatagtagtcatcatataatgacagtattgctaagatcacccagtgagaatgtgtagaataaatatagaagatgaataagaataggatttccatgagcatgaacattgaaagaataagaggaagagaaggactcaacaagggatacagagaaagagtggttagaaaatctggaggagaaccagaaagagatgcagtcattgatattaagggaagagggagttttgcagatgaggaaagcaaccacgacaagtgcagcaggaatgttgagtagaaagaacaagagaggtcattggatttgaccactgggacatttttgaccttagcaaggccaatttccctagagtggtgatacaaaagcccatactgagttggtagagtaaatgagatttgagaaagtggggaaaagtaagtctgtagatttatcgtttaaaagattggtgccaaagagaaagagagggattgaatactagattacagaatttgagggaaaggaggtttttttttttttaaaattaagatgagaagggtacatttgtagaataaaggaaagggagactgaaagtacgagtgagatagaggataattgatggaggagagttctggaaggagcaggaggaatcaatctcataaggaagatgaagagattacctttgcactgaaggaggaataccatttccttactctgataataagttttacaggtggaggggaaggtagtcagataagttcacatccaatgatctgtattttcttggtgaagtagtattctgtcatctgccacagaagggctgctgccacaagcatgggctggtcctgggcacagtcaccatgaagctaaaaaagagcatcaggcccttgatgctttgatacctgccatctttgccgccaggacagaccacaaagattcaaaaagcatttaaaaattttaaacacatcatgaaaacagacttttctaaaaaaaatttatacttctcagttggcttattgagtaggaagatattttatgtatttcaaacatatgtcccagaagatcaagccagaaggtattatgcacaattctcagacaaaagatgaacagaagtaaagggacttagtgtccaagttatccatcagctcacttcttagccagtgctttattcctcactgcacccatgcgtatatttcacaccattttcattgtaggaactcagaaattgttaataataacattgttggtttatattaatgagtccttactatgtgtcaagcatttaagcactttgcatattaactcatttaatccttccaataaccttacagagaaggttattatcatccctatttcacagattacaaaatagaacagaaattgtatttggttgcttatggtcatacagctagtaagagtgcagaaatggcttttgattccaggcagtctagcatgagtctgccctcagtgctattagtgggatagtaaaaaccttaaagatttgtgttgttatacaccaagcctataatcatttcttaattacagccatgctaggggcttgtgaatctggaggcatgcctaaggatgtgtttattatttaactttacatcctcagatttgagcacattaataatcctccataaatatttgatgaataatcaaatgaatgagcaaagatgatttctctccaatcacccaacagctttctgcttgggatgtattggaactagattgtagatcgtggggtggaggtatggtaaagaacagttggtggctaaggaaaacagaagagatacagggactacttcctccatgggctacacattacatgactttgtctctgactaacggcattttgtaaacttttttttacatctttgagtgcaaatttgtgatgtacttaaacatatttcaagaaaatgctatgatataccaaaaacatgccctttcatatgagattttatctagtcctatagtttgcttctaaatagagtttttctccggaccctaggaatgttttcatttaacaatctcaaatcatttgggcatagtgagagaaaactgtaagtctgagacatgaagtctataatttattctcttattactttccaacacacatgaagagcccaagcttgctcagggaataggaaagggaaaagtctgggggctgcttgctgggatgatgttccttcagaactaaggagaatgctctctgaaataatttacttgttcttttcttaagcagaggaagtacttgctgcttatgtacaaattcaagttaactttgtagtaaggtacaaattaattacaaagtatttatgagggacatttatgatgtgcctaacgtatagcaactttgagaacttacagaagcagtgacaggcaacttttgtcctttagcaatgcatcatcttcctcagcaaatgaaataacagacataaaacaagtctgagcaacagaagccaactcctctctatataattgtacagctatatatggaattatgtcatggagattagaagttctgaataaggggaattgataatggccgaagtgtaaggaagaggtggaaaatgacgtgaagacttggagtatgggtggggtatgcaaaggcaatgtgttcctcatgatgtgcccaacaacatgttaagtgtgtcatatgcatgctctcatttgttctctacaaaattgataagtactactgttaacgatatcctttttccaaatccagaagctaatgttcagaatccttagagctggcaagctgtgagagacagagaagctggtcaaatctaggcagtctggtgctgaggcccacatactcagcaactgtactacaccttatggtggcctaggcaggctaatcgtgtctgcgtttgcaaatatacaggtcatatgactggagatgaatgttttgagaggtatgcatcaacccaagccaataccccaaaagactcttagtaggattcttcccctttgacctggcagaccttctacctccattgcctgagggtaggagaatgaggccatttctcatcagagggcttgcttttctatagtactgctctattgtgtctggtacaacacacaaaattagagactctttaaagcctcaacaaaccttgtctctagcatgaaaagatcatgggtaaaaaccctattctgtttcattagcaactctcatgtcctcaaattataaccctctcaaggtcccaaggtgatgtcactgtctattatcatgagcacacaggcaatgatggtgtctagtgggagaatgacctcctcaatttcaagtgtgaactcaactatgatgaatgagaggaggccgtgtggcttcttcaatcttggagggacaaccgtattcggcttattatcagagattgtctcacattgagatggaggtagaaatatgtaatatcaaaatccggacatagaacagtttctccatcacctcaagactgtctaacaatacaaaatgtggtggccttcaaatcagagaaaggatatgcaataaagagcaattatgcagattcagccttcaattgctgattatactttggctagtgatatatactcactatgaaatagagccatatcttccccctcctctgcacatgaagagatacatcaatcccttgcaaagaacctctgctctcctttccctttctctttttctcatgcacaatttgttgcctcctctgccatgttcccttaaacactattgttattatcacatgacattgtaattagtctaatccatgtctttctgccttgatagatgatggcttttttttaatgcaaagattcagtacattttggtattcccaggagcttacaaggcatcagtgtctgtgtctttcccatatccccggtcccttaccacatcaacctgacttctacatggtagcagctgcatttcttcgttgagggcattctctgatccaagccattttgcccacccttgtggcagaccagaattaaaggtgaattagtgtctcctgagagtactctcatccaatgactggtggaaatcaatttaacatacaccagctccttctccccttgggcagaatagctctgaggagtccttctatactggcttccagagttgctcatgggacaaggcttcatttgccatcagaaaataatggacttattaacacaccttttattgtttgcctaacctgtcttacttcccgacgtctcatccagcatattacttacatccctaacaaatgactttcacctaaatccttgactcgaggagaacacaaactacgtaagcacccaatatacagaaggacttcaataaatgtccttttaataaaattgaattacaaagatgcatagtgtagcatgagataaaacgtggaagtgctatgctacgtaagtgctgggagcctatcagtcaaatttgagcacttgtaaacacaacaagcaccatgatttcaggatttccctttgcagtgggaaggcggctgtcctagttgttagtagagaagagtacattatcggaagctctggcttctatttttagacctcttgctgacatagaaaacctgtttcctaacagtactgtagtgaccttcccaccctcagagaaatggtgcagaatgcctaaggaagaaacaagtccccatttgtggaagccacagaggaacagaggagggaaatgagagcttaggtactattcgttggcagacatggtgctttaagatctcttttgacagctaaatagaaagtgctgggttgcctggcagtgcagtggccttgaacaggatttaggtctccaagctgctaaagcttggctctgagcccaagatgtccaaagagcaataatctctttcttttttaaaaacctcacatgaaaaaataattttccaaaataaggtaaaatcatgactcttacacagttatataattaatacatgttaaagattttatttaactcattagtcaatgagggaaccaggcagatggtataatcagttcaaaaaaaacctcaaagaacagacacatctatagataaaaatattgaaataaatgtgcaaatggaggcaaaattagcctcttccacagtgggggaaggaagtcacttgaacctctacaggacagaatttccatacctataagcaagggatattttgtattactattagttatataatttgcagagttttaaaatagctcccatagaatcagagtctgataacactgaaaggtatgctgtatggacaatgtatagttttttactgaagcataatttttccctacactcacgatcgtttgatttaataatgcaatatttctccaataagggggaattagactttttactagagcttacttatacttttaaaatccagctcattttcttaacactgtgtatagggatgagagtaatcaaatgcagggcagagatactatgcttgagaaaagtacatctgattgttaagaaaaagatctcaaggtttaggaggaagatccttccttgataggggaaggaaagagatggtaacagaaaagaagtagctgatatttcacatttacattatctcattcagttctcccaatgaacttgagagttaggtgaagatatttctccttttataagatgaggaaatgggagcccagagtaattaagtagcctacatagggtcatacaaatagtatatagtagagccaggatttaaacccagtctttttagccctgaagtttatgattttcttccattatgccatactgtactggtaaaggatgatgttaggatggagggcaacggttaagactttcctgatccccacctcaaacagggcagttcagcagtggtatcgaagaagcatgtagcagtgtttctcattggtgattgtcatatttttgtcataattttctcattctgttgagtgctctggagagataaacagaattggcttctgatctcataggtttagcttaaacatttgatttaaatgaattactttttgaatgaattactttttgaagctgaagaaatgaaggccgattaactgggttaaaatgccttaaaagttgttctgaatcagatttcctgggatgccactaaaagttccttacataaaaatggcttatattcttattaatagcatttattgaacatttactgaatgcctactatgtgctcagtactatattaagtgccaagggaacactacagtgaatcgggtaaaatccatgccctgtccagagcaaactagaaaagattagacacatataaaagtcgaccataatacaataagataagggttatagggttataggaatgctaggaaagatgatattcatatagggagaatcatgcaaaatttcatcaattaggtatcatttggctttggaggataagtttttaacttggaaacaaatgtgtatatgtgtgtgtatcctatcagccaattccattatcataactccaaacatagtatagtttcttcttaaaaattattaatgcaaaaaattctatttccaatttgtcagggcctaacaagttggtgaacttgttattcatagtagaggattcaattaacatgagagaaagtcatctttaattctatttttgttacttcctaaaaggaaaggatatgtcatttaggttcatgaaaaattctcaggtctttatatttcaaaactaattccaaatggcattcaaaatcattttcttctaaggctaaatggctctttatttattattcaccccaatcccaaatagcaagaatcccatgttttccagcaattctttgatgacattttattatagcataaatagaaatatatgtaaattattcttacaaattgttctcaacctgaaggttccatttagcctctgagatctttaaaataggaaatgaagcttgttaccacaagcaaagtgttctgaatctcccaaaacataaactgttcactttaaggtcactatgatcccgcaatgaacaaaaaagcagcagttcacttgtattagaaaaggcttagtaaaaatgccctctctgtgatgcttggttgggcagacacgttttgtttcatctgacatttcttgcagagtgactcaagagctattcagcaaattgtttctgacttgtccttaatgcctgattttcttttatttagcaccacaatttaccatctacttgtaggtcataagtagtagaagaccaagtatatactagacacataatgggtactcaataaatatttgttgatttaataagcgactgaggatttgtaacatgaaaatacacagaattcagcaaatgtctgcaaattcagttttctgattaacaaactcaacaaacgagtataagttctattatactgccatgtcttcacctaaagtatttctttttttttttttttttttttttttttttttgagacggagtctcgctctgtcgcccaggctggagtgcagtggcgcgatctcggctcactgtaagctccgcctcctgggttcacgccattctcctgcctcagcctcccgagtagctgggactacaggcgcccaccaccacgcccggctaattttttgtatttttagtagagatggggtttcaccatgttagccagggtggtcttgatctcctgacctcgtgatccgcccgcctcggcctcccaaagtgctgggattacaggcataagccactgtgcccggcccacctaaagtatttctaaatattttttaaaatccacactctttgctgaaacatgtgagactttttcataagaaagccatatgaccaagaaatattttaatatgatactagcatttgtttggtgaagcagaagagtaaactgaagctcatttcattattacataaaatgtgatctttgttaaataaacttcctactcatcctgcaattttaccttctttttataatttagtggttatcaactggggagattttgtctcacagaggacatttggcaatgtttagacacatttctgattgtcacaacagggggtgtgggagaagtggtgctactggcatctagtgggtagaggagggggatgctgctacacaccctgcaacgcacagaacaactcctaacaaaagagaatgatttagtccaaaatgccaatagtcccaaggtagagaaagcctattttaaaaaaagaagctggctgcaataatctcaaattcatgatggctacatgggttttccagacatgaagaatgtttatgcataattcccagaaacaagaaaggtataaaaggtggttgggtcctgccaagaagtcctgtaaagctaagaagaaaaaacaaaacaaaacaaagtttacagagaaaagagaatggaaataggataagatgggcattatttcagtaaagattggcatagaggatattggaagatctaagttgtagtctccaagatttcagtttatattaaaatgggtttgacaatgtatttcctacacaggcatatttttacaatccaatgaacgcacaataatgatagtaatactactaccattactataaataacagtaactacgatctattaaggaaccattacatgccttccatacattattactaattatcacaattatcatcaaagtaagcatcattatttctattctgcagaattaacaggctcagagaatttttggcagctgtttaaagttgacaggtggtaataatcagagttagtgttaaagataaaacagactagtagccaccatacttcaaatatatctttaagtagtatgacccaaattccaggttttctcaggactgccctggtttctgcctgattttcctgtataattattaatagcactcactttctcttaaaagtgatcactctttatgagatgatggattctctcttttctctttaaactggagaaatccacatcaggcaaatatagaaacttgctggcattctcaaagccctttgacatgtatctgagccatgtgtttatttgtccatttacttatccttgtgtgggagcagttgacaactggtggccatttgtgggaaggactcacagaagatgctatttggttcttgatatttaagctaccttaggtgttaattaattgctttgtctagaatttttttttttttttctgagacagagtctcactctgttgtccaggttggagtgcagtggcatgatctcagctcactgcaaactccacctcccaagctcaagtgattctcctgcctcagcttcccaagtagctgggattacaggtgcccaccaccatgccaggctaatttttgtatttttagtagagacggggtttcgccatgttgaccaggctggtctcgaactcctgacttcaggtgatctgcccacctctgcctctcaaagtgctgggattacaggcgtgagccaccacaacccatctgtatggcaattttctaatttctatcaacatggcttgtccaaagcaaatggtttttgatgagtccaaagctgtctcatcaggctgtgggaatctgtaaacatccagcatgtttacttctctgaatgttttaccctttgcacaaacctggaatgtcagcaaacaagctgaatgcagtaagactggtaaaaccatttgcgtatgagttgagcagaagaatcgatacataatttacggtgaattttcaaggagattaaaacagcacagtggcagtgggttagattgtggggccatttcttttttttttttttttttttttttttttttgagatggagtcttgctctgtcaccaggctggagtgcagtggctgcaacctccaccccactgggttcaagcgattctcctgcctcagcctcccgagtagctgggactacaggcgcccgccaccacgcctggctaatgtttgtatttttttagtagagacggagttttgccatgttgaccaggctggtctcaaactcctgtcctcaggtgatccacccaccttggcctcccaaagtgctgggattatagacatgagccaccgcacccagctttttttgtttgtttgtttttgtttgagatggagtttcactcttgttgcccaggctggattgcaatggcacgatctcgactcacagcaacctccgcctcgattgtggggccatttctaattacaatcatgacatttaaaaaatttctctattctttcagattaaatgacttaaattctctctcataaagggagtgccatgaagaaaagtcattccctctcccttgtgatcctcctatcctccaaggctctctctttcatgggcatcaaagcaccatgcaacgcaggaagccataataagaaacagtgcttactcatgttcagatatcaaggctctgacccttaactctacatcttcctgcttcttctgtgtgctttattttccccctttgtctattgagctaatggcaagaatctttatgctagacaaaatctttttattctaaaggaaatttaatttctgtatatgtcaagcccatatatttcatattctattcccatccaagggccacacattaaaacaattgtggtacttgaagacacattaagttatttatgtgaaattgcaaagtgaaaatgccacttttttctatttgtgacaagagagaaaaataatatcatttccatcttggaactcaaagatttccctctgttctcaagtaggcttttaccttaaaaggacgctgggaaataactaaggagaactaacaaatagtgactaattgtcttggtgttacacaggataccctattatttcccaatgtttatttttaaatagaatccatcacaatgcttttcaaaaaataatatttggccaggtgtggtggttcatgcctataatcccagcacttcaggaggctgaggtgggaggactgcttgagcccaggagttcaagaccagcctgggcaacacggtgagacccccgtctctacaaacaatacaaatttaaaaattagctgggcgtggtggtgcatacctgtggtcctagctacttgggagcctgaggtaaaagagcaaggctgcagtgagctgtgatagtgccactgcactctagcctgggggacagagagagaccctgtctcaaaaaaaaaaaaaaaaaaaaaaaaagaataatagtaacatttattgtgaacttagaaatctgtggtaaatacaaacatatatatatatacatacacacacataacattaacaagtgttttaaaatatagtcattatgaataatagaaaacatttttgttatctaggttttgaatatgcaaaatacagaagtctcatgtatgtttatgagcgatgtaagtcattataataactgagtcgtatatattaagtatttgttgtccatattatctggcttagccctgtttcacttccatactacctcctaacgcttgtgataaatagtgttctgattcaggcttgatggtttttcacctgagcccactccagtgcatctggctccgaggccatcatttcccatccattctttctgctatgactttgttcatgctacagagcacaatatcaaactcattgtagatagtcctacaggcagtccctatgctcttccatgtccatggtcagtcctcatttcatctatggaaagaccatggaatttataataattcctgttgttctctagcctcctagtctgattaggagcagggccaggcaaagttggcttacagaccgaatctggcctaccacctgttttgtaaataaagttttactggaacacagccacactcatttatttacatattgtctacagctattttcactacaaaagcagaattgagtagttatgacagaggccttgtggcccacaaaggctaaactatttaatatctggccccttaaaaaaatgatgttgactagggcactgagtttttaagacagctcagccaggaattaataactttgtcaaatccagttacaaatagagcttttcaatcacatccataagttatatctgcagactagagaatcataaatttagtcttaaacttatagataactgggaaaagttaagctgactttactgattttcctcttctattgcctctctatcctaggtacctactctgcagcccaaatagaacatttcttccttggcaggagcacagagttttataatagccctttgattgcctttagtcctttgaatagttctattgttatcatctaacatatatattgttcaataagaatgttttaattgaattaataaatgaaaaaatgtggatcagcattttcaaagctatgttttgcagaatgcttgctatctttgaaatgtgttccacgaaaaggatggtctatctaaaaaacaaaaaaatctatagtcaaataagtttgggaaataatgacacacactatttattttcaggaacaccatagttcacataggtgtattaaagttttggagaaagggagggtgacatcaacaaaacggcacagtagacagctcaagctctcaaaaagagtagaaactgtcagaaccaattttgtcagaactctggaaaacagtcaaaagtttacagcaaccaaatgtccacaaaatcaagaaaaaggtaacttcgaaatggtaggaaagttttgtggtattcccacttgcccttgtcccattccctccctagtatggcagtagttttggtttaaaattggtagcagcctacactcctagtatggggccctggtcccttgatctggaaggagtagaccaaaccttattcacaaattattttgtgtgtctgttctaacctttctataggctaccagaaggacaaatgcaaggagtttatatttgttttctagggctaccataacaaaataccacagactgagtggtttaaacaacagaaatgtactttctcacagttctgaaggccagaagtccaaaatccagatgttgacaggtttgctttcttttgagacttctctccctggcttgtagatatctgccttctcactgcattttcacatggtcgttcctctgtgtaaacacatccctggtgtctcttttctccttttctcataaggacaccagtcatatcagattaggggccaaccctcacttaaacttaactaaccctttatagaccttatctccaaatatggttacattttgaggtactgagggttaaggcatatgaatgtgggggggacacaattcagcctatgacaatgctcatctctgtttttacctaactcaggatggaaaggcagtgagtattaattaaaaaaatactgcaagtcaaactaaaaatcttaaagggcaaaatattacaattgaaatatacaatagaccatctaaaagcttggaagtgaaacttagagtttcttagggaaattaggacattcaaaatcgaccatgcatatggcaaatttagaaagccactgcattttcagggaaatatgtgtgctcagaaaagacccgagcaaacccttagctttcaccttgggctgatccctagattcagttcaagcccagctagttgttgaagggctctggcatagagccaatctgcaaagactgggagagttatgttttgtttgcttggttggttggttggttgattggttgctttgtattttggccccagatactcaagaaaatctctcataaaattctagttgaacacaggctgagaaacaaagactatagtgaccacacatgagaaggaatattacagtcttcgcagaaatagttttggaaagtcactaagcaaatggcctactatacccttcaacagtcaaaacattcagcaaattctagagaaggtagataattttcagttactacagtatgataaatatacagttttcaacaaaaatcacaatgcataaaaagtaacaagaaagtattggccaattcaaaggaacaaaataaattgatagaaattatccctgaggaagttcagacactgggcttactaaacaaggactttaaaacaactgtcttaaatatgctcaaagatctaaaggaaaacaaagacaaagaatgaaaggaaatcaggaatattatgtaggaataaaatgagaatatcaataaagaaatataaattgtaaaaaaaattctgtatctgaaaggtaaaacagaaattgaaaattcactagggtagtttaacagtaggtttgagcaggcagaagaaagaatcagttaatgaagataggaaaactgaaattgtcaattctgaggagcagaaagaaaaaagaataagtgaaagtaaacagagcctaggataccaatgggaacccatcaaatagaccaatatacacattctagaagttccagaagaataaagagtggaaagaatatatgaataaaaaaattttgagaaataacagttcccacattttatgaaatatgtaaatctacaaatccaagaagcacaataagttccaagtagggtaaacccaaagagatccacactgagacatattataatcaaactgtcgaaagccaaaaacaatgaggacactgtaataacagcaagagaaaaacaactcattacatacatgggatccctagtaagactatcaactggtttctcagtggaaaccataagggccagaagacaatgggatgatatatttaaagtgctgagagaaaaaaaaaaactgtaactgaaagtttatatccagcaaaactgtcctcaacaaatgagggagaaattaagacattactagaccagcaaaagctgagggagttcattaccacttggcctacgagaaatgataaagggagtccttcaagctgaaataaaaggatgctaaacagtaagtagaagtcttatgaataaataaagatctccagtaaaggtaaatgtatgggcaaatgtaaaaacactattattgtatttggagtttataactgcacttttatgtcctacaggacttggaaagacaaatgcataaaaaattattagttgattttattgtgcattcaataaaaagatataatctgcaacaacaaaaacataaaggagagagaatggtgttgtataagagtggagctatcgtatgttattgaagttaagttggtatcagagagaatggtgttgtataagagtggagctatcatatgttattgaagttaagttggtatcatttctgactaggttgttataaatctaggttgttaaatgtaattcccatggtaatcacaaagaaaatatgtgaaaagttaacacaaaaggaaatgaaaagaaaatccaaatggttcactacaaaaaaaatcaactaaacataaaagaggtcataatagaggaaatgaaagaaaatccaaatggttcactacaaaaaaaatcaactaaacataaaagaggtcataatagaggaaatgtaggacataaaaagctatgagatattcaaaaaacaaaatgatagaagtaagtccttgcttatcagtaattactttaaatgtaaatggattaaacaccctaatcaaaagacatatactggcagaatggataaaacaaaccatgattcaactatatgctatctacaagagactcactttagtttcaaagtcacaagtaggctaacagcagaagaattgaaaaagatattccatgaaatagtaaccaaaagaaagctgaggtggtatactaatgttagacaaaatagattttaagtcaaaaattgttaaaagagacaaagaatgacattatatatggagagagatctctaaagatgttctatttattattaaaaatggtatgttgaagtctccaactattactgtagaaatgtttatttctctcatcattttggtcaatatctgctttatatattttggagctctgtttggtgcatatgtgtttagaattattatatcttaatgagttgaccattttatcaatatataatataattgttttcaggccactaaacaagcctcagtaagttttaaagtattaaaataataaaatgtatcttttcccactatagtggaatgaagctaaaatcaataacagaagaaaaactggaaaattcagaaatatttggaaataataccgtcttaataaatcaaagaagaaatcacaagggacataagaggtgaatgaaaacaaaaacacaacgtaccaaaacttatgggatacagtgaaggcagtgcttagaggaaaatgtataatataaatgcctacacttaaaagaagaacaatctcaaatcaacataaatttacaccttgaagaactagaataagaagagcaaactaaacccaaagttatcagagaaagtaaataataaagattagaggggaggaagacagagaatagaaaaagagttgcagaataaacgaaaccagaagtttgttctttcaaatatcagccaaattgataaacatttacctagactgacgaagaaaaaaagaggactcaaccaaaatcagaaatgaaaatggagtcattgctattgaccttacagaaataaaaagaactttaagagaagattacgaataatttagataacctagatgaaatgaacaaataagtaaaaacacacaatttacctacactgattgaagatgaaattaaaaatctcaacaaacatataacaagtaaagagattgaatcagcaatcagaaacctcacaacaaagaaaagttcaagaccagatggcttcactggtgaattctagcacacattttaaagaaaaattaacatgaatcttcaaactcttctaagaagtaggcaaggaggaaacacttgttaactcattctatgagtccagcattactctaataccaaagtcagataaaatcgccacaagaaaagaaaatcacagaccaatatccctttgtagtgagtgcttgtaattgtatgttgtcttggcatccattttatatgtaagtttaactctctcatgccagaaacagggctcagtcacccttgacatagtctcatattcttcttcccacctgaatggtagccagaggtaaaacttagaggcatctctcctgcctagcagggaggactccctgctttcctgctacgtcctttaaagagaccattcagacatttgcctgcaaacttaaagtgatcacctctcagttacaaaatgaccacttgaaacgattgcctgctcactttaaaaccaccaattaaagccccccagtgggaagcctgtttagataacaccctagactgaataaaagcattggcccatgggtcccttctctctctctctgcctgtgcaccctgacctctacatgtgtgcagtctctgggcatgctgtgtaccctccagggtacataagtagtaaaaactcttaaactttcacgttgtggttgcgtcattaaagctgttcttgcaatctgacccctgacagtgaggcagccccaaagcgtacagatgtggattgcctctgctggtgctcttttgtccaagtctcttagctgctgggggacagtagttaacagctaggttgatagagtttcattcaaaacacccttatgaagatgtatttaaaaatccttgacaaaatattagcaaaccatatccaacagcacagtaaaaggattacacatcatgaccaattgagatttattccagaaatgcaaagatggttcaatataaggaaacaaattaaagtaatataccacattaatagaatgaaggagaaaaacacacgatcacctcaactgatgcagaaaaggcatttggcaaaattccaacatcctttaatgatttttaaaaacactcagaaaactagaaatagaagaacacttcctcaatatgataaagggaatttattaaaactcacaattaacaacatgatccaactataggccatctacaacaggcatactgaagggtgaaagattgaaagcttttccttctaagaagatcagaaataagacaatacctgccttcaccactgctatttggcattgtattggaagttttatccagagcaattagacaagaaaaataaatgaaaggcatccaaacttgaaaggaggaagtatatctttactcacaaatgacacagtcctacgtatagaaaaccccaaagaatccaaaagaaaattactagagctaataaattcagtgaagttgtagcatacaaaatgaacacacaaaaatcagttgtttctgtacacctgcaataaacaatttgacaagaaagttagaaaaaaagcacctccatttataatagtatgtaaaagaataaaatacctaaaaataagttaaccaaacatgtgaaagttttgtacactgaaaactacaaaacattgctgaaaaaatcaaagaagacctaaataaatggaaaaacatcccttattaagtcatgagtaggaagacaatatatttaaggtgtcaatactacccaaagttatctacagattcaatgcaatccctatcaaaattccaacagccttttttggcagaagtggaaaactcaatcctcaacttcatattaaattgcaaggggccctgaatagtcaaaataaccttgaaaatgaagaacaaagcggaaggactcacaattcctaacttcaaaacttaatacaaaaccacattatcaaaacagtgtcatactggcataaggataaatatgttgaccaatagaataaaattgatagttcagaaataaacccacacacctatggccagttgattttgacagggttggcaagtccatttaatgaggaaaaaccagtctcctcaagaaatagtgctgggactcagccgggcatggtggctcatgcctgtaatcccagcactttgggaggccgagttgggcagattacctgaagtcaggagttcgagaccaacctgaccaacatggtgaaaccccatctttactaaaaatacaaaaattagccgggcgtggtggcacatgcctgtaatcccagctactcggggggctgagggaagataattgcttgtgcctgggaggcggaggttgcagtgagccgagattgtgccactgcactccagcctggccaacagagcaagactctgtctcaaaaaaaaaaaaaaaaagaaaagaaaaaaaagaaatagtgctggcacaactgaatttccacatgcaaaacaatgaagttggacctctctcataccatatacaaaaattatctcaaaatgaatcaattacctaaatgtaagcgttaaaaccaaaaagctgctttttaaaatataggggtaaacgttcattaccttggatttggcaattgatccttggatatgaaaccaaagcataagaaacaaaagaaaaaataggtaaattaaactttatcaaaactaaaggccaagtgtggtggctcatgcctgtaatcccagcactttgggaggctgaggcaggcagatcccttgaggtcaggagtttcagaccagcctggccaacatggtaaaaccctgcccctactaaaaatacaaaaattagccaggcatgatggtgggtgcctgtaatcccagctactcaggaggctgaggtaggagaatcacttgaacctgggaggcagaggttgcagtgagccaagactgtgccactgcactccagcttgggtgaaagagtaagaccccatctcaaaaaagaaaaaaacaaacaaacaaaaaaagccacaaccctaaaaacttttatgcatcaaaggacattatgaagaaagtgaaaaaacaataaagaaaatatttgtaaatcatgtctgaggagggtttaatatccagaacatgtaaagaactacaattcaataaaatgacaaaatacccaattcaaaaatgggtaaagggcttgaagagatatttatccaaagaaaatatacaaatagccagtaagtacatgaaaagatgctcaatgtcattactcattaggggaatgtaaatcaaaaccacaatgatataccatttcacacctcctaagatggcaataattttaaaaatggaaaataagtgttgacacagatgtggagaaattggaactctcacacattgcttgtgacaaaatggtgcagatgctatggtaaacagtttggcagttcttcaaaatgctaaacgtgaaattatcttatgacccagcaattccacttcttagtatatatccaaaagaattaaaagcagggactcaaacctacttgtgtgtaaatattcattgcagcattattcataatagtcaaaaagatgagaacaatctgaagtgttcattaacagatgaataatgttttatacatacatacaatggaatatttttccaccatgaaaaggaaagaaattctgatacatgctacaacatggatgaaccttgaaaatattatgctataaaagaaatcagtcacaaaggacaaatattatacggttccacttacattaaatatcctaaatagagaaattcatagggacataaagtagattagaggttaccagaagtggcagggaggggaaaggaaaagttatctcttaatggttacagagttgttatttggtgtgattgaaaagttttggaaacagactggtaatggttgcacaatattgtgaatgcagttaatgccactgaatatagtttaaatatatatttatataaaacaaataacatgtgttataatacataatacacacacatatgtatataaaacaccacgatttaaaaacaataaaatgctttgggaaaatctacattaaagaaactacataactattcaacagtgctttccaaacttgtttgaccttggaagttttaaaaatggactacagttaacatttccaaggacatttatgaaagatagaaacaaagtacaagtgatcataattttgaaagggagaaagatggtctgcagtaacaagtcccccttgttaaagtgcagactgcttcagcagggctcagatggggcctgagatttggcatttccaacaaactcctaggtgatgctgatgctgctggtcctcagcccacagtttgagtagcaggggatataatagtactatatatgaagaatagcactattcttcatgatcctgttccctaccatagccaatttgatcaactgatctgaaagcaaagatgttaatggataataatcaataatttattatgtctccaatgtagcatagttataattttacatgggtttctaagacaaataccttattccaaagaagatactctgagaaagtgatatatagcaacaaagaagatcaatatgggatggggattgtcatacttggtgctgggggcagatgaggtggaattattttttcaaatacatttaaagtatgccagatctatatcttacttccatttatatttggattgcatacttgaattatggccaggccactctttctcataagaataagagaaaaaggaaaaatgagagcaagagagaaagggaaggggggagcaggaagaagagggaagaagggaaataggagacaaggaaggaacgaaggataggaatgatagtgccatgaaaaactagatgtttacataattcttttcaacagtcagattctcattcaactcatttttgaatatcatcactttgctgataaatcaattagatggggttaactagtgtaaaatatttccttctgtagtttacagagcacattcattcactggtgatcacatctaagaacatgtccctgtcaatcagaacacctgagcagactattgtgctaaatgcagatgaaaggttgtgctgacacatgctaggataactcctaaaagtggggaaaaaaacagttatctacaattcaacccaaagaacttgcaggtcaacttccatatttaggtagcttatatcactaggataattgtattggcctcaggcattttacccctgcagttaagaaaaatatccttaaagttaggcaatttctgcctcttataaactctgcgaccttgagaaaattaatgatctttatgcctcaatttttcttatctgagaaatggaggtgatgataattattgaagaatgaaataatacattcactggcacacagcaaggttcaaatatatgtcagttcttagtatatgcgtgtgctaatccctcatcaaaaaactttttttctttctaaggttttatatagaaatgcaaatgaaccttgaaccaaaaaaaagtgcccaaaattgaaaaagtcagatgtaaaggattaagaaaggtacaaaccaatgtaaaataccatggttagcaggccaggagggcaacaggatattatgaaatgagggaagtgcaacaaaaaggttgaaagtttaggtttttggaatcagaatgatgagacactgactctcagcttttctaattactgtgatgggacttcaagcaatttaacctctctaacaccatgttttctcatctgtaaacatttactagagcaataaacagattcgtcttttgtgaggattacactagataatttttacatgcacttagcacagtgcagcaatatatggtaacttaaaaattattttgacttccagcaacatactcataatgccacttatcaggaaagataaaaacgaatatataatggtatgacccagctttctaaatgcttccaagccagttgggtaggctagagaagcagaaaatgtacaagacaaccaatgtttaaattttcaaatttatgcttttaaatgacatttctctttttcctgtttatttttcccatcattcatttttctatctatcttgcatataagaattcaggaaagttttccaccttgaactggatgatctcgaaggaaatatttcattgtggagagaaagggaaaaagcaaacatatataatttcttgtgacttgcctctgccttgtctaatttatttctcattagcagaaaaatctttgttacaaaatagaattctatagccaagaaagagaaagtatctattttgctttgttttgagtaatcaaaaaagaaaaacaaaatccagcagagtagaaagtgaccatggagaagaattcatcatggcagatgctgacataagaggggccgggacaaattaaaaatagttggagcatttcaaagatgtctactgaaaattgttttggtaatatggtggtgcctgttattctgtgcctacaaatatattttttaaaatcacaatcacatttcaaaaggtagacttaaggagggctacaaggggccctctcaaatgaatgagttaaagaggtgaaagaagagaaaaacacattgatagtcctggtttgcatctatcaaaattcattagtaataagtatccaaactattttaaatataaatcctgttatacaaaagtgtgcataagaacacacttgtactttcattaggaaaagagagttctgaggggtataaggtgtttttcaagggtcacagaactcagtacatttcttttcacatccccactgcagaagattacacagatatgagcaaacacatgaaaaacaatcacaattactgtttcattaaaaatagaaaaattagttatgtttcaaagaataacaacacatctcttttaccacaactccttgctccttcttttaccaaaagattttgcctggggagttaaattagccattgtgccccaaatttcctcatttctagaaccccacacggacttctgaagaggtttaaaaatgcagtgtttaagtgctgccataacttgtgttttcactgccttcgagggaggcctcaagccaaattcctcttctttcagatcctacagatttgttgggtactgagccaactagggtgtttcttgcactgggctgctgatcctttgttgcatgaagacatacacatttctacaggagaaggcagcaagtaaatagatagttcatggcaatattagctcagaaagcattaggagaaaattccacaaaggcaataaatatcttccccagcaaaatgtgaagcagagaatcatcagacagtgatttacctactgacaaaaggtaagagaaaaagagaactgcagtcaggctagtcactggatctctggagataacaatggactcttattgtgtccaaagcacatctaggatgcaataatccttgctttacaccatatttactaaggtaacaatatggacgtaaattgacattactgtatgtgtttatgtcttaagttaattttgtttgttatatttctgtacatcatttctcattggtggtcagaggatataaagaaggagtggggtaaattcagaggtgtcaagaaaatcaaagtaacctgctgatttaaagaatgtcatacaaaaggaggtgggtgtttctgactcatccataactcaaaatgcagctccattttgacctcatgaccaggctatttcatcactacgagggaaccgctgttgatgtctacaatgttgatgatcctaaggtcaaaaataaaaaagccaccacccaaaaggctattttaatagaaacttatgacagtgaatccagttcaatagttttcagcttatattttccaaatccaaaactcttcagggtaagttgccattgcttaacagccattatccaaaatacaagtgggaatgttatcattatgcacctcagggtaaaactttttttttggcaatctcaccatcattttaattgtattcaaatctctagccaattgcacagatgttaatggagctgtatttttgcttcaatgtctattgcaatattctcattgcattctgcaggtcctccagtaaacgttacttgcaatatttttatcaacagttttggatcagtcacagaaacgaccatggtaagtgctgcaatgccactggcaagagaaagacacaactcaattatgctgtgaacacaaactgtcaaattttctattgttcaacttgcagggcctcctgtaaatgttacctgcaacatatttatcaacagctttgggtcaatagcagaaactacaatggtgagtgggactgagcattgaagccatcgtgtgaaggaatgggatgtgggattgaagtgcactgtggcatatttgtgagacatttactgagtgccaatttccaactttgctcgcctctgaaaagcaataatttatactactttattttgtaaagtcatttgtcaagtgttcattacttaatattcagtgatcttatatctatcgtgccagagaaatttttaaaacatttgatgttttaatggttttctgtagaattatccacaataaacatgatgcatagttatggatatttaaataggtgcatctccaatgcttcagaagtacaaatttcaaagtttgagagatgtaacagtatagccagttttttacatgtaatggaatttttaagatagttgagcctcccttcgatgccacattcaagatatattccaaagggctgaaattagaaaaatacacacacacacacaattttgttgacaagagaaagtagtcccaagtccataacaattataccatatgaatgccttttccaaaaaaaaaaacccctaaacttaaagctaattagaagctcattatacagtatgagtaaacatgtttcatatatctgaaaaagatttcagatactataaaatctaccagtgcattttttttttttttttgagatggagtctctctctgtcacccgggctggagtgcagtggcacgatctcggcttactgcaacctctggctcccaggttcaagcgattcttccacctcagcctcctgagtagctgggattacaggtgcacgccaccatgcccagctaacttttgtatttttgtagagacagggtttcactatcttggccaggctggtcttgaactcttgacctcaggtgatccacctgcctcggcctaccaaagtgctgggattacaggcgtgagccaccacaggatctcactcttctgcccaggttggagtgcagatcatggcacactgaaacttcaaactcctgggctcaaacgatattcctgcctcagcctcccaagtagctaggactacaggtgcacaccaccacatctggttaattaaaaaaaaattgtggagacaggatctcactatattgcccaggctggtctcaaattcctggcctcgagcaatcctcctgcctcagcctcccaaagcaccagcattaaaggcattaactactacacccaggcttctaccaacactcttcataaatgtcatggtcatgttacctgtgacatagcctattggatcattagtcttacccccacagggttctcggctacagcatggaggttgcattttgggtgagatattttcttggtccccatattatttactttaagtcctaaatcaattggctgggtctaatttgcattactatgtaaagtttacaaccattcatttgataaaaccaaaatcaagtgtaattgagtttgactaagtattatggtgcctgatgtcctaaaaataataagcataatgccattgagaagtaaaaaaaaaaaaaaaaggtttccttgtttatatgaattttctctttttggcaactaacatcatgtttaataaattactgttctttgtggtgtccttcatgttaggaagaattaatttacctttaccactttttttccactggcaaaattagacataattcaactccattacccattttgatattattctgaaacattattacccagaaatgagacttgtgaggctttgacaggatgtggtgcatttaaaaatttacctaaataggatagttttgatagggctattaaatgactcataataaaagctaaacacagaaagagtatatcaactcccaggttgacattcagtttctgtctctcccctcttggctttatcgtaataagagagggggcaaagcttccagtagcccaaatcactgtcaccagctttacacgatggcattcaatgacaatatttgcacgacctaatgctgattgcattaattagattcccatgttgctttgattaaatctcctcattgcatcgtattctcaatcaaaaatgtaaatgtgcaccttttcgatgttcattaatgcaaaaaaaagctaaacatttaaagagattaaaatggaagctatggatatccttgttttctgctatctttaacagctactgaaagtttaataaatgggctgctcaggtacttcctggccacttatttagtgacctttgtcatgcttcctgccagaaaatttggaaactgttgctcaagggtaacatacacagcctgtctattctgctgtataacacagattgaattgcatggttagaagactgatgtatattgtgcttcttttgttttacttcttagctttgatataatgacaaactccatttgctttaaaaatatattttgttttattcaattttggctttggtgcaaaactacagaaaatattttttggaactctatcatgcttgtcaaagaagaaatcctcaggccaccgagggtagggattggcaaactttttctgtaaaaggccagacagtatacctaagactttgagagccagatagtctctgtcacaactatgtgattctgcccttttggcatgaaagcagccataaacaatagtaagcaaataattgtggtggtgcaccaataaagctttacttacaaaaacaggccaaggcccaagttagcaaataggtgtggttgtgtaccaataaagttttatttacaaaaacaggctgaggccaaatttgggccacaggccataggttgccagccccagatttagggcatcaatatttaagtggatgcataataagaatgtgagaattgctccaacaagaaagggcctcatcttccaagataattgaggccctgcctgggactccacctggtacaccagtcttaattagctcaggctgtgataacaaaggattgattggttggcttataaacaacacaaatttatttctaacagttctggaggctggaagtgtgagatcagggtactagcatggtcaggttctgatgagaactctatttgggttacagactgctgacttcctctggtattctcgcatggtagaaagaaaattatctggggcagtaatccccttcatgagtgctctacccttacgacctcatcaccacccaaaggccccgcttctaccctccaatactatcacattggaggttagaatttcaacatatgaattttgagaggacacaaacattcagtccattgcacacccaaagtgtcatcacagcccaagctttctttaccataccgctaagattttaccatccatgaatttactgatagtttcacaaaatttgactcagaaaaattggtcaaaaaaattaaacagaaacagattcttccctgaactgtctttagttgtagtcagaatccttagctttatgcacagtgatgaggtcattgaggacattgattggtgctattttctggggtaatagttttgatttctctacattttctggaataaattatgtcaaagaatgcctcagaattttgagtttctaaacctgttgactttcctctcttcccttacacttcactctcaccccattatccaaatagcattattaaaagttttagtttggggtatttgttcccagatcaaaggcaatgattatatatttcaagaagtcaagatggctttctttgttgctatccagtctgcccttcctatggttaatgaagtcccactaatttattgtaggtgttgcctgcccacaaagtagaggcctgcttacagacccaataccaattctcactctgatatgttagtgtcagagatgtgtactcacaggacaacacatttgtgttactctaaggagtatttttatgtatcattatttttatggatatattattcaaaaatgcatttttgttcattaagacacacagaaatctgttagtgttcattgctagttgccccagcattaagagtattcagtggaacaaattttgtgtggtcccaaagacttagatgactaataaggagaaaatgataagataggttatattctgtttttgaaatgtgagtttaccgttttcttttatttttctcttttctttagtttctgacggcaagtgaatttacaggatggggagtatatttgcaacccctatttcctgatataaaggcatggtttgagaattttagtaatgtcagtaagggtcaagggtgctttcataccatctgtatatagctttcccataagtttgggccatcagaaaatagagaaaagatgctctcttcccagcttccaaatgactgcctggaaggatgtaggtagatagtgtgtgatttggacatatggatgctggaacactatccatgctacagcagtggatcctagtctgctccttatttaacagataggagggtgaactcaaagtgtacaaaatgtgtctgctcagagaacatctccagaatataattctagctccctcaaatccttccccacaacagacatttcacatgctttgctggttacttctgcagaatgaagagttgttttatctccaatctgaaatcacattcctgaagaactcagattaagaagatagacagccccttattagaatgcatgttgtgctgtaactgctgaaatgagactgtgggtcccctttcattctatagctgcgtaaacaagttataagaagatgctgacttatcagggatagcaggtagctacatttcttatttttgacttcttaaggaagaatcaagaatctattacaagcctgacttttttttttttttaatggagtctccctctgttgcccaggctggagtgcagtggtgcaatctccactcaccgcaacctgcgcctcctgggttcaagcaattctcccacttcagcctcctgagtagctgggtctacaggcatgcaccagcacacctggctaatttttgtatttttagtagagacggtgtttcaccatgctggccaggctggtctcgaacacctgacctcaggtgatgcacccacttcagcctcccaaagtgctgggattacaggcatgagccacagcacctgggccaagtctgacattttttaaacaaacatataaggtgaccttggtctctaaattagcagtgcaatggtaaagcctcaatttatcataaagtaactgccccctataacttcaaactcaaggttagctttcccatattaaagctcgcacagacttgagattaggcctactttgggcactcttcccaagagctactgcctccaaaatgctctatgaacttgatcatcaggatgaatgtatttgaaaataagtcatgggaatttgtatagtttagtaaataggtaaaaaagaaaaacaaaaacaaaaaccgtattgaagcttttttccatacaccctaatctttacaacttaattatttttttcccttttgatcctgggggaattcacccaaacttgccatcctgaaatggtctccagagtagagtgactcccagtagagtgaccaactatcccaatttgcctaaactgaggaagttccctggatgtgagagttttggggccaaaattgggaagttctcaggcaaaccaggacaagttagtcaccattagagtaacgtaaacaatgaccaaaaatccagttgccaaatatgtggagatggagcaagtaagggtaaaaaatgtaaaggaaagagagtaataatgaattagtatatatcacacttgtggtcacacgtagcaatagtggataactactagctctgaaaccacagactggcttggttagggaatactgttgaagcctcaatcggagtccagattatcaagtgaagtagtactttcaatgaacctaaggtctttgagtagaagtccccagaagagcagtcactgcccccaagctattcattaacagaagaaaattcccagaccaaatgggaatgccaggggtgtacctaagtctcccacagtgttctgattgagaacgtgaaacatctctggataaagcatcaagttggctagtgtagatacaacacattcagacaaaatgataagaatttcaaaagtaagtagctgcaaggaaaatattttgtcaacatgaaagatcttaatgtttacgttgataaattttaaaatattgccccatcatgtcatagttttataagattttcactactcaaattacgcagtgggtttccttctgcccagagcatctcagcagaaagggatcagagatcatgtgatttctgatttggaaaataaatcagttttatttgacaatctgccatgacagactgatttctgtgttcattgtttacctttttctgtagcaaaatcagctttagtattatttcatcccaaaatgaataatttaaacactaaaaaattcaaccaagtcaacccgttttattggtgttctggtttggttgaatcttcctttttctttctcccttttgtcccctctcctaatagaactaaatggtttattttgaccaaggtatacacagtttggtttactcggacaccaaagctgtatcaaatcagggagaagaatgagagagaaatgcaaatagaactcctgtgccagggtaatcagtaacacttgtccacggcatttctgtaggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcaggtaagcctccattggctgcacatgttcgcatctccatttctccactaatgtagagctgcctgattctgcagggtaggatgtatatgaatatttgacttttgtggtttcttgtttatcatttgaatcttaaagttggtggagagtgtcagaagtccctttggtctcataaatgtgattctccataacaagaatgtatttggtaggatggtacatggttaatggtattgtgtaatcacctgcacaaatgtgttcctgattgcttcagtaaaggaagtacaggctattccgttcaattgccattaagcataatatacaaaatctcatttcaataattctgccattctgtaacattcaagcatgcacacacacacacacacacacacacacacacacacacacaaattcaatagctcagcatagtcattaacaacatacttatagctggatacatggaaacctggttccaatgtcagctttgcttctaagtaaacacgtgaccttgatctcttaacttttcttggacttgggcctgggacagacaattgctgagatccatttttgcttttatattcaaatatgatcttctccagaagtgttatcactctaggctcaaaataatctcccccttttctgaactcatatagcagtttctttttttttttccatatttttttattatactttaagttttagggtacatgtgcacaacgtgcaggttagttacatatgtatacatgtgccatgctggtgcactgcacccactaactcgtcatctagtattaggtatatctcccaatgctatccctccccctccccacccccacaacagtccccagagtgtgatgttccccttcctgtgtccatgtgttctcgttgtttaattcccacctatgagtgagaatatgcggtgtttggttttttcttcttgcgatagtttactgagaatgatgatttccaatttcatccatgtccctacagaggacgtgaactcatcattttttatggctgcatagtattccatggtgtatatgtgccacattttcttaatccagtctatcattgttggacatttgggttggttccaagtctttgctatctaatagcagtttatctgtgactctgtaaggctcttattttttcctgccttattattttggttattgctgttcatgagtatagcataaaaacatggatttctggaattagacaaatctagaatcaaatcgaagctttgccacttactaagttatgtaatctatgaccctcagttaccttaattttaaaacgggaaactccatgtttatctctgtatattcttgtgtgaatgagtaatgtagtggtcagcaaatattttctgtaaagggccagatattatcttaaatgttgcagaccagattgcctctgttgcaactactcaactctatcattatagctcaaaagcagccataggtaatatgcaaacaattggacacggctgtgtctcaataaaatattatttacaaaaatagatggtggactggatttggccctttggctgtagtttgccaacccttgatataagatatattaaaaatacttgctgcagtgcctgacacagagtaaatgtttgataaataaaataatggctatctgtattttaaaatcagttctttttttttaatgctcaacatctctaatcattagaaaaatgcaaataaaaaccacaatgagacaccatctcacaccagtcagaatggctattattaaaaagtcaaaaaataacacatgctggtgaggtcacagagaaaacggaacacttatacactgctggtgggaatgtaaattagttcagccattgtggaaagcagtttggcaatttctcaaacaaagcagaattaccatttgaacaggcaatcccattattggatatatacccaaaggaatataaatcattctaccataaagacacatgcacgtgtatgtatgctcattgcagcactattcacaatagcaaagacacagaatcaacctaaatgtccatcagtggtagactagataaagaaaatgtggcggctgggcgccgtgggtcacgcctgtaatcccagcactttgggaggccgaaatgggtggatcacgaggtcaggagttcaagaccagcctggccaatatggtgaaaccccgtctctactaaaaaatataaaaaattagccgggcatggtggtacgtgcctgtagtcccaactactcaggaggctaaggcaggagaatcgcttgaacctgggaggcggaggttgcagtgagccgagatagtgccactgcactccagcctgggtgacagagtgagactctgtgtcaacaaacaaaaacaaaaacaaaaaaccaaacaaaacaaaaactggcactgtacaccatggaatactacacagacataaaaaagaatgagatcatatcctttgcagcaacatggttggaactggagggcattatcctaagtgaactaacacaggaacagaagaatactgttcagtgaatagtatagaatagtacagtactgttcaactgaacatgcagtacaaacgctgcatgttcttacttataagtgggaactaagcattgaatatatatggacacaaagaagggaacaacagacactgggacctacttgagggtggagggaaagaggaggacgagaatcaaaaaactgccttatagggtactacgcttattgcctgggtggtgaaataatctgtacaccaaaccccgatgacatgcaatttacctatacaagaaacctgcacatgtatccctgaacctaaaatcagcgtttagaaaaattaatgttccttttcagtagtaagctcttagctctttcaattcaagatatttggtttttgtcttttttgtaacatctaccaaatgtctaggacaatgtactgtatatgagagacagtacattgaataaagtattggcatttaaaggtccttaacagaatgccccctttcgctatataaatttattaccaaaaaagtaaacagctagtctccttgcaaataatttttccaagtctgcagactcaccatcatcacctcatttgacaactctgtatatgatttggttctgtattgtaaattccattcttatacctagtaatttcacagcatgctgatggctgacagccccaatgtcttgtggaataaaagaagctgctcatttgtaaaaagcggcaaagtcactgcttgcacagaaaaccaggaaacttcccccagtgaccattcatttttaaggaaacacaaaacattctccatggtgatgtgtttggttggtgtaaaatgcagtactgagcacaacataaattgatcggacctgagaaaatgggacatatgtggagtgtggtgctaggaaggagagttataaaaagcagcacagagcatcagctgccccagctaatcctccaggccttgggtggcatttgctctaatgaataccaggcatcacacactgctgaaataaaatcagattgtagttgctgttgttgctttcttgctgttttgtgaaggtctttacattctagaatcatgaagagtatgatgctcccaagcctagacccagaggcaattcttgtgtctctggttcccaagcatagcacattacaggccctgaaatgccctgacaactgttttggattaggtggggattgtcctgtgcaggctattttatacttttctttcattgtgagtattttctgaaatcaaaataaaaaaccttggtaaaggagaattggggatatcattttaagaaaatacaagctgttcggagatttgaactgcaagaatctaattatttgcctagaagggcttttgatgaaccagatactgtactgggtctagagatccagaactaagtaagatgtggtctttcccctggaatgacttcagtctaacaaggcaggtggatgcatgataaattaagtaataggaataaataggaaacaaggaaaacaaaagtggctctaattttgcaaatgaagtatgtgatcaaaatattgtcagaatttggcagttggcatccacagtcctgtttgtcagtgggctcaatttaactagaggtcaaggagtaactaatgctaatatatgcccagctgcaggtttgactcaaatttaaggccaaggggggtacagttgtgtccatgtcttaaaggtgctgaaaagttcctgctgacgttccattagaaagtaatttccctgcatactcaggtttacaacacaaatactcccaggagaggaaatccactggcttaaatccatactaaactctaaagagctgatataaaatttatttctgaggatgaacatactggattcctaagaggagaaatgggatagaatgaagaaaggttgggaaagatacaaggaaggggctagaagtaccaaataaaaaccctaaaactgtctccacatacacagtaaatacttaagcaattatttaattatgtaagcatgtggtccacattttaaaaagtaatgttctgtcttgatactctgtatttgcattttcctgaaacctaaagcaaatatcaattgcatttaatctgggaaaaattccatgcttttcttggctttgtaggtgtaggggtagaattaactctatatgggcaccaaagcccaaggttttgattgtcaaacaaaacaaatatagaaatatacagtccactgatttcataacaagcacgatcacctttcctaatacttcatatatctgtattccaaaaggtaggggtctaaaaaaaaagagaaggcagtagaccagaactccgtaagtgtcatccttatgaacacttggggtaccttgactaaaattcaaacaaatcttttaaataggaaggaaaggccttatctcagtgttaataaaccttttatccagtgatgtaggacacaatctttgttgatgaaaaagtaccaaatccatttctgtccatttttctttaatattcattctctaatgttttatcttactctctgttttttcctaagttgtttgttgacctgccccattaattattgatcatctctgacaagagtatacattttgatttgtaaaccttcttcagagaaagtcaataatccagagaatagagatcaagtactgagtaacatgtggtccttcatctgggatggggaaagagtcaaattctaaattcagagagagtcaaattctaaattcacattacttacaatgaatccatacttgaatccatactgaaatagtgaggtgagtcttgaaggttgtacatattattgtttaaacaatatttgttgaatttaatattgtgagttggaataaaggtcaggacatcatgggatatggtggacaacatgaaagaaaaaaggagaaggtgagcatttttgaagaacagctcatctcacatgcccacagtatctttgctgatattgtcttctttttaaaaatcccattgcttctgagaatttagtcagaaatatgacttttatagaaggattttttttaaatttgaagttaccttgtaaaatatctaatccaacacccttgttttgttgataaggacgtcacaatggagctagtaagtaggaaagctaggacaagaatcagggctcttaacttctgtttcagtgctgtcatttcctacccccacattaattcctcatttacttcaacccaagtccaaagacacaaacacacacaattcatgttgcagcaaagggcatcatttcatgcttttttatggctgcgtagtattctatggtatatatgtatcacattttctttaatctaccattgatgggcagctaggctggttccatgtctgctattgtggatagtgctgtgatgaacatacaatttcatgtgtcttttgtagaacaatttattttctttggggtacacacccaggaatgggattgctggttcgaatagtatctctgttgtaagttatttgagacgtctccaaactactttccacagtgcctgaactgatttacattcccaccaacagtttgtgtttgcttttctctgcagccttgcagtatctgttgctttttgactttttgataatagccattctgactggtgtgagatggtatctcattgtggttttgatttgcatttctctaatgaccagtgatgatgaacattttctcctatgtttgttgaccatgtgtatgtcttcttttgagaagtgtctgttcatgtcctttgcccatttttaatggggctatttgttttttgcttattgattggcttaagttccctatagattctggatattaggcttttatcagatgcatagtttgtgaacattttcttctattctgtaacttgtctgtttactctattgataatttcttttgctgtgaagaagctctttggtttaattaagtcccatttggcaacttttgtttttgttataattgcttttggggacttgtctaaaaataattttccaaggccagtgtcaagaatggtgtttcctagcttctgtctaggatttttttttttttttcttttgagacaacatctcactctgtcacccaggctggagtgcagtggtgtgatcttggctcactgacaactccattcctgggttcaagtgattttcttgcctcagcctgccaagtagcttggattatatgtgcatgccaccatgcccaactaatttttgtagttttagtagagacagggtttctccatgttggccaggctggtctcgaactcccgacaagtgatctgcccacctcagcctcccaaagtgttgggattacaggcatgagccactatgctcagccctgtctaggatttttatagtttgaggccatacacttaaatctttaatccatctagatttaatttttgtatatagtaaaaggtggtagtccagtttcattcttctgcatatggctagctagtcattccagcaccattttttgggaaaaggagtcctttccccagcttgttttgtcaaagatcagctggttgtgtgtggctttatttctgggttctctattctgttccattggtctatgtgtctgtttttgtaccagtaccatgttgtttttattactgtagccttatagtacagtttgaacttgggtagtgtgatgcctccagctttcttctttttgcttaggattgctttggttatctgggctgttttttggttctgtatgaattttagaatagtttttttttctaattgtgtgaaaaatgacattgttagtttgataggaatagcattgaatctgtaaattgctttgggcagtatgactattttaatgatattcttcaaatgtatgagcatgggttgtttttccatttagttgtgtcgtctctgatttccttcagcagtgttttgtagttcttgtagagatctttctcctccttggttagctgtattcctaagtatttcattttttttgtagttattgcaaatggtattgtgttcttaattttactctcagctggaatgttattggtgtatagaaatgctactgatttttgtacattgattttgtgtcctaaaattgtactaaagtcatttatcaatttaggagccttttggctgagtctttagggttttctaggtatagaatcatatcattagctaagagaaatagtttcagttcctctcttcctatttagatgccttttatttctttctcttgcctgattgctctggctaggacttccagtattatgtttaataggagtggtgacagaggacatccttgtcttgttccagttctcaaggggaatgcttccagcttttgccatccagtataacgttgactgtgggtttgtcatagattgctcttattattttgagcgatgttcctttgattcctagtctgttgatggttgttaccatgaaaggattttgaattttatcaaaagatttttctgtgtctattgggatgatcatatggttttgcttgaaccttcctcaaaatatatgcatattttggcagggcgcggtggctcatgcctgtaatcccagcactttgggaggccgagatgggtggatcatgaggtcaggagatcgagaccatcctggccaaaatggtgaaaccccatctgtactaaaaaaaaaaaaaaaaagtacaaaaattagccgggcatggtgtcgggtgcctgtagtcccagctactcaggaggctgagacaggagaatcactggaactcaggaggcggaggctgcagtgagcagagattgtgccactgcactccagcctgggcaacagagcgagactctatctcaaaaaaatatatatatatatatgtatagtgtatatatatacacacatatatgtgtgtgtatatatatgtgtatatatatgtgtgtatatatgtatatatatgtatatatatatgcatattttgtgcattaggttatttaagctattttttgtttgtttgtttagaggaaaaggtccttatctttattaaagaagctatgaccctccaactgttaagagcttgagctttgtttccagatttactgcatgcctccagaatgggtatgcctaaaggtgaagtgattaaggaaatattgtttgctttcagtgtgttattaaactgaccagttatctgggggcctcatactaccatctaataacccataaataattataaaattgcccctcaacaatagcaccccatatcaccaaagcatctgtttacctcatcatcaacctttatctgacctaaaacttattggcacctaaaactttatggcattggaggtgatttgcttgttaatcccttttgattctatttgcaattctgggtgttgataattcagtattctgccttcccagtagtacttgagttgtaatagagaactcttggggattgacacgcttttccctctgatgatagattacaggcaccactgagagtaggtatagtgcagatttctagacagacatccaacgatgttcctccaaacaatcttgtctaatgaccaactctacccacatacataaaaggctagcttttctcacatggcctcccatccttgactcatcctatagtctgatgcaagaacttcaaaagattctaactttagttatatatttttttatggcatagggaataaggacattctctatttagatgtcagagccaaaaataaaatgtacaatgaactgagacctgccttaaatgttgccagtggtgttgctttgattaccttactctcaattttgatgagacacataagcccgtattttctattagaaggcagctatgaaaaactatgatttcttttcgctgtgcatatttggaccattatttatctttatgttctataatccaggcaaaattacattctcattttctaactctgtgtccaaatcctcattagtattgtgacttaagtaattaatgtctgtaacataagcgtccacatcagaattaagcagtcttcagagaagtgctgggaaatgccatggaaaccacaatgattccattcttcctagaggcgagcaaggtcgggagggtgggaagcactggcatgcacatatgctagtggattcagcaggagctgtggtgtggaggggctgtttttggagaggggctctttaaaaaggtacagctgagggtagaaatatgaaggtccagaaagtgcgttgtatgtatgacagactctcataaagtatggaaagctttgttgagctcctgctcaggttagaaatacgcaaacactatgggacctaatattggttcagacacaacagagtaaggatcttgtattagtcagggttccctagagggacagaactacaagttacatattacatatatttatgaaagggagtttattaaggagaactgactgactcacaccatcacaagatagagtcccatgataggctgtctgcaagttgaggaacaaggaagccagtggtggatcagtctgagtcccaaaacctcaaaagtacggaagccgacagtgcagcctttagcctgtggccaaaggcccaagagcccctggcaaaccactggtgtgagcccaagagtccagaagctgaagacttggagtctgatgttcgaaggcaggaaacatctagcacaggagaaagatgaagaccggaagactcagcaagttggctcttccatcttctcctgcctgctttattctagccgtgctggcagctgattagatgatgtgcctagccagattgagggtgggtctgcctctcccagtccactgactcaaatgttaatctcttttggcaacaccctcatagacatacccaggaacaatactttgcatccttcaatccaatcaagttgacactcaatattaaccattacagatcttatgcttgtttggaggaaaggagagacttgatcaatgaaatacatggcagctagcatgaccacttgtccttaactgtttacgtgactggactagcaatagcaaccagtaggttttcttccatttagaggtaaccttacatttcattaacattcatcagtttgctcttcaggcaatggtacaaagaacagaatattgagaagatggctcagggcattgtgatctccacacttcctttcatcatttactgtatctcccaggatcatagaacagcctttccagctccataagtttatcattctgggtctcagtttcctctataaaatgagactgaaccagacacttagaccaagtatgaggctccttctagcactattataagtctgtaactcaaaataacgtccctctccttcccaaaccacaaaacactttcctgatgagtaaataagagtgcattcttcatgtcccttagggcttgagtcagcagaggagattcagaatttcaaggtgcctgtcttaaactacttggatctttgaacccttttctcctgaattaaatatacaactcctgagaagaggaacctgattttggagtaggttagggaggtttggactacctgtaatttaagaggcagcgttaaaacattcaacatggccgggcagagtggctcacacctgcaatcttagcacttgggaggctgaggagggtgtatcactttagctcaggagttcaagacaagcctgagcaacatggcaaaaccccatccctacaaaaaatacaaaaaaactagctgggcttggtggcgtgtgtttgtagtcccagctacttagggggctgaggcaggaggatagcttgagcccaggaagtcgaggctgtagtgagccaagatcatgccactgcactccggccttgatgacaaagtgagactctgtctcaaaaaaagaaaaattcaacatatagtttacacaatgacaaatactcagtatcaagtgccctgagaaacttcccagtcgtaaactagatcatttgtaccctctgattcaatcaccaggaatatctgtgaactattattttagaatatgttcatgaaacataggtttatatacttttagacaattacacaaagatggttggctgggaaaataattgactgaatatgtagactaaaggaatcatgtggtagatttgagccagcagagttgaagagctagtctgctattattactcatcacctgaactttctcatggcagaaagccaaaggaaaaccagaggttctggtgagggtgctcaacttacattaatgtgggcttctacctggtccacactgctgctttgaaaggctccctggatgacattaataccaaaataaacatgcataatgtcaccatggctcttatgaaacatatgaattactttagttcattctcacagcacataatccaaaggaaaaggtactttattttaaaatggaaaaaaaaatgtgtccatctgcgtatctcagcagtctctccaacaagtttcttctcgcttgtggtgtttaaaattacaaaccaacatctgtatcaaagaggatacgatatttatcattggacagtcattaaaagattattaagtacgtatattaatacaattatgtgaagttccacatgagatatactctcagagcaaagccatctcatttctgattgattggttatttcaaatgacaataaaataaaggttttatttgatgtttcattttagtatggatattttgctaaacttgagcagtcagatgaaggatagaaagcaaaaagtatgctaggggattaaagacagaattctattggggtgggacaaatgtcagttctgagggtcaggaatacttggattcaaatccaattttactaaatgaccataaaaagtcatttaacctttctttgacctgcagtttttctcagttccagattcacaataaatgttcaatgaatgtcttaattatccctgagttggctgtaggataaaagggaggaagtaagggcgacaacgccccttaccttccttaacacatacgtatggacatacttgtaccattcaggctccactcactttccacacttagtccaaagcagatggatactctccttgccttgagtttcctctttttgggagacatgtagctcataacagaggtgacagttgcatctactttcagataatagtttagctgatgctgttcctcccctttagctgcttgttaaaagtaaactgaggaattatgcttggtttcaaagtgttatccagtcaaggatggaccatcctatcaactgaccagaactccattctctctccaaactttgccaccagaaacagtggtcagtaagtctccatcagttaccacagtggaagtctttttaacgcagcaaaatatcagccaggtaacacaattttgccctcagttgtcaacaggtacaaggttactttggttttctcaaaacggtatctgcagttcataagcatgcttacacgtgttctcttcccccttttttttaaagtaaaatgaactcaaaacattttaaaaattgctacactgtacagtaactttctccctttcttcacctcagtgccacgattaaatagctgtaatactagacgcatagtaacaatgaaaaaggcagttctcattatttcaatgtgcaggctacattttaccttcaccaatgttttgatatataaatactagatgtgaaatgactttgaaatgtaaaatgtaactaagatgtgggggagtattgattatttaaatctttggtaatttgagttccttcctctgatggtgttcaatttatccctcttctattcaacaccttcaaaacattttcatccaggaaatatcaaagcatttgggaaaattttagctgcagatttatcagttgctctccaagttgaatccaatccacatttggacttaattaacatgggccaaccatatgtgtgcacactttctgaaaggaccacacacagatgggaacagatattgtatttttgtccttcccagctactattgctcagtgcatatgggtattttttatgatgcctttataatatttggtaaacatggaccttcctactcagccactgggattttagtcaggggagaggagaatagctaatgagccaagcagtgttgccatttatctcctctacatcccaaggtcaacaggaaaaaaaaaaaaaaaaaaaacagcaaaagtgcttatttggaattaatagagaggaaagagtctaaccatacagcttagaaacaacctgggatttaggtccagccttagacaatattgaaaaaatgatgtgtctctggtgcccagccacactgttctgagccctgtttttcatctagtttcatctttccctttgattttcttagtatgacagtctgcccttggagatatcaatagggaatctgggaatctatcaatttatttacacaaagaaggaaatgagtaacagtacttgaaacacatttctcttcctagctttgcatcttaatagtcaaagaagcctttagctaaatgtgtatttatttattatatatagcagctaagagttggaaggtgtttgagcaaggatatattgggacctttgtggaactcccaacaatttatacaccattaatttttcaaactttgattaggtggaaagtcttcccaggtgccaagctcagggctggagtaggcaggactctctctatgcattacatgatgtaagttcaaagtagccatttaatcacagagctttcagaaatggtaagttaaaaaatttcattccttgcctgcctaaccagacttggaccaattccttttgttttctgtgaataaagatcctcatgtgggtacctcaggttcaattcaggagcatcaagtcatgcttctctgatagaccaaaagggccctctaaggatccaggtatgtaagaatagataacctgctctacccgatcactgtgagtgcttatctgggccccaagggagtaattaaaggtcctttacttgattctgttcacgtgtgtctgattcacatcatcaaaagtattgtctaagtgggagagttggaaacaacttcgaaaagttcaataataaattgaaactattaggatacatatctgcaattctgatattaagttgtgatctccttcaagagacacactgtcttattttaagtgtctggtgcctggtgcccaataaatatttgccaaaatattgctgaatggatgtataatactaagttacagcccagatgcagtcctgcttaacaccaatccctccacaataggacctagagctagtcttcccatgtactctgttctttatgaccagtaccatgagatttcctaaaatttttgttgtggttcattcaatgcaggttgcagccacctccctaacttcttttgaaatttcttggtggcctattttccagacatcagagacagtaatctgatatgctgccatcgccctgagtagagttcactgcctacttttggcctttgcacactggcatgtgttaaaaggcatgatggtcttggcttcttctctatcttacctagaaactgtcctcctaaccctcttagcagctctcccagtttcctagccacatctaccatattcttggttgccagtggactgattttggcttcactgccctgacttaaccagtatacctctccaatgtgactgaagcccatgattaacacccccaacttgtatcattacccctagtccaatcacttagcagcctacttgaggctaactgtcctaccctaatgtcgagaggctgagggaggagaatcgcttgaactcgggaggtggaggttgctgtgagccgagatcatgccactgcactccagcctgggtgacagagcgagactctgtctcaaaaagaaaataataataatatttcccaaaggagtgctactgttactgaaaaattatagacctctttcttaaaaccttctcctttttgtctatcacattgacagaaatcaaagtcatccctcgggatatgctgaagtagtactccttaaagtgtgctccaggaaaccagcattggtgtaacctgggctgctttatcaagagggcctgataatctgcattctaaccaagcccataagacaatgcttatgcccaccagagactgaaacccactatactaaaagatggttgatcagacaaccagcctagcggtgttttttatcccagtgatttcctaatcttccctccctctctccatgtgtgggctgtattaatgatgcacttttaacttgacttctaacttgcccccaggctaatttcacttaaggtctaggtgggttaagatgacactcttgtttgatacttgatgcatcctgtcaaatctccctgacactagaatgtcacatggttcagaaatttcaaggtacaactgggaggaaagattcaacggatcaacatggtacaggaaggccttccttatgttctcagtgaaagagtgaatagtgttctaggatgttggatgacaaagccctatggaagcaataaatgtctcacctatctgcccagattgccaagaagttcctattttaagaagtgttacttgcacttaaagttttcatcatattcaagagggtaaatttacctataagaggaaatccttcaagctggttgccttcacttatagtttataatcacagagatgttgagcaggatggggatgtttgctgggggaggcccagagatttagtcaagatcaaatagctctttatgggtaagccaggtctatcacccaggtttctgggttgccgggagaggctggaggagtttttaaaacaacaagccatgaggattctgggtgtctgaggaaaaatgaaaggggtatccctgagcaggtacaaggcaactaaggtgtctatgaccaactctgctggcttcatagacaaaagaggataataaattggtaacagattattttcctaaggaggaaatgtgaaatgtgatagagtgggaaataataaagggaatttgatgtcggttaaagctgtattcaaatctaacttcggttgcttagtggttttatgactttgggaacaaagcttaaactctgtgagtttcaatttgcttatctcacaaatggaggtaacactgtctgccttgtgtgataatactcagtgattataaaataataagaatgcttgacccacagcaggtgttctgagaattatgattattaatactattatcaccatcactttaatttttagtttgcctaagtattttcatcctaaaggagcaccataggttccagcccccagatgtgtccatgtgccactgaaagtttgtggtgtgctgcataaagagagataaatgtggtcccaacagaggaacagcaatacccccaagactctcttgttcgtcctgaaagacacagaaacatcctcttgtccttcctctctgaacaagagaaactattgtaatcattagaattaactctccaaaaatagcatgttgtcaatccttgctttagggaagcagatcactcattaaaatttgtatttgtacctgaaaattcatcttctcttcaaatggtatttttccctcaagagtttcattgggaatgaactccgagttctaattctaagttccttatgaaccagtagttgctttatgagtcaagcagccttctgtctgccataacattgtaatgttaaatgattaatttacattcttctagcaatgtgaaaatagccccagccatggccctaactagttgaccaaggttccaggacaagtcagccaggcttcctggcattcctttaacttgatttgttttatttctagtgagaatctgccagcaacttagcggaggcaccaggcaagctttgacagtcctgtaatttagcagcatcctgtggactctgatgactggcctcgtcccttctaaatcctttaacctttcccatttccacagaataaaagcctgaaattctcacacaaattttaggatactgattcattaatttgttcaataaatatttcttggatacctactctggtctaagcagagacaggggttcagccttcataaatcttgcattgtagtagggaagaaaaataaataaaaaatataaaaattacaatatttgatttaacaactgtaaaggtaactgaaatagtttacagtgtctgcatctatcagtcatttaaattttaagtgaggtataaacccaagagatggttttatgagcaaggtgaactcaataggaaagtagtaagaaagggaaagggcaggaaaggtgagattttgggagacggactttctttgctttgttctattctttgcctttaaaataggaatgcttgctcagccttcttactttcagtaaagaagcagggcctctgtgaaggaactttacttcttcccttgtgcaaacaggagcaggggtgccctgaatgcacagtggaggaacggacaataatgcttcaggaaatgagttatttaacaaaaatcaaaaggaagaggggcagcctcagctcaatgccttcatgtgcaatggccttaatatttcagattatcggggaagaggacaaatctgacatgctggtcaatgtctgccagtgagaagtctgagtgtccaggcaagttcggaagactactggcttcccgactaaaatagttaattctgtgagacccacccaaagtgggtgaaaagccagagcaaaggagataaaaattgttcacattttagtatattggtgtatagacatatcagccttatttggtgcaatttctgcatgtctgtacaaaataatatcaagttctttttttcccccaaactcatatttaaaaaatcataaaatagcctttttaaatagcaaatggggtggcacttttgtagattcttgtctgggagcataatgaaatattctagggtgatgggaatgctctaaatctggatctgaaagcttgttaaataggtgaatacagatgtaaaaagtaattgcactgtatcttaagatttgtgtttttttactgtatttaatgtacacttcagtagaaaaaatgaaaaaggaaaaaataagtagcgggaaaaacctagatcttaggcctttagatgcacggtagactggatgtcataaatgatgagctctgaggctcaggcagggacttattagatctttacaatatctttctatttgctcatgatttaacaaactgcggaactgttaactctcctccttattattggcacccactgggttccagtacaaaacctatctagaaaggaaattagaaaaacaaagaagaaaaaaaaacccactgagttctcagctgagacaagattcagggatagggtcatgcttgttaggtatttctctcagtggggtctcccatgctgttaatagttttggctcccaaaatgctgagcccctctaggatagttagatctgccacaaaggcagcaataattgtgtgtgagatctctgcttcctgaagaaatgtgaaaaggtcattttgcaaaacagtcaaattcagcaagcctatgattaggaatattaaagttgggttgtttccagtaacaaaccaatatatagttgaattctgtgacattcttaaaagaacatgttcttttaagctgtgttcatcttcattattattatttttaatttctttaaacttttcaaaactataatgaaatttccagattttttggttttgattcactgaaaccaattatccatatgccatctaattattttcatataatgaacatttttttaatttaaattttaattttttgaattgtaaatggacaaattatagttgtttatgtttatggggcacaaagtgatgttatgatttaagaatagaatgtggagttattaaatcaagcaaattagcatatccattccctcaaatacttattatttttttatggtaagaacacttgaaatttactctcttagcaattctgaaatatacaatgcattattatttactattttcaccaagctatgcaatatatctccatgaaagaaaaatttattccttctgtctaattgaggctttgtttccttttgcagcactattcataatagacaagttatgaatgaacatatttttgtatgatgaaaatatttatttcttctttgaaaaatagaaaaaaaatagattctcattatggtaataataattttaagctcatggatccttttgaatttttttcacctttaataaggtgtcagctttgttgttgtttttttttttgtttgtttgtttacttttttttggttcttatattctgtccttatttcaaagagttcatggcattaatctacacaaaattgtgttttcaaaaaaacaaagtctttatgctgggaaccaaaaactaaatatctgtatatctatagctatatctgtaaatgaactccataattgacaacaatttttcctgcctaaaatgttatttttaagtcagttgtttagaactataagccacattttttcctttagagacatgtttgggttctcagaatagcccacggaaggtagctaatttatttagcaatgaatgtgaaatgctgtaggtttgtggcaaatttttaataatcatgatatgattgtaatagcaaaaaattactgaacgaaatggaattttgtaattttacctttcagttattgtttgaagaaaggcacagctaattacacaaagatgggaaagctgttatatgaatagtttttatggacattttcaaataatttatactgctcaattcagataatgcaagataaagaataaaaacaaaatatgaatcatcccactaaccaaaaatataatggtgtgcttatttccaagatttaaaacatgtttttacattgcactgttttatatctttctttttccagtcattatattttaataattttgatgattgtcagcgtggattctttgtctaatctgacttcaaatcgcaaccctttcctttctttaaaatacatgtgctaaattttgttttgtttgcttttacttgaatagattgtaaaaatgaagcagagaaaggaaaaataaaggaagcaggaaggcagagcaagaatgagcatgacagcaagggagagtttaggcaacagtgtgagaattcgaggggtctttggatataaaaggtgtttgagatacgatgaacagaatttgaagcagtcaactttagaaaaatacggattgtagtattaggatcaaatgagaataagcatcatcttacctacctcatcatttggttgatgacaaaacaaatgtttagcaagtttaaggtcttgtttgggggaagagatagtttgaggcagtactaggaagggaaccaagacttactaattctcaatcctaatttccttccttgaatcttggagatacagaaaaatgggagagcaagaggtgtgcatcattcccttaaggattaaaaagggaaatggtggaaatgagatggtagctcaacgaatatcctgatataaggatcagccagagctgactggagttcaaaaaagttaaggaaagaggaaagtggagcagagtaaccccttctgggtgcagagagctgaagactatgtacaaaccgttgtttgtttgtttgtttgtttgtttgtttgtttgttttgtaagataatgagtagtttgtttttcctttttttttcaatttttttatttccataggtttttgggaaaaaggtcccatttggttacatgacttaagttctttagtggtgatttgtgagattttggtgcacccagcacctgagcagtatacactgaacccaatttgtaatcttttatccctcacctccttcccaccctttccccttgagtccccgaagtccactgtgtcattcttatgcctttgcatcctcatagcttagctcccacttatgagtgagaacatgtgatatttggttttccattcctgagttacctcacttagaataatggtctccagtcccatccaggttgctgtgaatgccattaattcattcctttttatggctgagtagtattctatcacatatatgtaccacagtttcgttatccacttgttgattaatgggcatttgggttggttccacatttttgcaactgtgaattgtactgctataaacgtgtgtgcaagtatctttttcatataataacttctttttctctgggtagatacccagtagtgggatcgctggaacaaataatagttctacttttctttctttaagggatctccacattgttttccatagtggttgtactagtttacattccctgtagaaaggttcccttttcaccacatccatgccaacatctattttttttttttttgacttttttgattacggtcattattgcaggagtaaggtggtatcgcattgtggttttgatttgcattaccctgatcattagtgatgttgagcattttttcacatcttttttggccatttgtatatcttcttttgagaattgtctattcatgtccatagcccactttttgatgggattgtttggttttttcttgctaatttgtttgagtttattgtagattctggacattagtcctttgtcagatgtgtagattgtgaagattttctcccactctgtgggttgtctgtttactctgctgactgttccttttgccatgcaaaataaacaaaaacataaagtaggggaaggacaccctattcaacaaatggtgctgggataattggcaagccacatgtaggagaatgaaactggatcctcatctctcgccttatacaaaaatcaattcaagatggatcaaggacttaaatctaagacctaaaactataaaaattctagaagataacattggaaaaaacccttctagacactggcttaggcaaggatttcatgaccaagaacccaaaaacaaatgcaataaaaacaaagataatatgtgggacttaatgaaataaaccatgatctttaaatgggtttttctagctcaagaactacatgctccagaattatcaaaattctagaataaatgctacaatatattgttaacccatacatgcagtaaatgagaagactgtggagttaagcatttgcccatttgatgtaagaagaactagcacttaccatgatcagttatacttattacatcatttctgtccttgaagcaaagtccaaggtgtaattctaaaatagtataaactttatatcttttggacattggcgtgggtaagagcctattgtttttgttatgttatatctcagtggtcttgtttattctagtacaaagctgagaacagcaccattttgggggaaggagggagaatcagaggctggaagatgaaaaatagagagtaagaggttatggtgaaatactacaatatttaaaaaatttatcagtgactgttcttcattttaaaaacaaaaagcactgccctgagttggagcttagatttcattatttgaatcaatgtcactttgcttaatgccaagtgtattttgtttgtttctcaacaactggacttcatagatttaaaaatggtttttaattttttttttgtttgctaagactcaccttgaccttatcctgtcccatggacttgaagaactttccgatggatgtccagacctgtacaatgcagctggagagttgtaagtcaccactgttgaaatgactccctgcttgttttaaccaatgacctggttcttttagtatgtcattaaagagaaaggacccttacaactcattccctatatactgaccaacccccaacatcctaatggaaagacaaaccaaagtgtgtgtgtgtgtgtgtgtgtgtgtgtgtgtgtgtgtgtgtgtgtgtgtcatacaaaatctcattatcaatacagcataggcaacctttcaaagtaaaatgccaaataacttgcctttctccccccgcccaaaaaatagcctgatttggtaagcttttcattgaaatgaaaatgtctcctgagaaaattaaaattattagtcattaaatctttatagtgaatcactctttaatcagaaaattgaatttctttccatcttatgcccatgtagaccatcaccccaaaaggaattctggcaggaagggataattgctttgagaacaagacataaggaccttggccagaggaggatgtaagaatgaggggcatgagatgagatggaataagacagaataagaggcatttctcttagataagcagtggatacacaaaagcatggtgaagcaagtagaaaaaggccatctactttgtcccctttatgacctaaccctgatgccactaaagtctttgatatgtgtcaccataagttgctgatgcctccaaagtaacaggattttcagttaagagatatgaatttctttctggcttggtctatcagtttctctgtttgtaaaatgcagagaataataagtgccactgacctacatggacgttaggagatttaatgaggcatgggcaaggaaatacttttaacttcttggtttagaaaaagaatatatgtaaaaagacttatctattatttaaaaagaggtagtgacagggttgatttcattctgatcatctaaaatcactatggatttcccttgaaacatcccagagaaataaacaaaatgatgaaacctctttatcttaagaagttgtcatagataaaatgaaaatttctgatttaaaataggccttatgtattcatttttttccttattgctccttctcttgagaaaaaagctgagaaaaacattttcttacatgattccttctttctgttttctctactgctccaaaatctcccctgactcaacccaacacttttattttttctgtaaaacagtagccgtagctgtcaactgatgttcatccaaggcttagaaaatttgaattagtaaataagctcagtcctggcatgaataatgaaatcaaagaaacatcatgtttaccactaactttggatgtgaagggtgggaattattatttttttccttttctatcccaatattactttcttcatccccacctctttacctctgctgtcttccccatgctggggcttcagggtgactgacaagaacttttattgtggtggccaacgagaagctcaccagacaagaacgtggggtattttgtgagcttagagtagtatttgctggaggtttccaaggtgtactcacacagatagggtttgccattctccttgtggaccaccaatgcttgtatagggcctctttgtatctccttgctttccatgttcttattatttttttttttttggctttatgttgaaaaggtagtccaaagaaacaggaaagtagattacaattaaacttgccattgatttctgggtagctctggcgagtcactatcttgcagtaaataagaataagaatccataaacttaaaaaaaaaaaaaaaaaacatgctgaggattttggccagccaagacctcacataatatcctctgtcctcatcactcttatctgaaaagttcaaatattacaaacaaagggaaaaggtagagaaatggtgcatgaaagaagagtaggcttcatttctagggtagagaaagatccagaaaaaattgacagatgatgacctagcttggagactaagagctaactttggattaccaaactgataacaattttactttggatggttcaagtcatataaaaatatgatctttcataataggtaatctgttttactttgtattaataattgtgatgagtgggcccatttagcaagacactagcacaaatgaatattcttaatttgcatattccataatttcctcttagattacctgccaatagtcttccccatttgctaaagtagaaggactttaacataagctttctgaatgcaaagctaatagaccctaggaggagggccaagtctgtaatgggaatgttttaggcaggcccgtgattaattcattctcatttaaaaaaagaatggttttcatttaaagtactgactggcactgtggattggattgtcttattggattgctaaagcctcagctcttgcaagtaaagacaatcttcaaaggatttttatgtttgttcacttgtttgttcttcagaaagagttagtgaataaaaaggcagaaatcaatagactttttagattccattctttcattacacagaaaaaaaatccatccataagtagctttctgtcttaaatttctttggctccaatgacacagagttgtagtgatgattgcagctcttttattaagaatgctcttgaattgactgagcgtatgtctgctttagacagtttctttgtttgtttctttacatgggtagactttcaagctttcttggaaagccatattcaattttcactatgatttctttacctcagttgggtacacgatgaatgacctgatatttgagtggttaagtgatggtccagtgcaagttgctgaaggattgaccctgccccagtttattttgaaagaagagaaggaacttggctact

SEQ ID NO: 4325 - DNA, 202511 bp, human
cttccctcaccctctccgtctcccgacctctcttctcctcttgctgtcatcgtacccccttcagtatcccctcgctgaacggccagtcactctttgccttcgaacagcaggcacgtcccctcttgaatgcttttccccgacccccgccccaagcaactgaaaaaggaaacatgcgcacttcagagcttggagctgtccgagtgctgaaatttataggctgggtaagatcacgtctccgtctcattctatagccctcattccagcacaggatctcagcaatttttccctcttccccccacccactccagcgcgcagagtcctttcttctctctcatttacaacttctttttaaaagaaaacattttctagaaaaagggctttgctaaacagaaaagatataaaacaaaagccacagctatctagcatggcattgtcaccaactccctttgcatggtgatgcgattaaggtagcagcatttttattattcaggaaaagcagctgggggattcatcagttctgaggctttgtctttctgggttaactgatggtcccaagcctcggtttgacctgaccatgatgcccaggactggcactttttcttttttctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggaatgaaccggcagctagtgaacattttgacagccttgtttgcatttttcttagagacaaaccacttcaggtaggtgaaacgactttgcatgttgatatttaaattgtttaaaagagaatgtgtcatgtaattgtgtatttatctgtgctctggactatattattttaattttatagaggaaagttagatatcttttgttcatttaaaacgcctaataattgtgggagggtggtaaatttttcacaaaagcaagttttatgatgcatagccgcactctatgcaattcaacacacattttcacagccaacgtgatattaaggtagtctgatgagttgcatgctctttacatttctatataagggtaattatttttctgaaagtaatttaaagagattattgggtgcagtgtttttcatataagatgattgtattaatttggcaggagcatgctcattttagataaaatataaaagatccctaattctcagccaacttgggacttctgttatatttcagaaactagaagcatactatgaggactacaattcaggaattttcttgaaatatcaaaaatttctttttactactatattctactattcaatctgtttggaaatggattgcctaccaaaatttagttaatatgacataattgtatttatgtacatatgagaagtggagcatgcataattttaaaaagtgagaaattactattttcatgcttgcattttctacatggtttacgaatagttgccaaatcaattgatacctcaaaatatcaaatcattaccagtaagtgaaatagtcatctaataacagagagtggaagactgagcagagacaggagatgctcttacaacaaagtataggactctaaatttaattttcattaaattttatggcattttttcacagaaccaagataaatggaacacatagtaataatgctatgaatactgggaaaacccactatgttcctttcaggtttacacctcctactatgattaagaaaaaatataggctggtttttattagaatcatcatcatcatcatcatcctcaccaccaccaccatcataatcaaataatacttgattaatcagatgaatctgcatatgagaatgtgagtatttatgcatgctcatatcaatttttaactcctacaaaatatttatatcatctttgcacttattttgaataccccttctttgaaaagctggcaagaatgtggtattttcttagtgatagaattcataagacactatttgttaaactattgaaaacaaagcttataaaatacatactttagggaagaaatttcagttaaccactatgtattgtgaaataattaattttgctacaaaccaaatatgctatgtttaataagctctttattacttttaacaggaaaatgaaaatctgagaaatttttcaccaactttcagtgttttggtgataaaaagtcaaaatgatttagaagtgtgttttcatcaatattttttagagagtcaacaatttaaatgcttatataagcatttaatatataagcatataaataactgataaaataatagaagtcatatacatgctcattgttgacctattttaaaaagaaatgaaatgtccaaatgaaggttctcttttagatatcacattgaaaaatattaatagttgatagttggattagaactagcagatgggaaaaataagcaatgaaataataagtttgttctgcccatcttattatatatttcttataaaaggtagatgacttatatttagggccgaaatgctgaaacaatttttttaagtcagatagaaatgattttaagacaatcacatgaatttaaaaaaatatcatctcatttctctgaatagttttaactatatatacataaaatctacaacctaaaactaaatacattgtctgttctcaaacatcttatggttaaagtttggaaacctgggtgacgcgactcaggatttatagttctcatcatttaaagttaactttagaacatgtacaagttcagaagttggccaaagagtttggatttttctagttttcttcatactaacatatcaaatatctttaccaaaatgtaaagttaaaaatgcagtgagcgttagctctcaagggatgcaaatgaaattgttgctaaaagagttaatgatgtgtttaggacggctttctgcaaagaccatgactccaggtctggaaaacaaccttcacagaccctatctccttcagatttcttggacaagttaatgggaaggacatcaggatatgatgcaagaatcaggccaaattttaaaggtaggttccacttaaacttacgttaagcctttgagaaatcttctagatgtttgaatagttaactgaaaaacattttcagggcttttaattataaaatgaaaatgacaagtatagtgttcattttattttggtattcttttgcgttagttactgatattttcattttacctgtcacttcccacatttgaaaactttccttgtttgtgttctatttcacaaataaaactagtgtcataaattatggccacagtccttattttttcgtaagtgggagtgtggctgaaagtgaatacaagagcaagtgatagacttgacttgcttgaatatctaccaggatgcatgcaagattcagtggttactccaaaatatttggttttgattttaaatacctacatcaaagtagagtttaaatctctataaaatatgccactttacatactttcaggcctctttaatttttagacttcgtaagaagaggttctaattttttgttcctttttgtttaagcattctcattgtttatttgaaattgtttatttgaaatcaacaaagatcacagaattttaaagtgcacatgtcaaagatggtggatactttctttgttcaattagaagcaaaccaatattttttgtttttatttgttgaacattacaaaaatatacttaatagtctgcagaaatgctttttaaatatatttagtttatttttattctgaatcagaaaaaaagaataagaatcaattactaataactgaatcatgttgatgctttaatttttaaatacatagtttaagtgatgttgtctttttcttgtaatgaaatttaacataatgcattgtgaagtgtttataacattttataaaaggagaaacctataatgttctggatattatgtagcaattcatgcattgcttacttttgtttattagcaatttaatggcacacttttcttcagtgttgatttttattattggcaaatataagcatgaaaactaaattttaaattcatttcttctttaaatgttacacctctgaatatacccaggtatgggcatattttataaagaaatatgtcagaattttggtgaaatagtattttttaagtatctccaagagagataactgaactacattcagagataaatttttctgaaaaaaaaaaaaagatggtcatgttcatcccatttcttaattttgtggtcattgctttggaagtcaatatttgaaataaaatcttgtgagtaacaaactgagaaccagctttcaatgggattgctcattcatatatttatccactaagtcattgaacaacttttgagtctggactatctgcaaaatactaactgttgggtgctttgtaaaattgggagatgaaacagtttaggtgcttctatcaaaaattttagtggagggaggagatgttacatgaatacttttactattagatggaaataggaaagtaccattaggaaatacaggtaaatcactacaggattccaagaaatggaaagataatttcctattaagatattaatggaaagctttatagagaaggtccagagatggaaaattgtttcaagtttacaagcatcttctttcatagctgttattcatttctttctagaaatactttttcaaaagggcaggaaagtacaaagagtaataaaacacacccatgttgacattgctactttaagtgaccacacaagaatgagccatcatttccacatccaattttttcctggttcttccggggatatcacctttgggaaatgatatttatcatggttccaaaggataaataaatgaggagaatgtcaggttcagcaaagtgtggccatgtttttttttttttttgatctatctactactttaaagtctaagtacaggatattttaatgacttataaaaaagaaatggggtggatatcacagaagactctaacattagtgggattcattgagttttatctccctctccctttaactctccaattcaatgaacactgctaccttttcataaaatttatttacatagaccatttatatcagatcaattatctgacatctcccaaagttctcttcatttgggggagcttgattattcctggatttaaaacactccccattattttagactacaataattttttcttgatgttcccatggaattttatatgtctaatatgatccttctacatatgtatattttattgatccattctcacaccacatctgagagggcagggaagtaccttattttatatatacatacatacataaaatattggtagtgtagggaaaataagtgatccttttctccaggataaggaaattagaaccaagacagagaggaaaaggtagatcaattaatgaagattagtgcttccaactggttgttgtagtagaatgtgagggtggtaacttttgagagaccagccagtagtcatagtggcaagcaaagatgatcttagctgaggtgaagagaaggaaagaaaagacagagaaaatagggaacttgtaacaaggaggaggcttagataaacactataatacttaccatagttgattagcaatgtaccaatgaggaatttaatatagtcagtagaaatgaagggagattaggaaatgtgaatgcatacagaatagtaacggtctccctgtaaatgtgaaaaagcaattttctgtgataactataaacatgatagtgatgatgatgttgacaattaaaataacggtgactgttaagaagatagaagggcaaaatttgaccaccagaataaaatcaagagccaaatatgggccactgaggtaaacagaatggttattctagaattcttattaaatattagcatatttctctgttttccttgctgccctgcattggcaagggaaaaagaagtgcataagtataatttttcttattggaaagaatttttcctgtatactttcaagtcagtaaaatattgcatgtctattccatattcctgatgggctttgaaagatgtcataatgggcatatatataagaaggaaaaatggatgtaagctagaaaagataaccaccagaaatgattcagacttagactctgtaattgagagacattcttagaaactacagggaaaaaatagcttttctgatgtgttgaagcacaagtgtataaacaaagtcatgagtcagagttgtcaattgaattttatctataagatccatagagacgtgtttcagatcttgtcaaaacatacatttaatgaaaatcctcaattcagataaaaacacaagctatatccattcacaattacctggttctgaaaccatggtaaatgttgattctatatcaagagatgaacctctttccccacttaggtgatttgtctcattttcagttgatttatcatggtgttattccatcatcctatcagatattcttctgtcagtattattgtatcttgaaaatgcactttaaacattaggcttttaatgaaatgttcaaatctgggcaaaatgcattagttccatttctttctttttgaaacaaagcctttatctattttaatgaaattttctttgaaaataaaattaacttagcgttacatcctagttttcatcccaatgtgaataaatacatttcactaaaacattctttttgggatagaatctagagtagataatgccaggagataattattcattccacttctttgtgcctgccatgcacactatttttttcccacatctagagacctaagttagaaagtgtaatgtgtgacattaaaacctacatttgcctgaaatatgtttttctgcaatttccaaagagctagcagttcaagaggtgtttcaagtatcatagatccacttccatgaaaccagaggttttcagattttgcccctggaaaatgatcatgtctgtagtcaagtggagctaaagttcaaatgttgtgaataccaacccctgtagaaggtgcttgagcacaagcgtccaccagggacacttggaaagggtgcttctttaagttagtgacaatgcaaccccagcatcgccatttctttgatcagcctggttggcatcagacattactatggaacctgagaaagaagaccaaaatgcttgcaagtatcagaagcattgtgcctgagtgcagaaagtagcagaagcctacaggcacctgaaaaagtaacttcatggccatgctgacattgtggttttattaggaaatacagacagtaattggttcaattataaatcaccttggaagtgattatggaattatctggattatctgcttgacagttaccttcctcacagaagaattcttattctcccttaattctaggtctcccttaattaatcaagaggcctgaggtaaatcactctttaatggctgagatgaaaaaaagccctaatggcactaagcccacattgaaaaatatgagagtcattattaaaaagtatacagaaaaaaagagttttcaggtgtctacgaatgtcaagtatgagtcagagttgtcaattataaaacttttaaaatgataagaatacagcatatgattttttgagacattatcttttaattatgaaagcagtcattttaaaatggcctagaactaagcccaattccaagacagttgacactcccattagggcaattactcttggctaaatacataggctatagttatcagtgggaaccattcattgaagaaattaaaggacaactaagggagaatagaaagaaggaaaggaagaatagatttattttaggacaaattattataaaattaccttgcaaagtacatatagcatgggggactatgtatatattagtatgtctatatatatgcacaaatgttgtgtttgtatatgcaatagaatgtccctaaaagatacacaaaagagtggaaatatcaggtgcttctgagaaaggtgactggatgccagggagatgggtaggaagaaaagttacttttctctgcatgcttcttgaatgctcatcattatatgtatttccaattcaaaagggtaattaattgttaagcacttctagagaggtaaagctcaaggaagcgcctctcttgggtagtatggtccatggtggcagattagagtcagtgtcactcttactttaagtgcagtaacatgcacgtggcctgatttcaatagtacccaagcccttgaaagaaatcccttgtccaataactattctaacctagcttgctattataatggctaaaattacagcactgttgcttctgttcttggattaaagattttatttcatattaaaactacttgatggaaatgacagtaagcccaattagtattttactccataatttgaatgagagtatttggttgtagtctggcactggggaagaatattgatggtgcaaggcattataaaacaaggcattataaaacattatcaataaggaaataaaatattgtttccttattgaaaggaaaggctgggagtaacaaagggaaacatatatgatagtttcattcagagacaatattgatgaagatttttgaacatcaaaaatcactggctgtgtcacaatttattatacaaatgtgttggttggtgttcatacagcttttgtgtgctgtatgaacaccaaacaacacatttgtatatactaggctcctactatggacccacaaggtttttcagggatttgaagtggcatcaagagggcatctacagcattctaatgcaccctggtaaagcatattgcaataagtttgtcagcatgtctttcattccatggtgacagggtagtatagtggaaagagccctgaacttggatctagaagacctaggttcaagttctggttcagccatttttgagaaaagatgtcttcacctatctgtgcctcaggttttcttctgcctttacctacctcacttgggttgtactgaggatcaaatgatatcatgagcatgaattatttgttttcaactgttactattatacagataatttgagttattattgcaattccaccatttttctttcatagccaacacttactgtgtattgtgaaaacagctgcttgattttctaaatggaaagaaacaagttagagaaattcgggcatcttagattcctaccagagtaaccataatgtagaggtcataagcctcagttggttttccttatattagttcagtggggaaatttccaacctgaaacggctatttcatattcctaaatataaaacaatgagggagccatttgtgggaaggaattatctttacccattcaaatcccatctctgattattttcttggactcattttaaaaaataaaccaaataagagaaatagaacaaatttaacttagtcctataaaggaggaccttaaatttaactgaagataatatgactgccatttctgatgtattttcttgtccagttactatagttgcaaggttcactgcacaatagtactgagatgatttcctattttagaattagtatttaaaagagagcatttggtctcacaacatggcaggttaagcgtaccagaaatggaagcccataatttagtctttgagaaagtactgcattgctccttggttgattctgggcgaccccatatccttaattttcattattgaatgaacttaaatattttatccttagtttatagaccttgctggtcctccacatcctgaaggataattcagtcaattttgctgataatctgagacttaaatggcatcaatattcaggtctcttggtgctcaatgaatggacagtataatgtgttcagttggggcagttaggtttagagtgagaaaaaaaataagtcattagtttgttcttgatggtgttggatatttttcttggtgtgttgctcagacactgtggaacagggtcttaaaaatgtaactatgtttgacgaagcctcaataacaaggtctttggaagcattctgggctccctttggaattaacgcctaggatgctgtcctgactgttgtatgaagcgtttgctcattgatttctttcctgagagagctactctgcacacttatgactgactacagacactttcagccatgcagaagccactaaagggagcatatgagcaaaaggcataggcctcaaatggatattctaatgtgtgcagtacatgtaagaacaaagtcaccaggttactcacttggagtctagtttggccagccaaccaaagtggttatgaggtaaatacaagagagaagctggaccctttctttgactcatgctatggtttgtgtatccaccattccattattaatatgatacaccaaatagtggctctgtatactcatccaaagggcaaaataaattctggattcagtaaaagtatgaaaagtccataggcaattatcatttgagaaaaggcatcttcacctatctgtgaagtatatatatgactggataagtcttgttttctattttttctttttttctgatgatggtggaacatattttcttgtggggaagaaaagccacacttgcctatgcactgtcaaagcaatagaataaatttgtggcaagggagcataaatgtaggcacaaagaattacatgtaatggttttacatctttatagttgagtctaaaaacacagttaatttgttaattattttaataaataattagtgactagtcaccatgtgccaggtaccattgttaggtgctaagtatagagtggtaaatagaaatttaagcttttaaatgtcagttcttactattactatctcacttaaataaaaactggaatataatttgtaggttgaatgcttattatccaggatatttgcaggaaagagaccacacatttcaatggtgtgagagaaaaaaacaacccttaaagggagagtgtagtattctgggactatcaacagaactgaagaagcaagggagggagtgattaccagaacctggtgaaggcagctatacagaagggtcacctaatgaaacctgtggaggaatgtagtcaatttgtgctatcctagcaggaagtaagcctgggaataaatatccagaccttgccctcctcctgttttccattctcctgtggaagcctttcattagccagattcaactaacagtcagagagcaagggagcccattgatacaaaccctgaaggacagtttcctagggtacagagaatagaagagaagagaggggttggggtggggaaatggaagacaaccagcacaaatgtcaacttaagagcaaactcaccccttaccattcaggtggttgagcagacatctccaacactgatgacaaatttagtaagccttctttgatcagtctggagaccatttggatatattatcccaatagataagtgctatccccaaaagcagagaagagagagaaatatagtgtaatgtgattgttctgtctcctaaatagaaaacaggaagaggtgcaataaatggattggagtatacgtgtgtgcgagagaaagagaaagaaggacggaactggggagggtgcaaggtggggaggaaagggagggggcactagaaataaagggagagagacaggaagagacagaggggagagaaagagagaaaggaaaaagagagcaagggatagagagagacgcggagggagaaaaaaaaagagagatcttcctgtggagcttacgaaaataattaatacagtttcctttctgtctgatttaacatatttgctaatattaatgtgcttgtccctacagtaattccctccaggctccccatgctgggatgtgttgtgggtttggatttgagcagaagatttaatgccaagtctctctggggaagcatttttgagataaattctttcccttcatgctcttctgctctgcatagaccttgagaaagggtgttagaagaaaagattgggtaaggggttaaaaaggcatgaagaccaggggcagagtagtgtgcatttccaggaaatggagagttctgggaacagttgctcatttcccactccttggctggtttgattatcacacttgaaatacagctactcatcttggcaattctcctacgttaggaaaagcccaggactactttaccacacaatttttacttcatttttaaaccaaacatacacagaaggtaatacaatgtatcttcttctaatttatttgcatttaaatacttcaagatgttgatttctaataaccacttcatgaccaacaagacagtcaagatttcttttatcaggctttctattagaaaaagcattttgcccatttcccaccacccaaataaatgtattcagaaaacaagggatccgtttatttatatttgaatctcagagtctctgaaaagtgaatgaggcacacatttggcaaaccaaacttaagttagattatgtgattcaggaaaatttataaatataatgtacggtgctgacaatggatttctcatattctactttttcctttgaattaactctggtttattacataagtttgtatatagtatgccaaatcaaaggatttaggatttaatactaaaacaaattaacaaccaaccagatgtgtttctcaagccatgtttttcagaagacctgattcaaagccacctgagagtctggttaaaaaggcaaatcctgggccccacacctctccatctacagaatatatggatgatgggatcttggagtattcattttgtcaacttaaatctataaatttggaaaaggaaaggagactttatttcttgtaaagggttatagtctgcaaagtgaccatcctgcagcctgggaagcatgtctttggacaagaccagagacaggcacttcaaaggaggaacggttggtataggagctttatgttgaacaggttggctaaacatacatattcaacaggttatagaaggctacgaatattcacaaaggtggttctgatgcatgtgtataaagcaaacatgcatgtaacatacaacccatgttcactttgaggtggagacttaacatttaaatgtcttacaattagggcctgtatgtcaaaaggcctttttaggacacagaggcatgcaagagtgatctctttaaaccagccagaatcatcagtccatggttggtggtcttcttattaggagaaagttactgacatcagtctcttgtccggtcaaagctgtagttatggttgatggaacaggggatcagttagcatctgtgaactggatgagttgtaattgttttaatattgcttatcttgagaccagtccttatttaactgctagagaagaaaaaaaaaaaaccctgtggcagttagaacatagtttattctttaagtgtaggggtgcatgatttaccccttgcctagcatggtttcaggtcctgtatataatttcatatctcattgccacaaagagtctgttctgtcagtcttatgatctctactttaacattagtgctggtcagttgttgtgtctaaacgccaaaagagaggaggtataatgagttgtgtctaacctcctgtcccattgtggctgggaactcaattttaagatttttctggagtccccttggctacaagagggcccattcagtcagtaggggcttaggattttaagtttacaactttaacaaagtcattactccctacaggttaagacctacaggactagaataagacatttttgcccttatatcagaaggatgataccttctttatagtatttttcccaagatcctatgtgcctatattgttttacgaaatgaagggggaaaatcccacaagagaaaaaaatatctaaatcgagactcatgaggcctgattttaactccagttttgacaattatgacctggagcatgccacttaacctctttgggagtcactcttgtcatctgcaaaaaaaaaaaaaaaaaaaaaaaaaggacttagaacaagatgtctctctacttcacttctaactttgatggtccctggttctaatagtctaaattaatatctttgggtatatccttttgtaaattgttgactcacccagagaacttggatgcacccaatcttcctagataatgtttcctttcttggaaattattaattctgtccagcatttttaacagttgtctctaccttatttcaagtcccagtatttcattcagaattgttattgcagggaagaccctggaaacttatgaggagattactgaagaaataagctattacaatttttgccttgctcttggtttggaggtagcaaattcatgtacaaaggctgcttctgggaaatgtagctaccaagtttctttaattcagcatctggccaaagatgtttcccaaaactgtagtccatgaaatgttctctaagtttttaaatgtaaaataagtataggaaattctgcaaaacatcctctgagagagacttaatatccattagcatattaaaaagttgtgagaaaatatgtagtaaaaataaatacacaaataaatattttaaaaacttttttttacacaggggtttgcttgatattcacttgatcacagattccttatcatgagtaacatcctggagaaccagtgttttatggaatattttggaaaatgtagttttggtaaaatccagaaacctaaacaaattttgccatgaaaatagatgatggggaacttaaacatacataaaatataataatttgccagaaagagaatattcataagagtgagaagggcccagcattcagtaaatgaggctttcattttgattcatggtcaacattagcattatgatgccacaagagaattactctacaagttagaatattattgcagtctatttttctcctgcttcatctacatgaataaataaacaaacagtggcattttgaaaagcatagagaaaagaaattagtcaatacatcaaaatacttggatctaataatcacctactgttttagtctttatgatttacaaaagctgacaaatatatacatttaaacaagtgacctttaaccttgaattagagatatttcttcagcagtatatgacaaagtttcatacctgtatgaagaattttcttttggattgctatcttctttctcaggcagctttcaaaaaatgggtaaatcttgtagttgtgcaatttccactcatttgctgagaatagtttttccatcacttccttgcaatgaaattttaaaaatttaaatctataccaaaaatctcatttaaaattgaaattatgcaatatttatcttaacttgtgcagatttaagattaacttcctatttattagtattaaatcactctaagtttctctgtttaaaaatgataatgtttcatatacttcaatatataaattccaaggaaaaactattgaaaattgtttgcaatgaagatggatgcagaaaatgaaatgtctttgaaatatcactaaatgtcttggggaaaggatgattatatatagatattcttaaatataatatatacttttaaattactagttcctcctccatgctttctctgagagtgtttgtcaagtaagcaagcatgattttttttcttccttcttctcaatccaagctcttaggaagagataaataacggagtaggggtagggaaatagtgatgccacctcagacttaatcaatggctcctgattcatgtcatttattttacacactaggtgaaaacacattggtgatggagcccctacacattctatatcaaactaatcctttatttgagacaaagtatccacagtgatgacattagcattgctagtattccactgtacagcccacagataatgggataccaattgtcttagtgcattttgtgttgctatgacagaataccatagactgggtaattttgaagattcgagatttatttcttacagttctggaggcttgggagtccaaggctgaggagtctgcatctggcgagggtcttcttgctgcatcatcccacggtagaaagcagaagggcaagagggcataaggaagaaggggaaggggactgaattcatccttttatcaggaagccattccagtgagaactaacccactcctatgacaatgacattaatccattcatgagggcacagccctcatgacctaatcatctcttagaggcatcacctctcaacattattgaattggggattaaattttcaacacatgagctttgggggacacattaaaaccacagcactgattaagtttgtcttttgattgaggttggcagtcttagatacactgcatcttgaagaagaactgaataaaggttaactataaagaagttatttgggcatgcacacatttgcttactttgagttcaaattttgttttatataatctgagtgcctgacttagatcctttgctatcatttgcttccagggtcacagcttctccatttccaagggacagacggtgtcattagatattggggtatgagaaggtggctttgctgaattattagttatagatgtcaaggaatatgaacaagaggataagattttctttggaatcctgagatttgctttccaaaggaagtatatacagtgtgttcccaaaatataaaaatttaagacatcatccctgtttgaaaggaaatgttacatatgcccagggtcatgccttgtgaataggaagccctggcactgaaaatttcacttttttcagaggcctttttaaatagatgaatgccaggctacctgttctctccaaaatctaaggtcacagtttgttaataaggttgccatactattcagtatttattttatctgaaatattaccatttcatttcctagaatccgtgcccactctgtaaccagtggcatgcttaacctgatctttatcaaactaatcctatattatcagatgtatttctctagctctcccaacataaaaggaattatccacagtctggaatatgtgttccttttatttcccccaagtttctgactcacgtttgtttatcatgcacatatgcctcatttaagtgcatcctttaatcaaatattctgagcaaatattcccacttaaaacccagcaggcggcttcctgttccatagatctcctgaatgccaacaaagtttataacatgcagggctttccgcagagtgtatgaatttgtgacttggggcaaatatcctaaaccctattaaaaaaaagatttccttggcaaaagaatacacttatctcaaggagaaaactccacgattctacttgtcaaccagctctgcaaataggataattacacacgtgggatttttttttttttctgcctacagttgaaactgggtttgcaaatggctcctgggtaaaaagtattctatagcacctccatctcccagaatgagttcatttaagaggtgccaatgtatagttaacagcactgtagtttggctgaaggaatctttgtgatgctcagtaagagtggattgacatgtgaagctttcatgattgagttattccttcatcatggggcctctctcattcccccacatattgaaaagaatataattattacataaaaatttggagccatgtgctaacaatatgtgccataataaaccatgcatacataaagtctcaaataagcaggtaccctctcagtgtctaacttttcatataaatgccagaataaattatctgcttcagtgatagagcaaagcacttgagggtattaacaaaaagtatccatcagtgacatcatgtaatatgctatatacatcacagaatgacacctttaaaaaatattattgactttagatgggtgatgtggcaggtgcaaagaaggcaaagaaataaagatgacataataaatagatcctaaaggaaagctaagatcaaaaataaactcctgtactttttttagaaaatccatagtgcagctgctctggggtgcctgattgcctatatctttatctgaatgcacagaaaaaggaagctgagctgtcacccaagggagtgcagagctcaaaatactagtatccttgatattctaggtctctcatgacccttgaaactctcctaggccttctcatcatttttggataaagtgcttgcacttgtacatgtctcacaaagatctctgtgtttaggttctttactacatctgtctgaggttgagtttccaagaagcagaccctgtgcaaaagagatttattaagaataagcaatcaggggagacatataagagagtgaggaaatgagacaaagaagtgggaaagccaagcatctatattgtcaatttcaacatcttcattccacatctcaagccacaccttcccactctatgttccagcctcgatgccccatttgccattcctcaaaccttttatttctggtgcttggcacttgcatttctctctaccatccctgcctttccaacagcttactctctactctgacttcaggttaatgtcatttcctctagaaagcctctcttaaactacaaatcccaacctttcctacgtgctcagtctagagtctatcttgtgattagttgcttctctatttctttccatcctagactagttcaagaaggttaggattgagcttatctcattctacattgtatctccaacacgtgacagtaggtaggttgtcaatagacatttatcaagtaaatttaaaaattgataacactaatccttaatctcagaatctgtaccaatgcaaacttgaatattaagaactgaactaagttattattatctgctaattattgtgattcacttaaaattcatgaagtccctccatatgtatcatctcatttgactcctcactgcattttcttgaatagaaaacagccagaattttatcattcttgttatttaggggaagaaaaagttatcctgctgccaaataggacttggacaaacactacctttccttatatataacctaggatggaggggagtataagtcattagaaaatgacaacagggacactcattccccatctgcaatactttattgaatatatttgtaacacagctgctgccctttctattacaggttgaattgaatttatctttgaagccccaggtttttgtgcactttctgtttatctaggagcttaataaatatttaatgttgagtaagtggatttatttacatgtagacatgtatcacgcatttattatgcataggacactgcgctaagtacaaagtagagggtgattcaaaggagaattgttaacttatcagcattctaacctgcaactttactatcccaccttcttctactttaccactatttcagtaccaatatcccatttataaaaagttttcttttccatgcctaataccgaacatggatggatagtgacatctaacttatccaaatagaatccctggcctaaggcactctcctactcagtgtctgcagtgttcagtaaataaaaccaaaggcgcataaatcatacatgttgataatattggatatacctgaattgccagggagttctgactgctaaagtaatttcaggttcacttcatggttatggcccatacttccttccaaccagtgagtctgtggttgggcatcttctgaaattctcctcttgagcttcatcttccagctttacaaaaaaattgagtagttctcaagtacaggattctcccagattatgaggcagtgaaccaaaaatctttacaaaagactaggggggctaactaaggtatccactaatagtgatgacctttatttttctctagagggcccgtggtacaggagaactcagttcactgaggaggaaaaagaagtagctctaggctttataaaagaggaggtacttgaatttggtattgagagcaaataggtgttcaatgaatgaaaaggggaatttcagatagagaactgtccatgtctggaaagaacattgctagtttgggggataataaaagatgagtatctctagaggaagtgaaagggataaatcatagaagataagcctacagaataaagttagttaaggccagaatgtaaagaagattattgaagcatagatttaaccacaggtaacaggaaggcaatcaaggtttttaagcagaagaggagcataattacataagatttctaagaagataactcaagatacctttcaaaggatatacgaaaaaggtaagggaccagggttccaggacaatcatccacaaaagagagatgatgaaggtttgggcttagggagtggcaatgggttagaaaacgggcaagattcacaagataaacttaaggtaaaattgcatcagacaagatgtagcgggtacaatagaaagagtaatgtttgactcaaggttccattttgagcaactgagcagacagtgattttgtttattcatgtcagggacacacgaggatatctaatctacagttgaaaattttaatctggagccaagaacagataccagagctataaatgtaggaatagtagtcatcatataatgacagtattgctaagatcacccagtgagaatgtgtagaataaatatagaagatgaataagaataggatttccatgagcatgaacattgaaagaataagaggaagagaaggactcaacaagggatacagagaaagagtggttagaaaatctggaggagaaccagaaagagatgcagtcattgatattaagggaagagggagttttgcagatgaggaaagcaaccacgacaagtgcagcaggaatgttgagtagaaagaacaagagaggtcattggatttgaccactgggacatttttgaccttagcaaggccaatttccctagagtggtgatacaaaagcccatactgagttggtagagtaaatgagatttgagaaagtggggaaaagtaagtctgtagatttatcgtttaaaagattggtgccaaagagaaagagagggattgaatactagattacagaatttgagggaaaggaggtttttttttttttaaaattaagatgagaagggtacatttgtagaataaaggaaagggagactgaaagtacgagtgagatagaggataattgatggaggagagttctggaaggagcaggaggaatcaatctcataaggaagatgaagagattacctttgcactgaaggaggaataccatttccttactctgataataagttttacaggtggaggggaaggtagtcagataagttcacatccaatgatctgtattttcttggtgaagtagtattctgtcatctgccacagaagggctgctgccacaagcatgggctggtcctgggcacagtcaccatgaagctaaaaaagagcatcaggcccttgatgctttgatacctgccatctttgccgccaggacagaccacaaagattcaaaaagcatttaaaaattttaaacacatcatgaaaacagacttttctaaaaaaaatttatacttctcagttggcttattgagtaggaagatattttatgtatttcaaacatatgtcccagaagatcaagccagaaggtattatgcacaattctcagacaaaagatgaacagaagtaaagggacttagtgtccaagttatccatcagctcacttcttagccagtgctttattcctcactgcacccatgcgtatatttcacaccattttcattgtaggaactcagaaattgttaataataacattgttggtttatattaatgagtccttactatgtgtcaagcatttaagcactttgcatattaactcatttaatccttccaataaccttacagagaaggttattatcatccctatttcacagattacaaaatagaacagaaattgtatttggttgcttatggtcatacagctagtaagagtgcagaaatggcttttgattccaggcagtctagcatgagtctgccctcagtgctattagtgggatagtaaaaaccttaaagatttgtgttgttatacaccaagcctataatcatttcttaattacagccatgctaggggcttgtgaatctggaggcatgcctaaggatgtgtttattatttaactttacatcctcagatttgagcacattaataatcctccataaatatttgatgaataatcaaatgaatgagcaaagatgatttctctccaatcacccaacagctttctgcttgggatgtattggaactagattgtagatcgtggggtggaggtatggtaaagaacagttggtggctaaggaaaacagaagagatacagggactacttcctccatgggctacacattacatgactttgtctctgactaacggcattttgtaaacttttttttacatctttgagtgcaaatttgtgatgtacttaaacatatttcaagaaaatgctatgatataccaaaaacatgccctttcatatgagattttatctagtcctatagtttgcttctaaatagagtttttctccggaccctaggaatgttttcatttaacaatctcaaatcatttgggcatagtgagagaaaactgtaagtctgagacatgaagtctataatttattctcttattactttccaacacacatgaagagcccaagcttgctcagggaataggaaagggaaaagtctgggggctgcttgctgggatgatgttccttcagaactaaggagaatgctctctgaaataatttacttgttcttttcttaagcagaggaagtacttgctgcttatgtacaaattcaagttaactttgtagtaaggtacaaattaattacaaagtatttatgagggacatttatgatgtgcctaacgtatagcaactttgagaacttacagaagcagtgacaggcaacttttgtcctttagcaatgcatcatcttcctcagcaaatgaaataacagacataaaacaagtctgagcaacagaagccaactcctctctatataattgtacagctatatatggaattatgtcatggagattagaagttctgaataaggggaattgataatggccgaagtgtaaggaagaggtggaaaatgacgtgaagacttggagtatgggtggggtatgcaaaggcaatgtgttcctcatgatgtgcccaacaacatgttaagtgtgtcatatgcatgctctcatttgttctctacaaaattgataagtactactgttaacgatatcctttttccaaatccagaagctaatgttcagaatccttagagctggcaagctgtgagagacagagaagctggtcaaatctaggcagtctggtgctgaggcccacatactcagcaactgtactacaccttatggtggcctaggcaggctaatcgtgtctgcgtttgcaaatatacaggtcatatgactggagatgaatgttttgagaggtatgcatcaacccaagccaataccccaaaagactcttagtaggattcttcccctttgacctggcagaccttctacctccattgcctgagggtaggagaatgaggccatttctcatcagagggcttgcttttctatagtactgctctattgtgtctggtacaacacacaaaattagagactctttaaagcctcaacaaaccttgtctctagcatgaaaagatcatgggtaaaaaccctattctgtttcattagcaactctcatgtcctcaaattataaccctctcaaggtcccaaggtgatgtcactgtctattatcatgagcacacaggcaatgatggtgtctagtgggagaatgacctcctcaatttcaagtgtgaactcaactatgatgaatgagaggaggccgtgtggcttcttcaatcttggagggacaaccgtattcggcttattatcagagattgtctcacattgagatggaggtagaaatatgtaatatcaaaatccggacatagaacagtttctccatcacctcaagactgtctaacaatacaaaatgtggtggccttcaaatcagagaaaggatatgcaataaagagcaattatgcagattcagccttcaattgctgattatactttggctagtgatatatactcactatgaaatagagccatatcttccccctcctctgcacatgaagagatacatcaatcccttgcaaagaacctctgctctcctttccctttctctttttctcatgcacaatttgttgcctcctctgccatgttcccttaaacactattgttattatcacatgacattgtaattagtctaatccatgtctttctgccttgatagatgatggcttttttttaatgcaaagattcagtacattttggtattcccaggagcttacaaggcatcagtgtctgtgtctttcccatatccccggtcccttaccacatcaacctgacttctacatggtagcagctgcatttcttcgttgagggcattctctgatccaagccattttgcccacccttgtggcagaccagaattaaaggtgaattagtgtctcctgagagtactctcatccaatgactggtggaaatcaatttaacatacaccagctccttctccccttgggcagaatagctctgaggagtccttctatactggcttccagagttgctcatgggacaaggcttcatttgccatcagaaaataatggacttattaacacaccttttattgtttgcctaacctgtcttacttcccgacgtctcatccagcatattacttacatccctaacaaatgactttcacctaaatccttgactcgaggagaacacaaactacgtaagcacccaatatacagaaggacttcaataaatgtccttttaataaaattgaattacaaagatgcatagtgtagcatgagataaaacgtggaagtgctatgctacgtaagtgctgggagcctatcagtcaaatttgagcacttgtaaacacaacaagcaccatgatttcaggatttccctttgcagtgggaaggcggctgtcctagttgttagtagagaagagtacattatcggaagctctggcttctatttttagacctcttgctgacatagaaaacctgtttcctaacagtactgtagtgaccttcccaccctcagagaaatggtgcagaatgcctaaggaagaaacaagtccccatttgtggaagccacagaggaacagaggagggaaatgagagcttaggtactattcgttggcagacatggtgctttaagatctcttttgacagctaaatagaaagtgctgggttgcctggcagtgcagtggccttgaacaggatttaggtctccaagctgctaaagcttggctctgagcccaagatgtccaaagagcaataatctctttcttttttaaaaacctcacatgaaaaaataattttccaaaataaggtaaaatcatgactcttacacagttatataattaatacatgttaaagattttatttaactcattagtcaatgagggaaccaggcagatggtataatcagttcaaaaaaaacctcaaagaacagacacatctatagataaaaatattgaaataaatgtgcaaatggaggcaaaattagcctcttccacagtgggggaaggaagtcacttgaacctctacaggacagaatttccatacctataagcaagggatattttgtattactattagttatataatttgcagagttttaaaatagctcccatagaatcagagtctgataacactgaaaggtatgctgtatggacaatgtatagttttttactgaagcataatttttccctacactcacgatcgtttgatttaataatgcaatatttctccaataagggggaattagactttttactagagcttacttatacttttaaaatccagctcattttcttaacactgtgtatagggatgagagtaatcaaatgcagggcagagatactatgcttgagaaaagtacatctgattgttaagaaaaagatctcaaggtttaggaggaagatccttccttgataggggaaggaaagagatggtaacagaaaagaagtagctgatatttcacatttacattatctcattcagttctcccaatgaacttgagagttaggtgaagatatttctccttttataagatgaggaaatgggagcccagagtaattaagtagcctacatagggtcatacaaatagtatatagtagagccaggatttaaacccagtctttttagccctgaagtttatgattttcttccattatgccatactgtactggtaaaggatgatgttaggatggagggcaacggttaagactttcctgatccccacctcaaacagggcagttcagcagtggtatcgaagaagcatgtagcagtgtttctcattggtgattgtcatatttttgtcataattttctcattctgttgagtgctctggagagataaacagaattggcttctgatctcataggtttagcttaaacatttgatttaaatgaattactttttgaatgaattactttttgaagctgaagaaatgaaggccgattaactgggttaaaatgccttaaaagttgttctgaatcagatttcctgggatgccactaaaagttccttacataaaaatggcttatattcttattaatagcatttattgaacatttactgaatgcctactatgtgctcagtactatattaagtgccaagggaacactacagtgaatcgggtaaaatccatgccctgtccagagcaaactagaaaagattagacacatataaaagtcgaccataatacaataagataagggttatagggttataggaatgctaggaaagatgatattcatatagggagaatcatgcaaaatttcatcaattaggtatcatttggctttggaggataagtttttaacttggaaacaaatgtgtatatgtgtgtgtatcctatcagccaattccattatcataactccaaacatagtatagtttcttcttaaaaattattaatgcaaaaaattctatttccaatttgtcagggcctaacaagttggtgaacttgttattcatagtagaggattcaattaacatgagagaaagtcatctttaattctatttttgttacttcctaaaaggaaaggatatgtcatttaggttcatgaaaaattctcaggtctttatatttcaaaactaattccaaatggcattcaaaatcattttcttctaaggctaaatggctctttatttattattcaccccaatcccaaatagcaagaatcccatgttttccagcaattctttgatgacattttattatagcataaatagaaatatatgtaaattattcttacaaattgttctcaacctgaaggttccatttagcctctgagatctttaaaataggaaatgaagcttgttaccacaagcaaagtgttctgaatctcccaaaacataaactgttcactttaaggtcactatgatcccgcaatgaacaaaaaagcagcagttcacttgtattagaaaaggcttagtaaaaatgccctctctgtgatgcttggttgggcagacacgttttgtttcatctgacatttcttgcagagtgactcaagagctattcagcaaattgtttctgacttgtccttaatgcctgattttcttttatttagcaccacaatttaccatctacttgtaggtcataagtagtagaagaccaagtatatactagacacataatgggtactcaataaatatttgttgatttaataagcgactgaggatttgtaacatgaaaatacacagaattcagcaaatgtctgcaaattcagttttctgattaacaaactcaacaaacgagtataagttctattatactgccatgtcttcacctaaagtatttctttttttttttttttttttttttttttttttgagacggagtctcgctctgtcgcccaggctggagtgcagtggcgcgatctcggctcactgtaagctccgcctcctgggttcacgccattctcctgcctcagcctcccgagtagctgggactacaggcgcccaccaccacgcccggctaattttttgtatttttagtagagatggggtttcaccatgttagccagggtggtcttgatctcctgacctcgtgatccgcccgcctcggcctcccaaagtgctgggattacaggcataagccactgtgcccggcccacctaaagtatttctaaatattttttaaaatccacactctttgctgaaacatgtgagactttttcataagaaagccatatgaccaagaaatattttaatatgatactagcatttgtttggtgaagcagaagagtaaactgaagctcatttcattattacataaaatgtgatctttgttaaataaacttcctactcatcctgcaattttaccttctttttataatttagtggttatcaactggggagattttgtctcacagaggacatttggcaatgtttagacacatttctgattgtcacaacagggggtgtgggagaagtggtgctactggcatctagtgggtagaggagggggatgctgctacacaccctgcaacgcacagaacaactcctaacaaaagagaatgatttagtccaaaatgccaatagtcccaaggtagagaaagcctattttaaaaaaagaagctggctgcaataatctcaaattcatgatggctacatgggttttccagacatgaagaatgtttatgcataattcccagaaacaagaaaggtataaaaggtggttgggtcctgccaagaagtcctgtaaagctaagaagaaaaaacaaaacaaaacaaagtttacagagaaaagagaatggaaataggataagatgggcattatttcagtaaagattggcatagaggatattggaagatctaagttgtagtctccaagatttcagtttatattaaaatgggtttgacaatgtatttcctacacaggcatatttttacaatccaatgaacgcacaataatgatagtaatactactaccattactataaataacagtaactacgatctattaaggaaccattacatgccttccatacattattactaattatcacaattatcatcaaagtaagcatcattatttctattctgcagaattaacaggctcagagaatttttggcagctgtttaaagttgacaggtggtaataatcagagttagtgttaaagataaaacagactagtagccaccatacttcaaatatatctttaagtagtatgacccaaattccaggttttctcaggactgccctggtttctgcctgattttcctgtataattattaatagcactcactttctcttaaaagtgatcactctttatgagatgatggattctctcttttctctttaaactggagaaatccacatcaggcaaatatagaaacttgctggcattctcaaagccctttgacatgtatctgagccatgtgtttatttgtccatttacttatccttgtgtgggagcagttgacaactggtggccatttgtgggaaggactcacagaagatgctatttggttcttgatatttaagctaccttaggtgttaattaattgctttgtctagaatttttttttttttttctgagacagagtctcactctgttgtccaggttggagtgcagtggcatgatctcagctcactgcaaactccacctcccaagctcaagtgattctcctgcctcagcttcccaagtagctgggattacaggtgcccaccaccatgccaggctaatttttgtatttttagtagagacggggtttcgccatgttgaccaggctggtctcgaactcctgacttcaggtgatctgcccacctctgcctctcaaagtgctgggattacaggcgtgagccaccacaacccatctgtatggcaattttctaatttctatcaacatggcttgtccaaagcaaatggtttttgatgagtccaaagctgtctcatcaggctgtgggaatctgtaaacatccagcatgtttacttctctgaatgttttaccctttgcacaaacctggaatgtcagcaaacaagctgaatgcagtaagactggtaaaaccatttgcgtatgagttgagcagaagaatcgatacataatttacggtgaattttcaaggagattaaaacagcacagtggcagtgggttagattgtggggccatttcttttttttttttttttttttttttttttttgagatggagtcttgctctgtcaccaggctggagtgcagtggctgcaacctccaccccactgggttcaagcgattctcctgcctcagcctcccgagtagctgggactacaggcgcccgccaccacgcctggctaatgtttgtatttttttagtagagacggagttttgccatgttgaccaggctggtctcaaactcctgtcctcaggtgatccacccaccttggcctcccaaagtgctgggattatagacatgagccaccgcacccagctttttttgtttgtttgtttttgtttgagatggagtttcactcttgttgcccaggctggattgcaatggcacgatctcgactcacagcaacctccgcctcgattgtggggccatttctaattacaatcatgacatttaaaaaatttctctattctttcagattaaatgacttaaattctctctcataaagggagtgccatgaagaaaagtcattccctctcccttgtgatcctcctatcctccaaggctctctctttcatgggcatcaaagcaccatgcaacgcaggaagccataataagaaacagtgcttactcatgttcagatatcaaggctctgacccttaactctacatcttcctgcttcttctgtgtgctttattttccccctttgtctattgagctaatggcaagaatctttatgctagacaaaatctttttattctaaaggaaatttaatttctgtatatgtcaagcccatatatttcatattctattcccatccaagggccacacattaaaacaattgtggtacttgaagacacattaagttatttatgtgaaattgcaaagtgaaaatgccacttttttctatttgtgacaagagagaaaaataatatcatttccatcttggaactcaaagatttccctctgttctcaagtaggcttttaccttaaaaggacgctgggaaataactaaggagaactaacaaatagtgactaattgtcttggtgttacacaggataccctattatttcccaatgtttatttttaaatagaatccatcacaatgcttttcaaaaaataatatttggccaggtgtggtggttcatgcctataatcccagcacttcaggaggctgaggtgggaggactgcttgagcccaggagttcaagaccagcctgggcaacacggtgagacccccgtctctacaaacaatacaaatttaaaaattagctgggcgtggtggtgcatacctgtggtcctagctacttgggagcctgaggtaaaagagcaaggctgcagtgagctgtgatagtgccactgcactctagcctgggggacagagagagaccctgtctcaaaaaaaaaaaaaaaaaaaaaaaaagaataatagtaacatttattgtgaacttagaaatctgtggtaaatacaaacatatatatatatacatacacacacataacattaacaagtgttttaaaatatagtcattatgaataatagaaaacatttttgttatctaggttttgaatatgcaaaatacagaagtctcatgtatgtttatgagcgatgtaagtcattataataactgagtcgtatatattaagtatttgttgtccatattatctggcttagccctgtttcacttccatactacctcctaacgcttgtgataaatagtgttctgattcaggcttgatggtttttcacctgagcccactccagtgcatctggctccgaggccatcatttcccatccattctttctgctatgactttgttcatgctacagagcacaatatcaaactcattgtagatagtcctacaggcagtccctatgctcttccatgtccatggtcagtcctcatttcatctatggaaagaccatggaatttataataattcctgttgttctctagcctcctagtctgattaggagcagggccaggcaaagttggcttacagaccgaatctggcctaccacctgttttgtaaataaagttttactggaacacagccacactcatttatttacatattgtctacagctattttcactacaaaagcagaattgagtagttatgacagaggccttgtggcccacaaaggctaaactatttaatatctggccccttaaaaaaatgatgttgactagggcactgagtttttaagacagctcagccaggaattaataactttgtcaaatccagttacaaatagagcttttcaatcacatccataagttatatctgcagactagagaatcataaatttagtcttaaacttatagataactgggaaaagttaagctgactttactgattttcctcttctattgcctctctatcctaggtacctactctgcagcccaaatagaacatttcttccttggcaggagcacagagttttataatagccctttgattgcctttagtcctttgaatagttctattgttatcatctaacatatatattgttcaataagaatgttttaattgaattaataaatgaaaaaatgtggatcagcattttcaaagctatgttttgcagaatgcttgctatctttgaaatgtgttccacgaaaaggatggtctatctaaaaaacaaaaaaatctatagtcaaataagtttgggaaataatgacacacactatttattttcaggaacaccatagttcacataggtgtattaaagttttggagaaagggagggtgacatcaacaaaacggcacagtagacagctcaagctctcaaaaagagtagaaactgtcagaaccaattttgtcagaactctggaaaacagtcaaaagtttacagcaaccaaatgtccacaaaatcaagaaaaaggtaacttcgaaatggtaggaaagttttgtggtattcccacttgcccttgtcccattccctccctagtatggcagtagttttggtttaaaattggtagcagcctacactcctagtatggggccctggtcccttgatctggaaggagtagaccaaaccttattcacaaattattttgtgtgtctgttctaacctttctataggctaccagaaggacaaatgcaaggagtttatatttgttttctagggctaccataacaaaataccacagactgagtggtttaaacaacagaaatgtactttctcacagttctgaaggccagaagtccaaaatccagatgttgacaggtttgctttcttttgagacttctctccctggcttgtagatatctgccttctcactgcattttcacatggtcgttcctctgtgtaaacacatccctggtgtctcttttctccttttctcataaggacaccagtcatatcagattaggggccaaccctcacttaaacttaactaaccctttatagaccttatctccaaatatggttacattttgaggtactgagggttaaggcatatgaatgtgggggggacacaattcagcctatgacaatgctcatctctgtttttacctaactcaggatggaaaggcagtgagtattaattaaaaaaatactgcaagtcaaactaaaaatcttaaagggcaaaatattacaattgaaatatacaatagaccatctaaaagcttggaagtgaaacttagagtttcttagggaaattaggacattcaaaatcgaccatgcatatggcaaatttagaaagccactgcattttcagggaaatatgtgtgctcagaaaagacccgagcaaacccttagctttcaccttgggctgatccctagattcagttcaagcccagctagttgttgaagggctctggcatagagccaatctgcaaagactgggagagttatgttttgtttgcttggttggttggttggttgattggttgctttgtattttggccccagatactcaagaaaatctctcataaaattctagttgaacacaggctgagaaacaaagactatagtgaccacacatgagaaggaatattacagtcttcgcagaaatagttttggaaagtcactaagcaaatggcctactatacccttcaacagtcaaaacattcagcaaattctagagaaggtagataattttcagttactacagtatgataaatatacagttttcaacaaaaatcacaatgcataaaaagtaacaagaaagtattggccaattcaaaggaacaaaataaattgatagaaattatccctgaggaagttcagacactgggcttactaaacaaggactttaaaacaactgtcttaaatatgctcaaagatctaaaggaaaacaaagacaaagaatgaaaggaaatcaggaatattatgtaggaataaaatgagaatatcaataaagaaatataaattgtaaaaaaaattctgtatctgaaaggtaaaacagaaattgaaaattcactagggtagtttaacagtaggtttgagcaggcagaagaaagaatcagttaatgaagataggaaaactgaaattgtcaattctgaggagcagaaagaaaaaagaataagtgaaagtaaacagagcctaggataccaatgggaacccatcaaatagaccaatatacacattctagaagttccagaagaataaagagtggaaagaatatatgaataaaaaaattttgagaaataacagttcccacattttatgaaatatgtaaatctacaaatccaagaagcacaataagttccaagtagggtaaacccaaagagatccacactgagacatattataatcaaactgtcgaaagccaaaaacaatgaggacactgtaataacagcaagagaaaaacaactcattacatacatgggatccctagtaagactatcaactggtttctcagtggaaaccataagggccagaagacaatgggatgatatatttaaagtgctgagagaaaaaaaaaaactgtaactgaaagtttatatccagcaaaactgtcctcaacaaatgagggagaaattaagacattactagaccagcaaaagctgagggagttcattaccacttggcctacgagaaatgataaagggagtccttcaagctgaaataaaaggatgctaaacagtaagtagaagtcttatgaataaataaagatctccagtaaaggtaaatgtatgggcaaatgtaaaaacactattattgtatttggagtttataactgcacttttatgtcctacaggacttggaaagacaaatgcataaaaaattattagttgattttattgtgcattcaataaaaagatataatctgcaacaacaaaaacataaaggagagagaatggtgttgtataagagtggagctatcgtatgttattgaagttaagttggtatcagagagaatggtgttgtataagagtggagctatcatatgttattgaagttaagttggtatcatttctgactaggttgttataaatctaggttgttaaatgtaattcccatggtaatcacaaagaaaatatgtgaaaagttaacacaaaaggaaatgaaaagaaaatccaaatggttcactacaaaaaaaatcaactaaacataaaagaggtcataatagaggaaatgaaagaaaatccaaatggttcactacaaaaaaaatcaactaaacataaaagaggtcataatagaggaaatgtaggacataaaaagctatgagatattcaaaaaacaaaatgatagaagtaagtccttgcttatcagtaattactttaaatgtaaatggattaaacaccctaatcaaaagacatatactggcagaatggataaaacaaaccatgattcaactatatgctatctacaagagactcactttagtttcaaagtcacaagtaggctaacagcagaagaattgaaaaagatattccatgaaatagtaaccaaaagaaagctgaggtggtatactaatgttagacaaaatagattttaagtcaaaaattgttaaaagagacaaagaatgacattatatatggagagagatctctaaagatgttctatttattattaaaaatggtatgttgaagtctccaactattactgtagaaatgtttatttctctcatcattttggtcaatatctgctttatatattttggagctctgtttggtgcatatgtgtttagaattattatatcttaatgagttgaccattttatcaatatataatataattgttttcaggccactaaacaagcctcagtaagttttaaagtattaaaataataaaatgtatcttttcccactatagtggaatgaagctaaaatcaataacagaagaaaaactggaaaattcagaaatatttggaaataataccgtcttaataaatcaaagaagaaatcacaagggacataagaggtgaatgaaaacaaaaacacaacgtaccaaaacttatgggatacagtgaaggcagtgcttagaggaaaatgtataatataaatgcctacacttaaaagaagaacaatctcaaatcaacataaatttacaccttgaagaactagaataagaagagcaaactaaacccaaagttatcagagaaagtaaataataaagattagaggggaggaagacagagaatagaaaaagagttgcagaataaacgaaaccagaagtttgttctttcaaatatcagccaaattgataaacatttacctagactgacgaagaaaaaaagaggactcaaccaaaatcagaaatgaaaatggagtcattgctattgaccttacagaaataaaaagaactttaagagaagattacgaataatttagataacctagatgaaatgaacaaataagtaaaaacacacaatttacctacactgattgaagatgaaattaaaaatctcaacaaacatataacaagtaaagagattgaatcagcaatcagaaacctcacaacaaagaaaagttcaagaccagatggcttcactggtgaattctagcacacattttaaagaaaaattaacatgaatcttcaaactcttctaagaagtaggcaaggaggaaacacttgttaactcattctatgagtccagcattactctaataccaaagtcagataaaatcgccacaagaaaagaaaatcacagaccaatatccctttgtagtgagtgcttgtaattgtatgttgtcttggcatccattttatatgtaagtttaactctctcatgccagaaacagggctcagtcacccttgacatagtctcatattcttcttcccacctgaatggtagccagaggtaaaacttagaggcatctctcctgcctagcagggaggactccctgctttcctgctacgtcctttaaagagaccattcagacatttgcctgcaaacttaaagtgatcacctctcagttacaaaatgaccacttgaaacgattgcctgctcactttaaaaccaccaattaaagccccccagtgggaagcctgtttagataacaccctagactgaataaaagcattggcccatgggtcccttctctctctctctgcctgtgcaccctgacctctacatgtgtgcagtctctgggcatgctgtgtaccctccagggtacataagtagtaaaaactcttaaactttcacgttgtggttgcgtcattaaagctgttcttgcaatctgacccctgacagtgaggcagccccaaagcgtacagatgtggattgcctctgctggtgctcttttgtccaagtctcttagctgctgggggacagtagttaacagctaggttgatagagtttcattcaaaacacccttatgaagatgtatttaaaaatccttgacaaaatattagcaaaccatatccaacagcacagtaaaaggattacacatcatgaccaattgagatttattccagaaatgcaaagatggttcaatataaggaaacaaattaaagtaatataccacattaatagaatgaaggagaaaaacacacgatcacctcaactgatgcagaaaaggcatttggcaaaattccaacatcctttaatgatttttaaaaacactcagaaaactagaaatagaagaacacttcctcaatatgataaagggaatttattaaaactcacaattaacaacatgatccaactataggccatctacaacaggcatactgaagggtgaaagattgaaagcttttccttctaagaagatcagaaataagacaatacctgccttcaccactgctatttggcattgtattggaagttttatccagagcaattagacaagaaaaataaatgaaaggcatccaaacttgaaaggaggaagtatatctttactcacaaatgacacagtcctacgtatagaaaaccccaaagaatccaaaagaaaattactagagctaataaattcagtgaagttgtagcatacaaaatgaacacacaaaaatcagttgtttctgtacacctgcaataaacaatttgacaagaaagttagaaaaaaagcacctccatttataatagtatgtaaaagaataaaatacctaaaaataagttaaccaaacatgtgaaagttttgtacactgaaaactacaaaacattgctgaaaaaatcaaagaagacctaaataaatggaaaaacatcccttattaagtcatgagtaggaagacaatatatttaaggtgtcaatactacccaaagttatctacagattcaatgcaatccctatcaaaattccaacagccttttttggcagaagtggaaaactcaatcctcaacttcatattaaattgcaaggggccctgaatagtcaaaataaccttgaaaatgaagaacaaagcggaaggactcacaattcctaacttcaaaacttaatacaaaaccacattatcaaaacagtgtcatactggcataaggataaatatgttgaccaatagaataaaattgatagttcagaaataaacccacacacctatggccagttgattttgacagggttggcaagtccatttaatgaggaaaaaccagtctcctcaagaaatagtgctgggactcagccgggcatggtggctcatgcctgtaatcccagcactttgggaggccgagttgggcagattacctgaagtcaggagttcgagaccaacctgaccaacatggtgaaaccccatctttactaaaaatacaaaaattagccgggcgtggtggcacatgcctgtaatcccagctactcggggggctgagggaagataattgcttgtgcctgggaggcggaggttgcagtgagccgagattgtgccactgcactccagcctggccaacagagcaagactctgtctcaaaaaaaaaaaaaaaaagaaaagaaaaaaaagaaatagtgctggcacaactgaatttccacatgcaaaacaatgaagttggacctctctcataccatatacaaaaattatctcaaaatgaatcaattacctaaatgtaagcgttaaaaccaaaaagctgctttttaaaatataggggtaaacgttcattaccttggatttggcaattgatccttggatatgaaaccaaagcataagaaacaaaagaaaaaataggtaaattaaactttatcaaaactaaaggccaagtgtggtggctcatgcctgtaatcccagcactttgggaggctgaggcaggcagatcccttgaggtcaggagtttcagaccagcctggccaacatggtaaaaccctgcccctactaaaaatacaaaaattagccaggcatgatggtgggtgcctgtaatcccagctactcaggaggctgaggtaggagaatcacttgaacctgggaggcagaggttgcagtgagccaagactgtgccactgcactccagcttgggtgaaagagtaagaccccatctcaaaaaagaaaaaaacaaacaaacaaaaaaagccacaaccctaaaaacttttatgcatcaaaggacattatgaagaaagtgaaaaaacaataaagaaaatatttgtaaatcatgtctgaggagggtttaatatccagaacatgtaaagaactacaattcaataaaatgacaaaatacccaattcaaaaatgggtaaagggcttgaagagatatttatccaaagaaaatatacaaatagccagtaagtacatgaaaagatgctcaatgtcattactcattaggggaatgtaaatcaaaaccacaatgatataccatttcacacctcctaagatggcaataattttaaaaatggaaaataagtgttgacacagatgtggagaaattggaactctcacacattgcttgtgacaaaatggtgcagatgctatggtaaacagtttggcagttcttcaaaatgctaaacgtgaaattatcttatgacccagcaattccacttcttagtatatatccaaaagaattaaaagcagggactcaaacctacttgtgtgtaaatattcattgcagcattattcataatagtcaaaaagatgagaacaatctgaagtgttcattaacagatgaataatgttttatacatacatacaatggaatatttttccaccatgaaaaggaaagaaattctgatacatgctacaacatggatgaaccttgaaaatattatgctataaaagaaatcagtcacaaaggacaaatattatacggttccacttacattaaatatcctaaatagagaaattcatagggacataaagtagattagaggttaccagaagtggcagggaggggaaaggaaaagttatctcttaatggttacagagttgttatttggtgtgattgaaaagttttggaaacagactggtaatggttgcacaatattgtgaatgcagttaatgccactgaatatagtttaaatatatatttatataaaacaaataacatgtgttataatacataatacacacacatatgtatataaaacaccacgatttaaaaacaataaaatgctttgggaaaatctacattaaagaaactacataactattcaacagtgctttccaaacttgtttgaccttggaagttttaaaaatggactacagttaacatttccaaggacatttatgaaagatagaaacaaagtacaagtgatcataattttgaaagggagaaagatggtctgcagtaacaagtcccccttgttaaagtgcagactgcttcagcagggctcagatggggcctgagatttggcatttccaacaaactcctaggtgatgctgatgctgctggtcctcagcccacagtttgagtagcaggggatataatagtactatatatgaagaatagcactattcttcatgatcctgttccctaccatagccaatttgatcaactgatctgaaagcaaagatgttaatggataataatcaataatttattatgtctccaatgtagcatagttataattttacatgggtttctaagacaaataccttattccaaagaagatactctgagaaagtgatatatagcaacaaagaagatcaatatgggatggggattgtcatacttggtgctgggggcagatgaggtggaattattttttcaaatacatttaaagtatgccagatctatatcttacttccatttatatttggattgcatacttgaattatggccaggccactctttctcataagaataagagaaaaaggaaaaatgagagcaagagagaaagggaaggggggagcaggaagaagagggaagaagggaaataggagacaaggaaggaacgaaggataggaatgatagtgccatgaaaaactagatgtttacataattcttttcaacagtcagattctcattcaactcatttttgaatatcatcactttgctgataaatcaattagatggggttaactagtgtaaaatatttccttctgtagtttacagagcacattcattcactggtgatcacatctaagaacatgtccctgtcaatcagaacacctgagcagactattgtgctaaatgcagatgaaaggttgtgctgacacatgctaggataactcctaaaagtggggaaaaaaacagttatctacaattcaacccaaagaacttgcaggtcaacttccatatttaggtagcttatatcactaggataattgtattggcctcaggcattttacccctgcagttaagaaaaatatccttaaagttaggcaatttctgcctcttataaactctgcgaccttgagaaaattaatgatctttatgcctcaatttttcttatctgagaaatggaggtgatgataattattgaagaatgaaataatacattcactggcacacagcaaggttcaaatatatgtcagttcttagtatatgcgtgtgctaatccctcatcaaaaaactttttttctttctaaggttttatatagaaatgcaaatgaaccttgaaccaaaaaaaagtgcccaaaattgaaaaagtcagatgtaaaggattaagaaaggtacaaaccaatgtaaaataccatggttagcaggccaggagggcaacaggatattatgaaatgagggaagtgcaacaaaaaggttgaaagtttaggtttttggaatcagaatgatgagacactgactctcagcttttctaattactgtgatgggacttcaagcaatttaacctctctaacaccatgttttctcatctgtaaacatttactagagcaataaacagattcgtcttttgtgaggattacactagataatttttacatgcacttagcacagtgcagcaatatatggtaacttaaaaattattttgacttccagcaacatactcataatgccacttatcaggaaagataaaaacgaatatataatggtatgacccagctttctaaatgcttccaagccagttgggtaggctagagaagcagaaaatgtacaagacaaccaatgtttaaattttcaaatttatgcttttaaatgacatttctctttttcctgtttatttttcccatcattcatttttctatctatcttgcatataagaattcaggaaagttttccaccttgaactggatgatctcgaaggaaatatttcattgtggagagaaagggaaaaagcaaacatatataatttcttgtgacttgcctctgccttgtctaatttatttctcattagcagaaaaatctttgttacaaaatagaattctatagccaagaaagagaaagtatctattttgctttgttttgagtaatcaaaaaagaaaaacaaaatccagcagagtagaaagtgaccatggagaagaattcatcatggcagatgctgacataagaggggccgggacaaattaaaaatagttggagcatttcaaagatgtctactgaaaattgttttggtaatatggtggtgcctgttattctgtgcctacaaatatattttttaaaatcacaatcacatttcaaaaggtagacttaaggagggctacaaggggccctctcaaatgaatgagttaaagaggtgaaagaagagaaaaacacattgatagtcctggtttgcatctatcaaaattcattagtaataagtatccaaactattttaaatataaatcctgttatacaaaagtgtgcataagaacacacttgtactttcattaggaaaagagagttctgaggggtataaggtgtttttcaagggtcacagaactcagtacatttcttttcacatccccactgcagaagattacacagatatgagcaaacacatgaaaaacaatcacaattactgtttcattaaaaatagaaaaattagttatgtttcaaagaataacaacacatctcttttaccacaactccttgctccttcttttaccaaaagattttgcctggggagttaaattagccattgtgccccaaatttcctcatttctagaaccccacacggacttctgaagaggtttaaaaatgcagtgtttaagtgctgccataacttgtgttttcactgccttcgagggaggcctcaagccaaattcctcttctttcagatcctacagatttgttgggtactgagccaactagggtgtttcttgcactgggctgctgatcctttgttgcatgaagacatacacatttctacaggagaaggcagcaagtaaatagatagttcatggcaatattagctcagaaagcattaggagaaaattccacaaaggcaataaatatcttccccagcaaaatgtgaagcagagaatcatcagacagtgatttacctactgacaaaaggtaagagaaaaagagaactgcagtcaggctagtcactggatctctggagataacaatggactcttattgtgtccaaagcacatctaggatgcaataatccttgctttacaccatatttactaaggtaacaatatggacgtaaattgacattactgtatgtgtttatgtcttaagttaattttgtttgttatatttctgtacatcatttctcattggtggtcagaggatataaagaaggagtggggtaaattcagaggtgtcaagaaaatcaaagtaacctgctgatttaaagaatgtcatacaaaaggaggtgggtgtttctgactcatccataactcaaaatgcagctccattttgacctcatgaccaggctatttcatcactacgagggaaccgctgttgatgtctacaatgttgatgatcctaaggtcaaaaataaaaaagccaccacccaaaaggctattttaatagaaacttatgacagtgaatccagttcaatagttttcagcttatattttccaaatccaaaactcttcagggtaagttgccattgcttaacagccattatccaaaatacaagtgggaatgttatcattatgcacctcagggtaaaactttttttttggcaatctcaccatcattttaattgtattcaaatctctagccaattgcacagatgttaatggagctgtatttttgcttcaatgtctattgcaatattctcattgcattctgcaggtcctccagtaaacgttacttgcaatatttttatcaacagttttggatcagtcacagaaacgaccatggtaagtgctgcaatgccactggcaagagaaagacacaactcaattatgctgtgaacacaaactgtcaaattttctattgttcaacttgcagggcctcctgtaaatgttacctgcaacatatttatcaacagctttgggtcaatagcagaaactacaatggtgagtgggactgagcattgaagccatcgtgtgaaggaatgggatgtgggattgaagtgcactgtggcatatttgtgagacatttactgagtgccaatttccaactttgctcgcctctgaaaagcaataatttatactactttattttgtaaagtcatttgtcaagtgttcattacttaatattcagtgatcttatatctatcgtgccagagaaatttttaaaacatttgatgttttaatggttttctgtagaattatccacaataaacatgatgcatagttatggatatttaaataggtgcatctccaatgcttcagaagtacaaatttcaaagtttgagagatgtaacagtatagccagttttttacatgtaatggaatttttaagatagttgagcctcccttcgatgccacattcaagatatattccaaagggctgaaattagaaaaatacacacacacacacaattttgttgacaagagaaagtagtcccaagtccataacaattataccatatgaatgccttttccaaaaaaaaaaacccctaaacttaaagctaattagaagctcattatacagtatgagtaaacatgtttcatatatctgaaaaagatttcagatactataaaatctaccagtgcattttttttttttttttgagatggagtctctctctgtcacccgggctggagtgcagtggcacgatctcggcttactgcaacctctggctcccaggttcaagcgattcttccacctcagcctcctgagtagctgggattacaggtgcacgccaccatgcccagctaacttttgtatttttgtagagacagggtttcactatcttggccaggctggtcttgaactcttgacctcaggtgatccacctgcctcggcctaccaaagtgctgggattacaggcgtgagccaccacaggatctcactcttctgcccaggttggagtgcagatcatggcacactgaaacttcaaactcctgggctcaaacgatattcctgcctcagcctcccaagtagctaggactacaggtgcacaccaccacatctggttaattaaaaaaaaattgtggagacaggatctcactatattgcccaggctggtctcaaattcctggcctcgagcaatcctcctgcctcagcctcccaaagcaccagcattaaaggcattaactactacacccaggcttctaccaacactcttcataaatgtcatggtcatgttacctgtgacatagcctattggatcattagtcttacccccacagggttctcggctacagcatggaggttgcattttgggtgagatattttcttggtccccatattatttactttaagtcctaaatcaattggctgggtctaatttgcattactatgtaaagtttacaaccattcatttgataaaaccaaaatcaagtgtaattgagtttgactaagtattatggtgcctgatgtcctaaaaataataagcataatgccattgagaagtaaaaaaaaaaaaaaaaggtttccttgtttatatgaattttctctttttggcaactaacatcatgtttaataaattactgttctttgtggtgtccttcatgttaggaagaattaatttacctttaccactttttttccactggcaaaattagacataattcaactccattacccattttgatattattctgaaacattattacccagaaatgagacttgtgaggctttgacaggatgtggtgcatttaaaaatttacctaaataggatagttttgatagggctattaaatgactcataataaaagctaaacacagaaagagtatatcaactcccaggttgacattcagtttctgtctctcccctcttggctttatcgtaataagagagggggcaaagcttccagtagcccaaatcactgtcaccagctttacacgatggcattcaatgacaatatttgcacgacctaatgctgattgcattaattagattcccatgttgctttgattaaatctcctcattgcatcgtattctcaatcaaaaatgtaaatgtgcaccttttcgatgttcattaatgcaaaaaaaagctaaacatttaaagagattaaaatggaagctatggatatccttgttttctgctatctttaacagctactgaaagtttaataaatgggctgctcaggtacttcctggccacttatttagtgacctttgtcatgcttcctgccagaaaatttggaaactgttgctcaagggtaacatacacagcctgtctattctgctgtataacacagattgaattgcatggttagaagactgatgtatattgtgcttcttttgttttacttcttagctttgatataatgacaaactccatttgctttaaaaatatattttgttttattcaattttggctttggtgcaaaactacagaaaatattttttggaactctatcatgcttgtcaaagaagaaatcctcaggccaccgagggtagggattggcaaactttttctgtaaaaggccagacagtatacctaagactttgagagccagatagtctctgtcacaactatgtgattctgcccttttggcatgaaagcagccataaacaatagtaagcaaataattgtggtggtgcaccaataaagctttacttacaaaaacaggccaaggcccaagttagcaaataggtgtggttgtgtaccaataaagttttatttacaaaaacaggctgaggccaaatttgggccacaggccataggttgccagccccagatttagggcatcaatatttaagtggatgcataataagaatgtgagaattgctccaacaagaaagggcctcatcttccaagataattgaggccctgcctgggactccacctggtacaccagtcttaattagctcaggctgtgataacaaaggattgattggttggcttataaacaacacaaatttatttctaacagttctggaggctggaagtgtgagatcagggtactagcatggtcaggttctgatgagaactctatttgggttacagactgctgacttcctctggtattctcgcatggtagaaagaaaattatctggggcagtaatccccttcatgagtgctctacccttacgacctcatcaccacccaaaggccccgcttctaccctccaatactatcacattggaggttagaatttcaacatatgaattttgagaggacacaaacattcagtccattgcacacccaaagtgtcatcacagcccaagctttctttaccataccgctaagattttaccatccatgaatttactgatagtttcacaaaatttgactcagaaaaattggtcaaaaaaattaaacagaaacagattcttccctgaactgtctttagttgtagtcagaatccttagctttatgcacagtgatgaggtcattgaggacattgattggtgctattttctggggtaatagttttgatttctctacattttctggaataaattatgtcaaagaatgcctcagaattttgagtttctaaacctgttgactttcctctcttcccttacacttcactctcaccccattatccaaatagcattattaaaagttttagtttggggtatttgttcccagatcaaaggcaatgattatatatttcaagaagtcaagatggctttctttgttgctatccagtctgcccttcctatggttaatgaagtcccactaatttattgtaggtgttgcctgcccacaaagtagaggcctgcttacagacccaataccaattctcactctgatatgttagtgtcagagatgtgtactcacaggacaacacatttgtgttactctaaggagtatttttatgtatcattatttttatggatatattattcaaaaatgcatttttgttcattaagacacacagaaatctgttagtgttcattgctagttgccccagcattaagagtattcagtggaacaaattttgtgtggtcccaaagacttagatgactaataaggagaaaatgataagataggttatattctgtttttgaaatgtgagtttaccgttttcttttatttttctcttttctttagtttctgacggcaagtgaatttacaggatggggagtatatttgcaacccctatttcctgatataaaggcatggtttgagaattttagtaatgtcagtaagggtcaagggtgctttcataccatctgtatatagctttcccataagtttgggccatcagaaaatagagaaaagatgctctcttcccagcttccaaatgactgcctggaaggatgtaggtagatagtgtgtgatttggacatatggatgctggaacactatccatgctacagcagtggatcctagtctgctccttatttaacagataggagggtgaactcaaagtgtacaaaatgtgtctgctcagagaacatctccagaatataattctagctccctcaaatccttccccacaacagacatttcacatgctttgctggttacttctgcagaatgaagagttgttttatctccaatctgaaatcacattcctgaagaactcagattaagaagatagacagccccttattagaatgcatgttgtgctgtaactgctgaaatgagactgtgggtcccctttcattctatagctgcgtaaacaagttataagaagatgctgacttatcagggatagcaggtagctacatttcttatttttgacttcttaaggaagaatcaagaatctattacaagcctgacttttttttttttttaatggagtctccctctgttgcccaggctggagtgcagtggtgcaatctccactcaccgcaacctgcgcctcctgggttcaagcaattctcccacttcagcctcctgagtagctgggtctacaggcatgcaccagcacacctggctaatttttgtatttttagtagagacggtgtttcaccatgctggccaggctggtctcgaacacctgacctcaggtgatgcacccacttcagcctcccaaagtgctgggattacaggcatgagccacagcacctgggccaagtctgacattttttaaacaaacatataaggtgaccttggtctctaaattagcagtgcaatggtaaagcctcaatttatcataaagtaactgccccctataacttcaaactcaaggttagctttcccatattaaagctcgcacagacttgagattaggcctactttgggcactcttcccaagagctactgcctccaaaatgctctatgaacttgatcatcaggatgaatgtatttgaaaataagtcatgggaatttgtatagtttagtaaataggtaaaaaagaaaaacaaaaacaaaaaccgtattgaagcttttttccatacaccctaatctttacaacttaattatttttttcccttttgatcctgggggaattcacccaaacttgccatcctgaaatggtctccagagtagagtgactcccagtagagtgaccaactatcccaatttgcctaaactgaggaagttccctggatgtgagagttttggggccaaaattgggaagttctcaggcaaaccaggacaagttagtcaccattagagtaacgtaaacaatgaccaaaaatccagttgccaaatatgtggagatggagcaagtaagggtaaaaaatgtaaaggaaagagagtaataatgaattagtatatatcacacttgtggtcacacgtagcaatagtggataactactagctctgaaaccacagactggcttggttagggaatactgttgaagcctcaatcggagtccagattatcaagtgaagtagtactttcaatgaacctaaggtctttgagtagaagtccccagaagagcagtcactgcccccaagctattcattaacagaagaaaattcccagaccaaatgggaatgccaggggtgtacctaagtctcccacagtgttctgattgagaacgtgaaacatctctggataaagcatcaagttggctagtgtagatacaacacattcagacaaaatgataagaatttcaaaagtaagtagctgcaaggaaaatattttgtcaacatgaaagatcttaatgtttacgttgataaattttaaaatattgccccatcatgtcatagttttataagattttcactactcaaattacgcagtgggtttccttctgcccagagcatctcagcagaaagggatcagagatcatgtgatttctgatttggaaaataaatcagttttatttgacaatctgccatgacagactgatttctgtgttcattgtttacctttttctgtagcaaaatcagctttagtattatttcatcccaaaatgaataatttaaacactaaaaaattcaaccaagtcaacccgttttattggtgttctggtttggttgaatcttcctttttctttctcccttttgtcccctctcctaatagaactaaatggtttattttgaccaaggtatacacagtttggtttactcggacaccaaagctgtatcaaatcagggagaagaatgagagagaaatgcaaatagaactcctgtgccagggtaatcagtaacacttgtccacggcatttctgtaggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcaggtaagcctccattggctgcacatgttcgcatctccatttctccactaatgtagagctgcctgattctgcagggtaggatgtatatgaatatttgacttttgtggtttcttgtttatcatttgaatcttaaagttggtggagagtgtcagaagtccctttggtctcataaatgtgattctccataacaagaatgtatttggtaggatggtacatggttaatggtattgtgtaatcacctgcacaaatgtgttcctgattgcttcagtaaaggaagtacaggctattccgttcaattgccattaagcataatatacaaaatctcatttcaataattctgccattctgtaacattcaagcatgcacacacacacacacacacacacacacacacacacacacaaattcaatagctcagcatagtcattaacaacatacttatagctggatacatggaaacctggttccaatgtcagctttgcttctaagtaaacacgtgaccttgatctcttaacttttcttggacttgggcctgggacagacaattgctgagatccatttttgcttttatattcaaatatgatcttctccagaagtgttatcactctaggctcaaaataatctcccccttttctgaactcatatagcagtttctttttttttttccatatttttttattatactttaagttttagggtacatgtgcacaacgtgcaggttagttacatatgtatacatgtgccatgctggtgcactgcacccactaactcgtcatctagtattaggtatatctcccaatgctatccctccccctccccacccccacaacagtccccagagtgtgatgttccccttcctgtgtccatgtgttctcgttgtttaattcccacctatgagtgagaatatgcggtgtttggttttttcttcttgcgatagtttactgagaatgatgatttccaatttcatccatgtccctacagaggacgtgaactcatcattttttatggctgcatagtattccatggtgtatatgtgccacattttcttaatccagtctatcattgttggacatttgggttggttccaagtctttgctatctaatagcagtttatctgtgactctgtaaggctcttattttttcctgccttattattttggttattgctgttcatgagtatagcataaaaacatggatttctggaattagacaaatctagaatcaaatcgaagctttgccacttactaagttatgtaatctatgaccctcagttaccttaattttaaaacgggaaactccatgtttatctctgtatattcttgtgtgaatgagtaatgtagtggtcagcaaatattttctgtaaagggccagatattatcttaaatgttgcagaccagattgcctctgttgcaactactcaactctatcattatagctcaaaagcagccataggtaatatgcaaacaattggacacggctgtgtctcaataaaatattatttacaaaaatagatggtggactggatttggccctttggctgtagtttgccaacccttgatataagatatattaaaaatacttgctgcagtgcctgacacagagtaaatgtttgataaataaaataatggctatctgtattttaaaatcagttctttttttttaatgctcaacatctctaatcattagaaaaatgcaaataaaaaccacaatgagacaccatctcacaccagtcagaatggctattattaaaaagtcaaaaaataacacatgctggtgaggtcacagagaaaacggaacacttatacactgctggtgggaatgtaaattagttcagccattgtggaaagcagtttggcaatttctcaaacaaagcagaattaccatttgaacaggcaatcccattattggatatatacccaaaggaatataaatcattctaccataaagacacatgcacgtgtatgtatgctcattgcagcactattcacaatagcaaagacacagaatcaacctaaatgtccatcagtggtagactagataaagaaaatgtggcggctgggcgccgtgggtcacgcctgtaatcccagcactttgggaggccgaaatgggtggatcacgaggtcaggagttcaagaccagcctggccaatatggtgaaaccccgtctctactaaaaaatataaaaaattagccgggcatggtggtacgtgcctgtagtcccaactactcaggaggctaaggcaggagaatcgcttgaacctgggaggcggaggttgcagtgagccgagatagtgccactgcactccagcctgggtgacagagtgagactctgtgtcaacaaacaaaaacaaaaacaaaaaaccaaacaaaacaaaaactggcactgtacaccatggaatactacacagacataaaaaagaatgagatcatatcctttgcagcaacatggttggaactggagggcattatcctaagtgaactaacacaggaacagaagaatactgttcagtgaatagtatagaatagtacagtactgttcaactgaacatgcagtacaaacgctgcatgttcttacttataagtgggaactaagcattgaatatatatggacacaaagaagggaacaacagacactgggacctacttgagggtggagggaaagaggaggacgagaatcaaaaaactgccttatagggtactacgcttattgcctgggtggtgaaataatctgtacaccaaaccccgatgacatgcaatttacctatacaagaaacctgcacatgtatccctgaacctaaaatcagcgtttagaaaaattaatgttccttttcagtagtaagctcttagctctttcaattcaagatatttggtttttgtcttttttgtaacatctaccaaatgtctaggacaatgtactgtatatgagagacagtacattgaataaagtattggcatttaaaggtccttaacagaatgccccctttcgctatataaatttattaccaaaaaagtaaacagctagtctccttgcaaataatttttccaagtctgcagactcaccatcatcacctcatttgacaactctgtatatgatttggttctgtattgtaaattccattcttatacctagtaatttcacagcatgctgatggctgacagccccaatgtcttgtggaataaaagaagctgctcatttgtaaaaagcggcaaagtcactgcttgcacagaaaaccaggaaacttcccccagtgaccattcatttttaaggaaacacaaaacattctccatggtgatgtgtttggttggtgtaaaatgcagtactgagcacaacataaattgatcggacctgagaaaatgggacatatgtggagtgtggtgctaggaaggagagttataaaaagcagcacagagcatcagctgccccagctaatcctccaggccttgggtggcatttgctctaatgaataccaggcatcacacactgctgaaataaaatcagattgtagttgctgttgttgctttcttgctgttttgtgaaggtctttacattctagaatcatgaagagtatgatgctcccaagcctagacccagaggcaattcttgtgtctctggttcccaagcatagcacattacaggccctgaaatgccctgacaactgttttggattaggtggggattgtcctgtgcaggctattttatacttttctttcattgtgagtattttctgaaatcaaaataaaaaaccttggtaaaggagaattggggatatcattttaagaaaatacaagctgttcggagatttgaactgcaagaatctaattatttgcctagaagggcttttgatgaaccagatactgtactgggtctagagatccagaactaagtaagatgtggtctttcccctggaatgacttcagtctaacaaggcaggtggatgcatgataaattaagtaataggaataaataggaaacaaggaaaacaaaagtggctctaattttgcaaatgaagtatgtgatcaaaatattgtcagaatttggcagttggcatccacagtcctgtttgtcagtgggctcaatttaactagaggtcaaggagtaactaatgctaatatatgcccagctgcaggtttgactcaaatttaaggccaaggggggtacagttgtgtccatgtcttaaaggtgctgaaaagttcctgctgacgttccattagaaagtaatttccctgcatactcaggtttacaacacaaatactcccaggagaggaaatccactggcttaaatccatactaaactctaaagagctgatataaaatttatttctgaggatgaacatactggattcctaagaggagaaatgggatagaatgaagaaaggttgggaaagatacaaggaaggggctagaagtaccaaataaaaaccctaaaactgtctccacatacacagtaaatacttaagcaattatttaattatgtaagcatgtggtccacattttaaaaagtaatgttctgtcttgatactctgtatttgcattttcctgaaacctaaagcaaatatcaattgcatttaatctgggaaaaattccatgcttttcttggctttgtaggtgtaggggtagaattaactctatatgggcaccaaagcccaaggttttgattgtcaaacaaaacaaatatagaaatatacagtccactgatttcataacaagcacgatcacctttcctaatacttcatatatctgtattccaaaaggtaggggtctaaaaaaaaagagaaggcagtagaccagaactccgtaagtgtcatccttatgaacacttggggtaccttgactaaaattcaaacaaatcttttaaataggaaggaaaggccttatctcagtgttaataaaccttttatccagtgatgtaggacacaatctttgttgatgaaaaagtaccaaatccatttctgtccatttttctttaatattcattctctaatgttttatcttactctctgttttttcctaagttgtttgttgacctgccccattaattattgatcatctctgacaagagtatacattttgatttgtaaaccttcttcagagaaagtcaataatccagagaatagagatcaagtactgagtaacatgtggtccttcatctgggatggggaaagagtcaaattctaaattcagagagagtcaaattctaaattcacattacttacaatgaatccatacttgaatccatactgaaatagtgaggtgagtcttgaaggttgtacatattattgtttaaacaatatttgttgaatttaatattgtgagttggaataaaggtcaggacatcatgggatatggtggacaacatgaaagaaaaaaggagaaggtgagcatttttgaagaacagctcatctcacatgcccacagtatctttgctgatattgtcttctttttaaaaatcccattgcttctgagaatttagtcagaaatatgacttttatagaaggattttttttaaatttgaagttaccttgtaaaatatctaatccaacacccttgttttgttgataaggacgtcacaatggagctagtaagtaggaaagctaggacaagaatcagggctcttaacttctgtttcagtgctgtcatttcctacccccacattaattcctcatttacttcaacccaagtccaaagacacaaacacacacaattcatgttgcagcaaagggcatcatttcatgcttttttatggctgcgtagtattctatggtatatatgtatcacattttctttaatctaccattgatgggcagctaggctggttccatgtctgctattgtggatagtgctgtgatgaacatacaatttcatgtgtcttttgtagaacaatttattttctttggggtacacacccaggaatgggattgctggttcgaatagtatctctgttgtaagttatttgagacgtctccaaactactttccacagtgcctgaactgatttacattcccaccaacagtttgtgtttgcttttctctgcagccttgcagtatctgttgctttttgactttttgataatagccattctgactggtgtgagatggtatctcattgtggttttgatttgcatttctctaatgaccagtgatgatgaacattttctcctatgtttgttgaccatgtgtatgtcttcttttgagaagtgtctgttcatgtcctttgcccatttttaatggggctatttgttttttgcttattgattggcttaagttccctatagattctggatattaggcttttatcagatgcatagtttgtgaacattttcttctattctgtaacttgtctgtttactctattgataatttcttttgctgtgaagaagctctttggtttaattaagtcccatttggcaacttttgtttttgttataattgcttttggggacttgtctaaaaataattttccaaggccagtgtcaagaatggtgtttcctagcttctgtctaggatttttttttttttttcttttgagacaacatctcactctgtcacccaggctggagtgcagtggtgtgatcttggctcactgacaactccattcctgggttcaagtgattttcttgcctcagcctgccaagtagcttggattatatgtgcatgccaccatgcccaactaatttttgtagttttagtagagacagggtttctccatgttggccaggctggtctcgaactcccgacaagtgatctgcccacctcagcctcccaaagtgttgggattacaggcatgagccactatgctcagccctgtctaggatttttatagtttgaggccatacacttaaatctttaatccatctagatttaatttttgtatatagtaaaaggtggtagtccagtttcattcttctgcatatggctagctagtcattccagcaccattttttgggaaaaggagtcctttccccagcttgttttgtcaaagatcagctggttgtgtgtggctttatttctgggttctctattctgttccattggtctatgtgtctgtttttgtaccagtaccatgttgtttttattactgtagccttatagtacagtttgaacttgggtagtgtgatgcctccagctttcttctttttgcttaggattgctttggttatctgggctgttttttggttctgtatgaattttagaatagtttttttttctaattgtgtgaaaaatgacattgttagtttgataggaatagcattgaatctgtaaattgctttgggcagtatgactattttaatgatattcttcaaatgtatgagcatgggttgtttttccatttagttgtgtcgtctctgatttccttcagcagtgttttgtagttcttgtagagatctttctcctccttggttagctgtattcctaagtatttcattttttttgtagttattgcaaatggtattgtgttcttaattttactctcagctggaatgttattggtgtatagaaatgctactgatttttgtacattgattttgtgtcctaaaattgtactaaagtcatttatcaatttaggagccttttggctgagtctttagggttttctaggtatagaatcatatcattagctaagagaaatagtttcagttcctctcttcctatttagatgccttttatttctttctcttgcctgattgctctggctaggacttccagtattatgtttaataggagtggtgacagaggacatccttgtcttgttccagttctcaaggggaatgcttccagcttttgccatccagtataacgttgactgtgggtttgtcatagattgctcttattattttgagcgatgttcctttgattcctagtctgttgatggttgttaccatgaaaggattttgaattttatcaaaagatttttctgtgtctattgggatgatcatatggttttgcttgaaccttcctcaaaatatatgcatattttggcagggcgcggtggctcatgcctgtaatcccagcactttgggaggccgagatgggtggatcatgaggtcaggagatcgagaccatcctggccaaaatggtgaaaccccatctgtactaaaaaaaaaaaaaaaaagtacaaaaattagccgggcatggtgtcgggtgcctgtagtcccagctactcaggaggctgagacaggagaatcactggaactcaggaggcggaggctgcagtgagcagagattgtgccactgcactccagcctgggcaacagagcgagactctatctcaaaaaaatatatatatatatatgtatagtgtatatatatacacacatatatgtgtgtgtatatatatgtgtatatatatgtgtgtatatatgtatatatatgtatatatatatgcatattttgtgcattaggttatttaagctattttttgtttgtttgtttagaggaaaaggtccttatctttattaaagaagctatgaccctccaactgttaagagcttgagctttgtttccagatttactgcatgcctccagaatgggtatgcctaaaggtgaagtgattaaggaaatattgtttgctttcagtgtgttattaaactgaccagttatctgggggcctcatactaccatctaataacccataaataattataaaattgcccctcaacaatagcaccccatatcaccaaagcatctgtttacctcatcatcaacctttatctgacctaaaacttattggcacctaaaactttatggcattggaggtgatttgcttgttaatcccttttgattctatttgcaattctgggtgttgataattcagtattctgccttcccagtagtacttgagttgtaatagagaactcttggggattgacacgcttttccctctgatgatagattacaggcaccactgagagtaggtatagtgcagatttctagacagacatccaacgatgttcctccaaacaatcttgtctaatgaccaactctacccacatacataaaaggctagcttttctcacatggcctcccatccttgactcatcctatagtctgatgcaagaacttcaaaagattctaactttagttatatatttttttatggcatagggaataaggacattctctatttagatgtcagagccaaaaataaaatgtacaatgaactgagacctgccttaaatgttgccagtggtgttgctttgattaccttactctcaattttgatgagacacataagcccgtattttctattagaaggcagctatgaaaaactatgatttcttttcgctgtgcatatttggaccattatttatctttatgttctataatccaggcaaaattacattctcattttctaactctgtgtccaaatcctcattagtattgtgacttaagtaattaatgtctgtaacataagcgtccacatcagaattaagcagtcttcagagaagtgctgggaaatgccatggaaaccacaatgattccattcttcctagaggcgagcaaggtcgggagggtgggaagcactggcatgcacatatgctagtggattcagcaggagctgtggtgtggaggggctgtttttggagaggggctctttaaaaaggtacagctgagggtagaaatatgaaggtccagaaagtgcgttgtatgtatgacagactctcataaagtatggaaagctttgttgagctcctgctcaggttagaaatacgcaaacactatgggacctaatattggttcagacacaacagagtaaggatcttgtattagtcagggttccctagagggacagaactacaagttacatattacatatatttatgaaagggagtttattaaggagaactgactgactcacaccatcacaagatagagtcccatgataggctgtctgcaagttgaggaacaaggaagccagtggtggatcagtctgagtcccaaaacctcaaaagtacggaagccgacagtgcagcctttagcctgtggccaaaggcccaagagcccctggcaaaccactggtgtgagcccaagagtccagaagctgaagacttggagtctgatgttcgaaggcaggaaacatctagcacaggagaaagatgaagaccggaagactcagcaagttggctcttccatcttctcctgcctgctttattctagccgtgctggcagctgattagatgatgtgcctagccagattgagggtgggtctgcctctcccagtccactgactcaaatgttaatctcttttggcaacaccctcatagacatacccaggaacaatactttgcatccttcaatccaatcaagttgacactcaatattaaccattacagatcttatgcttgtttggaggaaaggagagacttgatcaatgaaatacatggcagctagcatgaccacttgtccttaactgtttacgtgactggactagcaatagcaaccagtaggttttcttccatttagaggtaaccttacatttcattaacattcatcagtttgctcttcaggcaatggtacaaagaacagaatattgagaagatggctcagggcattgtgatctccacacttcctttcatcatttactgtatctcccaggatcatagaacagcctttccagctccataagtttatcattctgggtctcagtttcctctataaaatgagactgaaccagacacttagaccaagtatgaggctccttctagcactattataagtctgtaactcaaaataacgtccctctccttcccaaaccacaaaacactttcctgatgagtaaataagagtgcattcttcatgtcccttagggcttgagtcagcagaggagattcagaatttcaaggtgcctgtcttaaactacttggatctttgaacccttttctcctgaattaaatatacaactcctgagaagaggaacctgattttggagtaggttagggaggtttggactacctgtaatttaagaggcagcgttaaaacattcaacatggccgggcagagtggctcacacctgcaatcttagcacttgggaggctgaggagggtgtatcactttagctcaggagttcaagacaagcctgagcaacatggcaaaaccccatccctacaaaaaatacaaaaaaactagctgggcttggtggcgtgtgtttgtagtcccagctacttagggggctgaggcaggaggatagcttgagcccaggaagtcgaggctgtagtgagccaagatcatgccactgcactccggccttgatgacaaagtgagactctgtctcaaaaaaagaaaaattcaacatatagtttacacaatgacaaatactcagtatcaagtgccctgagaaacttcccagtcgtaaactagatcatttgtaccctctgattcaatcaccaggaatatctgtgaactattattttagaatatgttcatgaaacataggtttatatacttttagacaattacacaaagatggttggctgggaaaataattgactgaatatgtagactaaaggaatcatgtggtagatttgagccagcagagttgaagagctagtctgctattattactcatcacctgaactttctcatggcagaaagccaaaggaaaaccagaggttctggtgagggtgctcaacttacattaatgtgggcttctacctggtccacactgctgctttgaaaggctccctggatgacattaataccaaaataaacatgcataatgtcaccatggctcttatgaaacatatgaattactttagttcattctcacagcacataatccaaaggaaaaggtactttattttaaaatggaaaaaaaaatgtgtccatctgcgtatctcagcagtctctccaacaagtttcttctcgcttgtggtgtttaaaattacaaaccaacatctgtatcaaagaggatacgatatttatcattggacagtcattaaaagattattaagtacgtatattaatacaattatgtgaagttccacatgagatatactctcagagcaaagccatctcatttctgattgattggttatttcaaatgacaataaaataaaggttttatttgatgtttcattttagtatggatattttgctaaacttgagcagtcagatgaaggatagaaagcaaaaagtatgctaggggattaaagacagaattctattggggtgggacaaatgtcagttctgagggtcaggaatacttggattcaaatccaattttactaaatgaccataaaaagtcatttaacctttctttgacctgcagtttttctcagttccagattcacaataaatgttcaatgaatgtcttaattatccctgagttggctgtaggataaaagggaggaagtaagggcgacaacgccccttaccttccttaacacatacgtatggacatacttgtaccattcaggctccactcactttccacacttagtccaaagcagatggatactctccttgccttgagtttcctctttttgggagacatgtagctcataacagaggtgacagttgcatctactttcagataatagtttagctgatgctgttcctcccctttagctgcttgttaaaagtaaactgaggaattatgcttggtttcaaagtgttatccagtcaaggatggaccatcctatcaactgaccagaactccattctctctccaaactttgccaccagaaacagtggtcagtaagtctccatcagttaccacagtggaagtctttttaacgcagcaaaatatcagccaggtaacacaattttgccctcagttgtcaacaggtacaaggttactttggttttctcaaaacggtatctgcagttcataagcatgcttacacgtgttctcttcccccttttttttaaagtaaaatgaactcaaaacattttaaaaattgctacactgtacagtaactttctccctttcttcacctcagtgccacgattaaatagctgtaatactagacgcatagtaacaatgaaaaaggcagttctcattatttcaatgtgcaggctacattttaccttcaccaatgttttgatatataaatactagatgtgaaatgactttgaaatgtaaaatgtaactaagatgtgggggagtattgattatttaaatctttggtaatttgagttccttcctctgatggtgttcaatttatccctcttctattcaacaccttcaaaacattttcatccaggaaatatcaaagcatttgggaaaattttagctgcagatttatcagttgctctccaagttgaatccaatccacatttggacttaattaacatgggccaaccatatgtgtgcacactttctgaaaggaccacacacagatgggaacagatattgtatttttgtccttcccagctactattgctcagtgcatatgggtattttttatgatgcctttataatatttggtaaacatggaccttcctactcagccactgggattttagtcaggggagaggagaatagctaatgagccaagcagtgttgccatttatctcctctacatcccaaggtcaacaggaaaaaaaaaaaaaaaaaaaacagcaaaagtgcttatttggaattaatagagaggaaagagtctaaccatacagcttagaaacaacctgggatttaggtccagccttagacaatattgaaaaaatgatgtgtctctggtgcccagccacactgttctgagccctgtttttcatctagtttcatctttccctttgattttcttagtatgacagtctgcccttggagatatcaatagggaatctgggaatctatcaatttatttacacaaagaaggaaatgagtaacagtacttgaaacacatttctcttcctagctttgcatcttaatagtcaaagaagcctttagctaaatgtgtatttatttattatatatagcagctaagagttggaaggtgtttgagcaaggatatattgggacctttgtggaactcccaacaatttatacaccattaatttttcaaactttgattaggtggaaagtcttcccaggtgccaagctcagggctggagtaggcaggactctctctatgcattacatgatgtaagttcaaagtagccatttaatcacagagctttcagaaatggtaagttaaaaaatttcattccttgcctgcctaaccagacttggaccaattccttttgttttctgtgaataaagatcctcatgtgggtacctcaggttcaattcaggagcatcaagtcatgcttctctgatagaccaaaagggccctctaaggatccaggtatgtaagaatagataacctgctctacccgatcactgtgagtgcttatctgggccccaagggagtaattaaaggtcctttacttgattctgttcacgtgtgtctgattcacatcatcaaaagtattgtctaagtgggagagttggaaacaacttcgaaaagttcaataataaattgaaactattaggatacatatctgcaattctgatattaagttgtgatctccttcaagagacacactgtcttattttaagtgtctggtgcctggtgcccaataaatatttgccaaaatattgctgaatggatgtataatactaagttacagcccagatgcagtcctgcttaacaccaatccctccacaataggacctagagctagtcttcccatgtactctgttctttatgaccagtaccatgagatttcctaaaatttttgttgtggttcattcaatgcaggttgcagccacctccctaacttcttttgaaatttcttggtggcctattttccagacatcagagacagtaatctgatatgctgccatcgccctgagtagagttcactgcctacttttggcctttgcacactggcatgtgttaaaaggcatgatggtcttggcttcttctctatcttacctagaaactgtcctcctaaccctcttagcagctctcccagtttcctagccacatctaccatattcttggttgccagtggactgattttggcttcactgccctgacttaaccagtatacctctccaatgtgactgaagcccatgattaacacccccaacttgtatcattacccctagtccaatcacttagcagcctacttgaggctaactgtcctaccctaatgtcgagaggctgagggaggagaatcgcttgaactcgggaggtggaggttgctgtgagccgagatcatgccactgcactccagcctgggtgacagagcgagactctgtctcaaaaagaaaataataataatatttcccaaaggagtgctactgttactgaaaaattatagacctctttcttaaaaccttctcctttttgtctatcacattgacagaaatcaaagtcatccctcgggatatgctgaagtagtactccttaaagtgtgctccaggaaaccagcattggtgtaacctgggctgctttatcaagagggcctgataatctgcattctaaccaagcccataagacaatgcttatgcccaccagagactgaaacccactatactaaaagatggttgatcagacaaccagcctagcggtgttttttatcccagtgatttcctaatcttccctccctctctccatgtgtgggctgtattaatgatgcacttttaacttgacttctaacttgcccccaggctaatttcacttaaggtctaggtgggttaagatgacactcttgtttgatacttgatgcatcctgtcaaatctccctgacactagaatgtcacatggttcagaaatttcaaggtacaactgggaggaaagattcaacggatcaacatggtacaggaaggccttccttatgttctcagtgaaagagtgaatagtgttctaggatgttggatgacaaagccctatggaagcaataaatgtctcacctatctgcccagattgccaagaagttcctattttaagaagtgttacttgcacttaaagttttcatcatattcaagagggtaaatttacctataagaggaaatccttcaagctggttgccttcacttatagtttataatcacagagatgttgagcaggatggggatgtttgctgggggaggcccagagatttagtcaagatcaaatagctctttatgggtaagccaggtctatcacccaggtttctgggttgccgggagaggctggaggagtttttaaaacaacaagccatgaggattctgggtgtctgaggaaaaatgaaaggggtatccctgagcaggtacaaggcaactaaggtgtctatgaccaactctgctggcttcatagacaaaagaggataataaattggtaacagattattttcctaaggaggaaatgtgaaatgtgatagagtgggaaataataaagggaatttgatgtcggttaaagctgtattcaaatctaacttcggttgcttagtggttttatgactttgggaacaaagcttaaactctgtgagtttcaatttgcttatctcacaaatggaggtaacactgtctgccttgtgtgataatactcagtgattataaaataataagaatgcttgacccacagcaggtgttctgagaattatgattattaatactattatcaccatcactttaatttttagtttgcctaagtattttcatcctaaaggagcaccataggttccagcccccagatgtgtccatgtgccactgaaagtttgtggtgtgctgcataaagagagataaatgtggtcccaacagaggaacagcaatacccccaagactctcttgttcgtcctgaaagacacagaaacatcctcttgtccttcctctctgaacaagagaaactattgtaatcattagaattaactctccaaaaatagcatgttgtcaatccttgctttagggaagcagatcactcattaaaatttgtatttgtacctgaaaattcatcttctcttcaaatggtatttttccctcaagagtttcattgggaatgaactccgagttctaattctaagttccttatgaaccagtagttgctttatgagtcaagcagccttctgtctgccataacattgtaatgttaaatgattaatttacattcttctagcaatgtgaaaatagccccagccatggccctaactagttgaccaaggttccaggacaagtcagccaggcttcctggcattcctttaacttgatttgttttatttctagtgagaatctgccagcaacttagcggaggcaccaggcaagctttgacagtcctgtaatttagcagcatcctgtggactctgatgactggcctcgtcccttctaaatcctttaacctttcccatttccacagaataaaagcctgaaattctcacacaaattttaggatactgattcattaatttgttcaataaatatttcttggatacctactctggtctaagcagagacaggggttcagccttcataaatcttgcattgtagtagggaagaaaaataaataaaaaatataaaaattacaatatttgatttaacaactgtaaaggtaactgaaatagtttacagtgtctgcatctatcagtcatttaaattttaagtgaggtataaacccaagagatggttttatgagcaaggtgaactcaataggaaagtagtaagaaagggaaagggcaggaaaggtgagattttgggagacggactttctttgctttgttctattctttgcctttaaaataggaatgcttgctcagccttcttactttcagtaaagaagcagggcctctgtgaaggaactttacttcttcccttgtgcaaacaggagcaggggtgccctgaatgcacagtggaggaacggacaataatgcttcaggaaatgagttatttaacaaaaatcaaaaggaagaggggcagcctcagctcaatgccttcatgtgcaatggccttaatatttcagattatcggggaagaggacaaatctgacatgctggtcaatgtctgccagtgagaagtctgagtgtccaggcaagttcggaagactactggcttcccgactaaaatagttaattctgtgagacccacccaaagtgggtgaaaagccagagcaaaggagataaaaattgttcacattttagtatattggtgtatagacatatcagccttatttggtgcaatttctgcatgtctgtacaaaataatatcaagttctttttttcccccaaactcatatttaaaaaatcataaaatagcctttttaaatagcaaatggggtggcacttttgtagattcttgtctgggagcataatgaaatattctagggtgatgggaatgctctaaatctggatctgaaagcttgttaaataggtgaatacagatgtaaaaagtaattgcactgtatcttaagatttgtgtttttttactgtatttaatgtacacttcagtagaaaaaatgaaaaaggaaaaaataagtagcgggaaaaacctagatcttaggcctttagatgcacggtagactggatgtcataaatgatgagctctgaggctcaggcagggacttattagatctttacaatatctttctatttgctcatgatttaacaaactgcggaactgttaactctcctccttattattggcacccactgggttccagtacaaaacctatctagaaaggaaattagaaaaacaaagaagaaaaaaaaacccactgagttctcagctgagacaagattcagggatagggtcatgcttgttaggtatttctctcagtggggtctcccatgctgttaatagttttggctcccaaaatgctgagcccctctaggatagttagatctgccacaaaggcagcaataattgtgtgtgagatctctgcttcctgaagaaatgtgaaaaggtcattttgcaaaacagtcaaattcagcaagcctatgattaggaatattaaagttgggttgtttccagtaacaaaccaatatatagttgaattctgtgacattcttaaaagaacatgttcttttaagctgtgttcatcttcattattattatttttaatttctttaaacttttcaaaactataatgaaatttccagattttttggttttgattcactgaaaccaattatccatatgccatctaattattttcatataatgaacatttttttaatttaaattttaattttttgaattgtaaatggacaaattatagttgtttatgtttatggggcacaaagtgatgttatgatttaagaatagaatgtggagttattaaatcaagcaaattagcatatccattccctcaaatacttattatttttttatggtaagaacacttgaaatttactctcttagcaattctgaaatatacaatgcattattatttactattttcaccaagctatgcaatatatctccatgaaagaaaaatttattccttctgtctaattgaggctttgtttccttttgcagcactattcataatagacaagttatgaatgaacatatttttgtatgatgaaaatatttatttcttctttgaaaaatagaaaaaaaatagattctcattatggtaataataattttaagctcatggatccttttgaatttttttcacctttaataaggtgtcagctttgttgttgtttttttttttgtttgtttgtttacttttttttggttcttatattctgtccttatttcaaagagttcatggcattaatctacacaaaattgtgttttcaaaaaaacaaagtctttatgctgggaaccaaaaactaaatatctgtatatctatagctatatctgtaaatgaactccataattgacaacaatttttcctgcctaaaatgttatttttaagtcagttgtttagaactataagccacattttttcctttagagacatgtttgggttctcagaatagcccacggaaggtagctaatttatttagcaatgaatgtgaaatgctgtaggtttgtggcaaatttttaataatcatgatatgattgtaatagcaaaaaattactgaacgaaatggaattttgtaattttacctttcagttattgtttgaagaaaggcacagctaattacacaaagatgggaaagctgttatatgaatagtttttatggacattttcaaataatttatactgctcaattcagataatgcaagataaagaataaaaacaaaatatgaatcatcccactaaccaaaaatataatggtgtgcttatttccaagatttaaaacatgtttttacattgcactgttttatatctttctttttccagtcattatattttaataattttgatgattgtcagcgtggattctttgtctaatctgacttcaaatcgcaaccctttcctttctttaaaatacatgtgctaaattttgttttgtttgcttttacttgaatagattgtaaaaatgaagcagagaaaggaaaaataaaggaagcaggaaggcagagcaagaatgagcatgacagcaagggagagtttaggcaacagtgtgagaattcgaggggtctttggatataaaaggtgtttgagatacgatgaacagaatttgaagcagtcaactttagaaaaatacggattgtagtattaggatcaaatgagaataagcatcatcttacctacctcatcatttggttgatgacaaaacaaatgtttagcaagtttaaggtcttgtttgggggaagagatagtttgaggcagtactaggaagggaaccaagacttactaattctcaatcctaatttccttccttgaatcttggagatacagaaaaatgggagagcaagaggtgtgcatcattcccttaaggattaaaaagggaaatggtggaaatgagatggtagctcaacgaatatcctgatataaggatcagccagagctgactggagttcaaaaaagttaaggaaagaggaaagtggagcagagtaaccccttctgggtgcagagagctgaagactatgtacaaaccgttgtttgtttgtttgtttgtttgtttgtttgtttgttttgtaagataatgagtagtttgtttttcctttttttttcaatttttttatttccataggtttttgggaaaaaggtcccatttggttacatgacttaagttctttagtggtgatttgtgagattttggtgcacccagcacctgagcagtatacactgaacccaatttgtaatcttttatccctcacctccttcccaccctttccccttgagtccccgaagtccactgtgtcattcttatgcctttgcatcctcatagcttagctcccacttatgagtgagaacatgtgatatttggttttccattcctgagttacctcacttagaataatggtctccagtcccatccaggttgctgtgaatgccattaattcattcctttttatggctgagtagtattctatcacatatatgtaccacagtttcgttatccacttgttgattaatgggcatttgggttggttccacatttttgcaactgtgaattgtactgctataaacgtgtgtgcaagtatctttttcatataataacttctttttctctgggtagatacccagtagtgggatcgctggaacaaataatagttctacttttctttctttaagggatctccacattgttttccatagtggttgtactagtttacattccctgtagaaaggttcccttttcaccacatccatgccaacatctattttttttttttttgacttttttgattacggtcattattgcaggagtaaggtggtatcgcattgtggttttgatttgcattaccctgatcattagtgatgttgagcattttttcacatcttttttggccatttgtatatcttcttttgagaattgtctattcatgtccatagcccactttttgatgggattgtttggttttttcttgctaatttgtttgagtttattgtagattctggacattagtcctttgtcagatgtgtagattgtgaagattttctcccactctgtgggttgtctgtttactctgctgactgttccttttgccatgcaaaataaacaaaaacataaagtaggggaaggacaccctattcaacaaatggtgctgggataattggcaagccacatgtaggagaatgaaactggatcctcatctctcgccttatacaaaaatcaattcaagatggatcaaggacttaaatctaagacctaaaactataaaaattctagaagataacattggaaaaaacccttctagacactggcttaggcaaggatttcatgaccaagaacccaaaaacaaatgcaataaaaacaaagataatatgtgggacttaatgaaataaaccatgatctttaaatgggtttttctagctcaagaactacatgctccagaattatcaaaattctagaataaatgctacaatatattgttaacccatacatgcagtaaatgagaagactgtggagttaagcatttgcccatttgatgtaagaagaactagcacttaccatgatcagttatacttattacatcatttctgtccttgaagcaaagtccaaggtgtaattctaaaatagtataaactttatatcttttggacattggcgtgggtaagagcctattgtttttgttatgttatatctcagtggtcttgtttattctagtacaaagctgagaacagcaccattttgggggaaggagggagaatcagaggctggaagatgaaaaatagagagtaagaggttatggtgaaatactacaatatttaaaaaatttatcagtgactgttcttcattttaaaaacaaaaagcactgccctgagttggagcttagatttcattatttgaatcaatgtcactttgcttaatgccaagtgtattttgtttgtttctcaacaactggacttcatagatttaaaaatggtttttaattttttttttgtttgctaagactcaccttgaccttatcctgtcccatggacttgaagaactttccgatggatgtccagacctgtacaatgcagctggagagttgtaagtcaccactgttgaaatgactccctgcttgttttaaccaatgacctggttcttttagtatgtcattaaagagaaaggacccttacaactcattccctatatactgaccaacccccaacatcctaatggaaagacaaaccaaagtgtgtgtgtgtgtgtgtgtgtgtgtgtgtgtgtgtgtgtgtgtgtgtgtcatacaaaatctcattatcaatacagcataggcaacctttcaaagtaaaatgccaaataacttgcctttctccccccgcccaaaaaatagcctgatttggtaagcttttcattgaaatgaaaatgtctcctgagaaaattaaaattattagtcattaaatctttatagtgaatcactctttaatcagaaaattgaatttctttccatcttatgcccatgtagaccatcaccccaaaaggaattctggcaggaagggataattgctttgagaacaagacataaggaccttggccagaggaggatgtaagaatgaggggcatgagatgagatggaataagacagaataagaggcatttctcttagataagcagtggatacacaaaagcatggtgaagcaagtagaaaaaggccatctactttgtcccctttatgacctaaccctgatgccactaaagtctttgatatgtgtcaccataagttgctgatgcctccaaagtaacaggattttcagttaagagatatgaatttctttctggcttggtctatcagtttctctgtttgtaaaatgcagagaataataagtgccactgacctacatggacgttaggagatttaatgaggcatgggcaaggaaatacttttaacttcttggtttagaaaaagaatatatgtaaaaagacttatctattatttaaaaagaggtagtgacagggttgatttcattctgatcatctaaaatcactatggatttcccttgaaacatcccagagaaataaacaaaatgatgaaacctctttatcttaagaagttgtcatagataaaatgaaaatttctgatttaaaataggccttatgtattcatttttttccttattgctccttctcttgagaaaaaagctgagaaaaacattttcttacatgattccttctttctgttttctctactgctccaaaatctcccctgactcaacccaacacttttattttttctgtaaaacagtagccgtagctgtcaactgatgttcatccaaggcttagaaaatttgaattagtaaataagctcagtcctggcatgaataatgaaatcaaagaaacatcatgtttaccactaactttggatgtgaagggtgggaattattatttttttccttttctatcccaatattactttcttcatccccacctctttacctctgctgtcttccccatgctggggcttcagggtgactgacaagaacttttattgtggtggccaacgagaagctcaccagacaagaacgtggggtattttgtgagcttagagtagtatttgctggaggtttccaaggtgtactcacacagatagggtttgccattctccttgtggaccaccaatgcttgtatagggcctctttgtatctccttgctttccatgttcttattatttttttttttttggctttatgttgaaaaggtagtccaaagaaacaggaaagtagattacaattaaacttgccattgatttctgggtagctctggcgagtcactatcttgcagtaaataagaataagaatccataaacttaaaaaaaaaaaaaaaaaacatgctgaggattttggccagccaagacctcacataatatcctctgtcctcatcactcttatctgaaaagttcaaatattacaaacaaagggaaaaggtagagaaatggtgcatgaaagaagagtaggcttcatttctagggtagagaaagatccagaaaaaattgacagatgatgacctagcttggagactaagagctaactttggattaccaaactgataacaattttactttggatggttcaagtcatataaaaatatgatctttcataataggtaatctgttttactttgtattaataattgtgatgagtgggcccatttagcaagacactagcacaaatgaatattcttaatttgcatattccataatttcctcttagattacctgccaatagtcttccccatttgctaaagtagaaggactttaacataagctttctgaatgcaaagctaatagaccctaggaggagggccaagtctgtaatgggaatgttttaggcaggcccgtgattaattcattctcatttaaaaaaagaatggttttcatttaaagtactgactggcactgtggattggattgtcttattggattgctaaagcctcagctcttgcaagtaaagacaatcttcaaaggatttttatgtttgttcacttgtttgttcttcagaaagagttagtgaataaaaaggcagaaatcaatagactttttagattccattctttcattacacagaaaaaaaatccatccataagtagctttctgtcttaaatttctttggctccaatgacacagagttgtagtgatgattgcagctcttttattaagaatgctcttgaattgactgagcgtatgtctgctttagacagtttctttgtttgtttctttacatgggtagactttcaagctttcttggaaagccatattcaattttcactatgatttctttacctcagttgggtacacgatgaatgacctgatatttgagtggttaagtgatggtccagtgcaagttgctgaaggattgaccctgccccagtttattttgaaagaagagaaggaacttggctactgtacaaagcactacaacactggtaagtttctttttttttttttttcagctgttaaacacaagtgagcgccatttgcagtttggagtatacatctcattactctaattgctgcatatttaccaggcaaatagacctatgtcgcacggacctgatttggctcaaaactccctcaacagataagattcctatactctctggaataggtcagcaaacacaagaggtaatttctccagaacatagagagaaggagagaggatttaggatcttttgctgttcctagctgaccatctgttgtcgaatgagtctgaggaaagatgtagaaaacctcattagtggtgcagaaaacataaattctggctcctttctggcatccgctcttgccattggatgcttaggtcaatttgcacccactgtcttactgccttagtgccttagtggaaaagagggacaataacacaggtctttgtaaacccagaaatagagctgttgtgttcttcagtcctggatagcaatagaagtttggatgaaagtcagctggcaggaattcagctggctctaaagtcatgtgttatcagtagtgctgacagacacatggggttggggggcaggtggtgaaggaagaacttgaggtggtagcaacaaataggcatccgttgttttctggaagattttacctgtccagaaaagttgatggtttttcttaagaaaaaccatggtgttcattcaatactatgcaagctgatcatggagagacaatcaagacatgatggtttgtccagtaactggtctaggtcccttgctgaggaaaacagtttatgcacacttgttccaacagccaacagtgatacttatgaagtaaccaaaacctgattccaaggatgttttttttctgaccaagaagaattcaaccctatatcttgtaatctgtatggactaagcaaaattaccttctggagttctaactccaagtcaattaaggagaaaaaaagtgggaaggggtaggaatatctgtctcttaaatgttagaagttttaatacctttatatgaactcctttttacaggtaaagaaacactgtacgtagttcctaggcatatgctaaatgtcctgaagcaattacccagaaggctaggaaatttttacaatgactagactatacactggcttatacaaatgtacatttttctcttgccattaataacacaatgataaatacacagttctttaaatactttgtagttttatgtaaactgtactactttggaggaaatggcttcaactattacacagtgtatgtcatgtgttacatattatatgctatatagtatatgctattaatatataatatactatatataacatattataaccccccaaaatttgaatattttatttccactggttattttctgtcagtcttgtaaattctgaagctctgtctaaaacaatcaagctgcagcaagcacagattttaaaaattaaatatgctttatggttttggtccagtgactctttagatcacacattctcacactattattatcactattattccacagtaattatttctattactggttcagttggagaagagttgaattggttacgtagggtgaacattttgtgcaatcttccaaatccatctgcagtagtcttttttttttttttttttaaacaacgtgggataatggaattggaaatataaattcaggctggactttaaatgatcatttcctccttctaggaaagtttacctgcattgaggtcaagtttcatctggaacgccaaatgggatattatttgatccagatgtacatcccaagcctgcttatagtaattttgtcctgggtttccttttggataaatatggatgcagcccctgccagggtcgcactgggcatcaccacagtcttaacgatgaccacccagagttcaggctccagggcatctctgccaaaggtaagaaatcttgcttgataacagatgacatgaaagcttcccaaaggtcttgtgggctggagagttctgtgaggacagaaatgttggccaccctatgacactgtcatagatatgaatgcaataagaggacaagaagctgagtttgagagaatcagggatctgggaacatggggaaccctcaaaatcatatcatttagaggaaagggaaattagtattgagagggaagagaaatgagtagaggcagaaacatggcttagagactctaggaagcccttgagtgcttttgatctcggttgtttataagacatgaagcttgcaagaattggagtaagactgatgcaatttatgccatattttcaagtatttattggtgaaactattgcaattcatatgtttagtgaagtcatttatagtaataaaaatttgaattaggctcctggaaatcacagaagagccatatcaataaatatatgtaagaaattaatgtacaatattagggtacagcaatctgatatatgaaacattgctatgccttaatttcctttaatggctgatatgctactatttttgagtgacacagttacccagagaaggaacagtagagtcatctaaaatggtgaaaattcctagaaatgtggcatggtgacagaggagtgtgggatcgatatcagggacatatagacagtttatagcacctcaaataataatccataagtggctgtgtaatctatttttataaaaagaaggccatctgcatttgtaaatattgcttaagcaagtaatgatgaatgtcccacttttgaaatgctctagcaccccagaagtgtgcctttgtgtgcttccccatttcactgagcacactgagccattggcttcaattttccagaatatgagtttaatttaggattcagtgtacattgtctcatactggttgagcagtctctccaaaatgcatttccggaaaataatgaagatgtaattccatatttttgctggcttgagtttatgtttggttgtgctgaatttgacataatgagaaatgttagatcatgttccacattatctcccatgtccagaagataagatgacatatggaggaggtctgtggttataatagaggtgggctgaatactggagaaatatttacacaacttattaagtcccatgcctccaaagataaacattaggttttatatggtcatagagaaaggaatagaggtatctctaatacttttttatcttctagaataacaaatagtataatgtacctgtattatttttctactggaatacagatgtcagaaatactaacagcttttttaacctgtataatcaaaaatcaattttacctaatagcacttttaatccactctgtgcccctcccaaacaggttcatttgcttatttattattagtcattagctattgccatcactgcatgccatggcattaaacctcaggatgtacaaacatatattttacaatttaatagacagctaaagtactggtgacaaactgtaagcatataatgtcaaaatataagacatttagcctccaactgctcattgctgtgaaaagagtagtcatttatcttcaaaatgggagtttgagtttttataaatttgttattcattttataaagctgttatgattctgcatcaatggtcaaaactattgctaaataaatgttcactgatcagggatctttgtatgtaaaggcaatgaggaactcagataaaccaaaagagagtaaaatcaaaaatcattttacacttggctctgaactcatggtggttatccttttgccaccattaggtttatcttcctctgtgtacttttcttatgctgttattaaacatggttggctttcaactgaccatgaggaaatgtaacttatgtggatgatggtgtgaaacacatgggataaaaagtgagtcatggaaaatgaagaattggtcatacagttacttatacatgcacatgcatgtaaatactcattttaatttataaacactgcaatccctgaccagatgctccactgtggtgattgtacatttacttcagggcctcctacaatgccccgtacagagtacacatgcacattacactttaaaagtaagatgtttgttatagaaaagacagaaaacacagaaaacatgattaatgttaaccaaccattaaataactgttgttaagactttggtgtattttctttcagtcttttttccatgtgcatttatgggcaagcccatgcacatgcacacacagaaaattgaggtcaaacttttacaccatcttagatatttagagttttcttttttgcttttgtaagtatgataattataaatacatttgcataggagtgtttgtagcccactgtgttctagataacatatatatagtttttaatttttaaaaactttcaatgagaaaaaagaaggtactgagcatgtttagagtgaatgagggaagatctatgagaagatatttgatgggatatatgttctatgcaggcaacaactttgtcttgttcattctgttaacttcaacacctagaacagtatgtggcttagactagatgaccaataaattctcatcgaatggataaattaatgatcagccatgttctcccatgtgaggccatgttgaagatattaggttggtgcaaaagtaattctggcttttgtcattaacagtaatggcaaatatcgcaattacttttgtaccaacctagtagatcagacttgaagcagaatccatgggtgaaagttacacagaaaagtatttgagttttaatgtacagaagaatctcataataatattacatgtactataaaggactggaatttctctagagtatgtctccctttccaaaaattctcaagcagactttgcaaagttaagaatatatgaacaaatttacaagaaaacaaacaaccccatcaaaaaatgggcaaaggacagaacagacacttctcaaaagaagagatttatgcaaccaacagacatatgaaaaaatgcccatcatcactggtcattagagaaatgcaaatcaaaaccacaatgagataccatctcatgccagttagaatggcgatcattaaaaagtcaggaaacaacagatgctagagaggttgtggaaaaataggaatgcttttacactgttggtgggagagtaaattagttcaaccattgtggaagacagtgtgacaattcctcaaggatctagaactggaaatatcatttgacccagcgaactcattactgggcatataaccaaaggattataaatcattctatgataaagacacatgcacaggtatgtttattgcggcactattcacaataccaaagacttggaaccaacccaaatgtccgtcaatgatagactggattaagaaaatgtggtacatatacaccatggaatactatgcagccatgaaaaaggatgagttcatatcctttgcagggacatggatgaagctggaaaccatcattctcagcaaactaacacaagaatggaaaaccaaacactgcatgttctcactcacaagtgggggttgaacaatgagaatacatggacacggggaggggaacatcacacactggggcctgtcggagggtgggggggctaggggagtgatagcattaggagaaatacctagtgtagatgatgggttgatgggtgcagcaaaccaccatggcatgtgtatatctatgtaacacaactgcatgttctgcacaggtaacccagaacttaaagtataataataataaaaatatgaacaaagacatattttgaaacataggccttgatctaaatcttagagcctttacttcactcaacctctctaagtttgtttcatcatttataaaatgagaacattattatctaccccttaaaaaaattaaatgaggatgagatgaagcagtacttatataaattgtttagcccagtttttctacatcgtcggtattcatctcatcctggttatttttattcttactgttccctgtccataatgtagtagaaaagactgctccatggcatgagaggttatattagaaaatgcataaagggccttatgaatagaagatgtcctgttctttggatggctcactattcacttatagttgtactgtcaatgagattaaccaaagtttgtcatatgtatgtgtgtacaagatacaattagtcctccatatctgcaggctctgcatctgcagattcaacaaaccatggatcaaaaatatttttaaaaaacaaagaaagcaaaacaacaataaaaaaaataaccaatacagcataacaactatacaatatttgcattgtattgggtattataagtaatctagagatgatttaaagtatatgggaggatgtgcataggttatatgcaaatattactccatttcatataagggacttgagcatccacagattttcgtatttgcaaagatcctggaaccaatcccctgtggataccaagggggcaactatgtacatatgcacaaatacacgtgtgtgttttttttacagatagttgattaaatgggttcagttccagagggtctgaataagatatgagtcaatttttccccactcactaccattaaataccctcacttggctatgtcttctctgcccctggaggattctatagattctcagtactatatgctatgctattagacctggaatgtacaaacgtgtatttttcaatttaatagacagctaaagtatcagtgacaaacagatattttaggatagtctattatcagacttttaaaaaattatctagtctgaaacaaaacttcagtctcatgtacaattcaatgctcttttcttcccttgccgcatgctcaggcctgacttgtgccttgaaaatgtacagcgatgtggagcactttgtctgttccttcacagttcctcccctgtatttccaacttttttcctcactcatgttgctgacttcaccattgttgagggctgagagtaatgggaaagatggaggaaagtctcatgtgaccgaagctgtggtatactattagtgccttctctaatggcaagcccccaaatgctggatttcttgtgaggtgaacttgagttctttggagttcccagggcatccaacatactacaccatttccagatgaataatgtattctctgggtgatgtcttaccatctcctcttagctatcacctcctagcagtatatcccatacaacttcttactcctcaggtccccttccttaataagatagcccttctggttgatgtattttccagatgactcacctttggctatcttccacaccatttattaggctcactaagaacttgtgcattattgccttgctaaatgatagaaatgcaacttaaccaactgctaatctttctgctttcaccctactatcatgggtattccagctaacctactgccttcaaaattcactcaggtaagaaagatattggtgttcacattttcatataaaacccaaatactaaagacaaatgagagattctcttaagaactctgatccaggggcaacttgttggaatttcagcagcttaccaaatatatggcatatggaagagataccagtctcttttcttacaggggtgggtataaaccaccttctatccatctttaggagaacagggagaatgccacagcactgtcaacgtccacaaattccattacttcaattaatgttttcgaatgtctggttttctgtaataatacagggtgttgggtataagagtctctagacagcattttctgtcttctagaaagtactgtatctggcatgtatatgtgcagcgtctccctttagtgtaaggctttagtaaaaatgctgaggcaataagaatatcctgttcccatactgttacacatataaatatacactcttaattttagacttttatccctatgagggcaaggacttcattgctcttggaaatgttcgtgtacccacccctcagcacaacacctggttcacagtaggtgctcagtaaagagtaaatcagtgaataaatgaacagtgttgaaaatacttgtaatcaaggggtattcccagtataattcaattgatgattcatccatccatttatttattcaactaacacttattgaatgttttatctgtgccatgcattcttctaggggtcaaagataaaacacagcccctaccctcaggggcttgtaatctgctaggccagagataggcatttggaatggtgattatttaacaatgtaggataaaaagatatatgaagtaagatgcctaacctattaagtggaggagggaagaatgggtgggtgaagaagggagagaagagagggggaaggagcaaaggaagtagagagagcaggagcagatctaggaaaatgtcctgaaggaggaagcctgagctgaatctacgaggcatattaagtaggtgaagtaggaggaggtaaagggcattccaggcaatgaggaccttctactcataatatttgggctacacttttaaaataaggctttctagaaaaaaatctgggtacatttcaaacatgcttcacacattttaaacacgtttcaagtaagaaacttgtgtttattgattccaagttaatttcctatcttcctgccaaccaatactttttgtgtttttgttcttgattttttgtttttcagaagttcaatcccttctctaaatacaggaaaatcaaataccagcatgatatgtgtttcatcggtatctttccctttgaagctataaaattggtttttaaacatacatctctgccaacccccaagaagctattgtgctggcaatacttcttttaaccgtttagagcataaagcctctagtggcagactaaaggctgcatgttgtctttcccaccctcagaaaagtatgaggatgaattgaatggaagatggaagactgagacatcaggcaggctttgcacatggcaaaataagattaaacgattattttcctttactccatgtttgttatcacagctagatgatttatagccactcctaagtgtgtcttgagtcctcatttgtggctgaagcccagagactatagaagtgaaagcaaacactgggatagctagaatgacctaggtgtgcagacgactctgacaggtccagaactgtctctttgaagcaaggatccagaggcattgtctttcgccattattaactgggatggcctatttcctatataaggaaatttctccttacttttcagccatctggtcaactaagaccagctggaccatttcaagcagctgacaaacccaggacatgcttggaatttaaaacgaaagaggccatacatagttttgccacatttggtcttgctttattccccctaccagaatgcttctaactagagattgcagtaagagaactacgaaaacagtaagactgatacctgtaggagtttttaaagatttgtttggatatctgttttagctctaaaaaataaagatgattgctccttgaatcaggtatatccccagctaatttaaacgactttcccagtatttctgaaagaagttggaaacaattattttttgtacataatcaggatcttatgaagttcttggataaagattaaaaagtaagaaagccaagcaaattgatctgcaggcctgcttgctttagccagatgtctgcatatgtaggagacttcataaactttccctcccgacatttcccaagccacagcaaattgaagagtcgttgatgtagtgagtgtgtgaaaaaaatatgcaaagagatgacacgtgagaattctctggggagagagctgaagcaccattggtactttagtttaagaatgttgttggcagcctttgcagggaagctgacagtgagagaagctatccaagctaggcttttgctcaagtcctggtgaggctcgtaagcctttggggatggcatatggaaattcaggattattttgaactctttctctttccatttcactaaaatgggtaactatgggtccaaatggcttgggttcttataaacaccacacagtgaggaaaaaaatgaactattgtggagcatgcaacacagtgtcaggcactatgttataatacatgatcacattacagacaagaagaaacagaacttctgtccttaagaagacataaacataaaatagaagattataattcagtgcagtaaaggcagatttttttacaaaatggctataataatttccctccctgtgtctacacccttgggtaatagcttcctcttacattgactgtaaacttgaccatgtgacttgtcctggtcaatgggacaatggcaaatgcagcaaaactagaggcttaaaaactgcttgcatattgaagctagctctctcctgctactcttgggatgctgtgaccactactatgtgactaagaccaggctaacctattgagtgataagagacacatggcccagttatctcaaccaccaggtgaggccatgcaaacacatgagggtgtccagccactgccatgtggaacagagacgatccatcccagatgagcccagaccaaatagttgaaccaaagaatcgtgaacaaataaatagctgtcattttaagctactacatcttggggtagtttgttacacagcaaaagttatggctgctaagaaggatccttgatctagtctggaacttcctggaagaagggacatgaggaagcagcacctgaactaaatttttttgaaaatagatgaagtttttatttggacacaaattcttaccaccaccatgttttaaataaaatgactgatattaactttagtgtccttggaacaagtctataataagaatataggataagaatataagaatatcgccatttagtctggtgatgttctttctaattttgaaaccactcttaaaatttaccatttcttccaggaagctttctcaaattctttggaaaagtttcctcatagctttccataagaagaagcctcaattaggcaattgttatgtgcctacctctctttataaaatatctctcatggcccaggaaggagcaggatgctgatgataaacacaccaatttgagcactcactaacaattgggcaagtttccatttttgtacatatccttatactaaatatgctcatttcatgagacagaattatgtgtttgtatacatgcatgataatgtagtcatttatgtaaagggtattatgtttatgaattaaacagagatatagtatggtaatgtttatgtaaacggcattatgtttatgaattaaaataaacatatatatagcataataaggaatattagaaagctttcagctgatgcagtaattttctgttgctgtataataaactttgctacttaaaatacccatttattagcttgtaattctgtaagtcaaaagcctggcttagcatgactgggttctctgcccagggtcttataaggctgaaatcaaagtgtcagctgggatgaggttttctttggaggttctgaagaaaaatatgtttccaagttcatttttgttgctggcagaattcagctccttgcagcagtagagatgaggcccccgttccttgctgctggctgttagccaggggctgctcttagtttctagaggctgtacacatttctttacacgactgtacacatttcattacacgtggtgccttccattttcaagtcagaaacagcacattagttccttcgtatatttcaaatctttgacttcctctatacccagatttaaagggcttgttaattagatcggacacacctaataatctctgtgttttaaggtcaactaatttgggatcttaattatatctgtaaaacccctccataacagtctctagatcagtgtttgatggaataactagcaggattatgcacagccaggactggaactcttggggtcttgggatttagaattctccctaccacacctttgtactggaatattctttggatagtctccctgattccattttgccttctatattgtattttcaacacaacagccagaaaagtcctatttagcacctccctgttgaacatcttcccgtagctccctgttgaacatcttcccatagctccctgttgaacatcttcccatagctccccatcccactcagagcaaaagccagtgtcctcactatggtgaacaattcataatctatcccctatttcctcttgatctcatatcccactaacctaccccctagctcactgcttcaggcacactgaccttcttgctgtttcccaaatatagagggcatgtgctctgggcccctgcaatgattgttttctgtgactggaatgttctgccctcagatagccacttgactaccttctctaccttctctaaatccttattcaaatcttatcttctcagcaaagcctggtcattaccactctgacctaggctctcatcaataccctgacctgattcaactttctaattttttttttgtttccccgcagtactttattaccttatagcaacactatcatttatatcaaactctattatggattatgtttattgtatattatctgtttcccttagcttgattataagctccatgaaggcagggttctttatctggcttgctcccttcaatagcatctagctcacagtatattctcaataaatatttgttgattgaataatgaatgaacatctacatctctagagttgggtcactgagaactatccatctaacctttatctaagatatgaaaagaataaaagggaacctacctagccaggcgcccccccgtttttttttttactggttattctttaccacagagaatccggctgcatatagtatgttattctaatataataacattttataagtttcacttctctgatagtatcaagtagtgttacatttctttttctttgatatatatttcttacagagtaatctaatcaaagatataataataaaataaaatagtggtttagataagagggcatcaagacagactatttttacctcagctttgcttcctcagcactgtcacaactaatttgggggtttctcggtgtgctgacgcaagcctccattgtcccttctcgcttctccagttttttaggatgcaggcttattctctgaattctgataaaggtgtctaaagatcttctcatctggactctatacagcagctctggaccaaaggtacagccccacactcttccacaggagcccaaatgccagaaaattagcacctttttctttatctagcaagaactgagtaaggttttattttccttgatcttaaggtgtcattaaagactatctgtgcatttgaatctaaggattgctttgaacttcatctaggacttaagaggccatgaactccaatctgaaacaaactacaaactaaagcaaaccattttccatcctttatcacaaaatggggactgggactgcagtttgctttccaaaaatgactataacttaaagaaactggaatatcaaatatattccagattacacatggattggtctcataaaatcttagagttctgcgttagtagagcatggggcctcagcaatcttgttagagatgagaaaactgatgttgatgaagattaatccacttttcaagagccacttgaagtagatgtcacttcttacatgaaccccttatggtttgccattaggtgtaaatggcctctcttccttacttccacgacgctttcttgcttccatgccactttcaatcattgcattctgacatggggcttagtgatcagggcccatgtgtacttgctctaacaaactgtactataaattccttttggagaaggccatatgtttttcaactttgcatgacccgtatgacttaaacagaagagcccgtaagtagttattgtggaagtactgtaaagagacagtgttcagtggctcctgattctctgtgatcaaggtaagaattagtgttggagtttgtcttaataaggaagggtctctaaagcagggacctcaaactttgctacacattagaatcagttgaggagatttcacaggtttcccagaccctaccacaaattaaaccaaactatctgggcatagggtccagacatcagcattttttttttaaaactaaaagtttgttctgattatttgttcttttttttttaacactttaagttctagggtgcatatgcacaatgtgcaggtttgttacacatttatacatgtgccatgttggtgtgctgcacccattaactcgtcatttacattaggtatttctccgaatgctatccctccccctgtcccccagcccccgacaggccccggtgtgtgatgttccccatcctgtgtccaagtgttctcattgttcaattcccacctatgagtgagaacatgtggtgtttggttttctttccttatgatactttgctcagaatgatggtttccagcttcatccatgtccctacaaaggaaatgaactcatccttttttatggctgcatagtattccatggtgtatatgtgccacattttcttaatccaatctatcataggtagacatttgggttggttgcaagtctttgctattgtgaatagtgctgcaataaacatgtgtgcatgtgtctttatagcagcatgatttataatcctttgggtatatacccagtaatgggatggctgggtcaaatggtatttctagttctagatccttgaggaatcgccacactgtcttccacaatggctgtactagtttacagtcccaacaacagtgtaaaagtgttcctatttctccacattctctccagcacctgttgtttcctgactttttaatggtcaccattctaactggtgtgagatgtatctcattgtgcttttgatttgcatttctctgatggccagtgatgatgagcattttttcatgtgtcttttggctgcataaatgtcttcttttgagaagtgtctgttcatatccttcgcccacttgttgatggggttgtttgatttttttcttgtaaatttgtttaagttttttgtagattctgtatattagaacttagtcagatgggtagactgcaaaaattttctcccattctgtaggtttcctgttcactctgatggtagtttcttttgctgtgcagaagctctttagtttaattagatcccatttgtcaattttggcttttgttgccattgcttttggtgttttagtcatgaagaccttgcccatgcctatgtcctgaatggtattgcctaggttttcttctggggttttaggtctaacatttaagtctttaatccatcttgaattgatttttgtataaggtgtaaggaagggatccagtttcagctttctacatatggctagcaagttttctcagcaccatttattaaatagggaatcctttccccatttcttgttctcgttaggtttgtcaaagatcagatggttatagatgtgtggtattatttctgagggctctgttctgttccattggtctatatatctgttttagtaccagtaccatgctgttttggttactgtagccttgtagtatagtttgaagtcaggtagcgtgatgcctccagctttactctttttgcttaggattgtcttagcaatgcaggctcttttttggttccatatgaactttagttgtttccaattctgtgaagaaagtcattggtagcttgaaggggatggcattgaatctataaattaccttgggcagtatggccattttcacaatatcgattcttcctatccatgagcatggaatgttcttctatttgtttgtgtcctcttttatttcgttgagcagtggtttgtagttctccttgaacaggtccctcgcatccctggtaagttggattcctaggcatttcattctctttgaagcaattgtgaattggagttcactcacgattttgctctctatttgtctgttattggtgtataggaaagcttgtgatttttgcacgttgattttgtatcctgagactttgctgaagttgcttatcagcttaaggagattttgggctgagacaatggggttttctatatatacaatcatgtcatctgcaaacagggacaatttgatttcctcttttcctaattgaataccctttatttctttctcctgcctgattgccctagccagaacttccaacactatgttgaataggagtggtgagagagggcatccctgtcttgtgccagttttcaaagggaatgcttccagtttttgcccattcagtatgatattggctgtgggtttgtcataaatagctcttattattttgaaatacgtcccatcaatacctactttattgagagtttttagcatgaagggccattgaattttgtcaaaggccttttctgcatctattgagataatcatgtgtttttgtcattggttctgtttatatgctggattacatttatcgatttgcgtatgttgaaccagccttgcatcccagggatgaagcccacttgatcatggtggataagctttttgatgtgctgctggattcagtttgccagtattttattgaggatttttgcatcgatgttcatcagggatattggtctaaaattttctttttttgttgtgtctctgccaggctttggtatcaggatgatgctcgcctcataaaatgagttagagaggattccctctttttctattgattggaagagtttcagaaggaatggtaccatctcctctttgtacctctggtagaattcggctgtgaatccatctggtcctggactttttttggttagtaggctatcattgcctcgatttcagagcctgtcattggtctattcagggattcaacttcttcctggttttgtcttgggagggtgtatgtatgtgttgagtaatttatccatttcttctagattttctagtttatttgtgtagaggtgtttatagtattctctgatggtagtttgtatttctgtgggatcagtggtgatatcccctttatcattttttattgcatctatttgattcttctttcttttcttctttattattcttgctagtggtctatctgttttgttgatcttttcaaaaaaccagctcctggattcactggttttttgaaggggtattttgtgtctctatctccttcagttctgctctgatcttaagttatttcttgccttctgctagcttttgaatgtgtttgctcttgcttctctagttcttttaatggtgatgttaggttgtcaattttagatctttcctgctttctcttggggcatttagtgctataaatttccctccacacactgctttaaatgtgtcccagagattctggtacgttgtgtctttgttctcattggtttcaaaggacatctttatttctgccttcatttcattatttacccagtagtcattcagaagcaggttgctcagtttccatgtagttgtgtggttctgagtgagtttctttatcctgagttctaatttgattgcactgtggtctgagagatagtttgtaatgatttctcttcttttacatttgctgaggagtgcttacttccaactatgtggtgaattttggaataagtgtgatgtggtgctaagaagaatgtatattctgctgatttggggtggagagttctgtagatgtctattaggtctgcttggtgcagagctgagttcaagtcctggatatccttgttaactttctttctcgttgatctgtctaatgttgacagaggggtgttaaagtctcccattattgttgtatgggagtctaagtctctttgtaggtctctaaagacttgctttatgaatctttgtgctcctgtattggctgcatgtatcattaggatagttagctcttgttgaattgatccctttaccattatgtaatggccttctttgtctcttttaatatttgttggttgaaattttgttttatcagagactaggattgcaacccctgcttttttttgttttccatttgcttggtagatcttcctctatccctttattttgagcctatgtgtgtctctgcatgtgagatgggtctcctgaatacagcacactgatgggtcttgactctttatccaatttgccagtctgtgtcttttaattggcgcatttagcctatttacatttaaggttaatattgttatgtgtgaatttgatcctgtcattatgatgctagctggttattttgctcgttagttgatgcagtttcttcctagcatcgatggtctttataatttggcgtgtttttgcagtggctggtactggttgttcctttccatgtttagtgcttccttcaggagctcttgtaaggcaggcctggtggtgacaaaatctctcagcatttgcttgtctgtaaagtagattttatttctccttcacttatgaagcttagtttggctggatatgaaattctgggttgaaaattcttttctttaagaatgttgaatattgtcccccactctcttctggcttgtagagtttctgctgagagaactgccagacatcaacattttttaaagctgctcaagtgattctaatgtgtagccagggctgtgaactgtaactctaaattttactgttatgtggggaagtgttttcactatgtttactatgtgtcatttaaagttcacatcaacccaacgaagtaggtactattattatccctactttatagatgaggatactaaggcacagaagggttaaataccttgctcaaggtcatacagagctagaccttaaactagagctagatctcgaacccaggcagtctggctccaagttggtgtgtttaatcattatgccataccacttttcatagtgaacaattattgagctccttttagatgcctttcattgtgctaaacgctttacatagattatctcatgacatccatatgaggtaagtagtattttgcatcaccaatttatatgtagggaaactaaaacataaatagcttaagcagtttgtggacagttacatttgtagcaagtgaagaacccagatttaaatcagtagtcaattcaaatcctctaaaaggaagaactaagaattttaagtcccatcacattgtccatactatgctaattataggcggtagcccttatttgtgaaataagttattttctagactgtgaaatccctgtcttttggctatgcatactgaattcactgtatattacatgcagttcacatattgtttatcattttattgaagaggcaatgcttgcctgattgccctttctctttcatattaggaatactttataatggttcctgaggcttccagtatgcaccctggatttgttgacaagcacattcctcctcagcacactttctcagtttaactcagttgctgtttattgcctctatcagctgtagccattttaaccatcattttcatcaattcacagcatgtgagattatgttaagagcccaaccaggtataagacattaactgtcattcagtggcaactaaaaggttgaaggaaagcacattggatgatcattgacaataaaatggttaaaaagattgtagcctattcattcaataaaataatagatgtaaataaaaatgaaggaactgcagtcacacataacaagagatgaatctctcaaatctaatgttggggaaaagttaccaagaacaaaagaatatttgctgcataattttatgcttattcagttgaaaaagagcagggaaagttaatctatggtactcaaaccagaattatgattggatttggaaattagggaaagtagcgattgagagggaccatgaagagctaggttttcaggagcaagtaatgttctatctcttgacctgggtagtggttacatggttatgttcgttttgtggtgattcattaaactatacacttgtgatctgggtacttctcaatatttaaaaaaataagttaaaaacggattgcaacaataatgaatccaaatagagaacactcacataatttaggaagtttcctctttttccttttccagaataaaaataatacaagctgatatttattcactctatgtgccagacctgcttctaagtgctttttattcatatattatttaatcttctcaaccctataagatagatattattggtcttagataagtaaattgagtctaaactttacaactaataagtgccaaagccagaatccaaacttcactggaccctaaaccctattcctttttcactatgctgctctccttcccattttatagtgactaatatcccttcaacctttaaaatgtatgtcctccatgccagttacagcttgtacgcttaagggttgattgatgggactggagggttttggcagcctagagattctttccatatttaagttcacaattttgagtaatcacagtaaatcctccatctagttctgaattctcactggaacagtcccaccttttatctttagcttcccattgctgtttcctactcacttcctgaacaactctttcgtatggaaagggttattaagagctttctgtcattggagagaatctgaaggtaggtacaagatattaaacagaaattggcacctaataatgtttcttgccctatgtaaccctaagtaaaagagttcttaaaaaatgaattaatattttgtaattggctcatatggaagaccgtttcgttttacaatgaactttgttagttccaaaccgtatgtgtagatttctctttttgtgggactctgtagaaagtatgctggacaaatacggaaatagcattgattataggattagtctaatataatttcaacaggcaagaattaggtaatggtcatagacacagcagtccagactttcaagtatagtgagggtatcgtggtttgacagcaccaagacgtaaattcattttggggtatactaatgtccaggcatattggggattgcttgttgggccaggcataatggggattacatgaggacaaagatgattcttttactcatttatttagtttttaaaatatttacaatatattctgaattctaagacatactttttcaccttttcacatttctgagtttgggttgcgtcttaaaattgaaggcaaaatagaatttaattagagatgtttgccttagtggcatataaaataatggtgcatcttatgattgctggcatcttagatttaatgaactactatcctaagcttctagagccagccacagtgcttggcactgggcatacagaagtgagtaagacagacatgttctcagccctcagagagctcacatcccactgtagagacaaatattaagcacaaattaatagataatgcttattaagaagtaactctgtgtgtcatgagaacatgtaagaaggaaactggtgcttttccagttttcccaaggaagtgaaggctaagtgggattttaaggcttaataataggtacctatataaaggtggcagaggacaaccccagaaagggaaactggtctgtaggatttgaagttggaatgagccagtaaacttcagagaattagaaagaaagactgtgtggctggaatgtagaggacaaaaggggaaatggcaaacagggaggcacataggtcacacaggacctcatgggccctagcaggaagtttgagtttcctcattatggggatgtaacataatccaattaatttgtttaaaagggctgcactgattactgtgtagagtaagatttgagaggggatagggtggatgtagggaaactagttggggagctacagctataacaagggagaggtagcttaggcgagatactggctgtcggaatgaagataaatgaatggattcaagataaatattgaaggtagaattaatgggacatagcaattgattatatataaggaattggtggagacagaaatggggccaaagccaactactgaagacacatcataagggatgaaaaaatgaagacccataggcttgaccgaaggacaacacatcagggttggaaggaattggggctttgagtacagcctggtgtcttgtaactcaggcatgaataatagagaaggaaggctgtgaggaacagtgaaaagccttccccataaagcactgggagcacaagaagcactgatttgtagcttacttaccaattagtgtcattaggtaccgaagcatacttccccatttagggctattgttggagcacagtgtgattcagtagtgcccatctgaaccagaaaagtagtgggagagttcattgcctgtggttttcatcaacaggaaacagtaactgcagccctacctctgtgacaccaccataggttcatgaccatcagcctttggcagaaaacaccactcaggggtttttaaattgagatgtttagaccatttcgatttcctatgactgttgatatgtttaggtttaaacctaccattttgctatttgtctttcatttgtcccatttgttctttgtaaacttttcctaccttcttttggatatcgtattttttaatgcatgtagcctttgttagcctattgtccataactctttttgtgttttttaaatgctttagggtttatagtacatatattttacttatcacagtctaccttcaactaatattatatcccttctcatatagtataagagccctacaaggcaaacttctatttcttctcctccagcttttgtacaattgttgtcatatattttatttctttatatatcataaaccccacagttcatttttattatttttgtctaaacagccaattatcttttaaattattccactaatttgaaaaaatcttctgtattcaccttggtagttaccatttccaatgtacttcatttcttgggtagatacataattccatctggtatcatttttcttttacccatgggaattattttaacattttttatagtacaagtttgctggctgtaaattatttcagcttttatacgtctgaaaagtcttttatttcatgtttgttttaaaaagatatttttattggttataaaatattagatggaccttttttccccctaataagtagcttaaagatgtttctctaattgtcttcacacttgcactgtttccaatttaaaaatctgctgtcatcttatatttcttcctgtgtacataatttgtcttttttcctctggtaattttaactattttcatttttatctggttttgagcaatttaattatgatgtggctcagtgtaattttcttaatgtttcttgtgcttggagttcatcaagcttcttagatttgcagatttatagttttcatcaaatttggaaaaaatgtatccattagtttctcaaataatttttctgtacccttttctgtatcctctccttcaaagacttaaattacatgtacatcaggctatttgacattgttatacagcttactaagcatctgttctctttttggtcctttatttttcctcttagtccatttgtgctgctataacaaaataccacagactgggtaatttacacagaacagaaatgtattgctcacagttatgaaggctgcaaagttcaagatcatggcattggcaggtttgtcgtctggtgaaggtttggtctctgcttttttttttttttttttaataccttaagttctagggtacatgtgcacaacgtgtgggcggtctctgcttttaagatagtgctttgcacactgtgtcctctggaagggaggaacactgtgccctcacatggcagaatgcagaatggcaaaagaggatgaactccttccatcaagcccctttataagggcacctaattccattcatgagggtggagtcctcattactcaatcacttcccaatactgttgcactgggaattaagtttcaacataaattttggagaggacaaaacattcaaatcatagcactctgtttcattttagtttttactgtcttattttcaaattcattaaccttttcttttgcaatgtctaatttgctgttaatctcaattcagtatattttccatctcagacacagtactcatctctagaaatttgatttgggtcttttttatgtcttccatgtctcttgttaacctagtcattcttttatctagctttttgaacatatagaatgtagttatagtaggatttgatgtccttgtctgctaattctaatatctgtgtcaattctgggttggctgcaattggtttctttttctcttaatcatgtgtgttaatttcttgcttctttgtatgcctggtaactttttattagattccagacattgtggtttttatcttgttgggtggtggatatacatataattgaaactttctgggacagttacttggaacaatttgatttttttttgtcttgctcttaggattttttagataggcaagacccctttgagcactctatttaataccttatgaatgatcaacttttccagtctggcttatggaaacaagaactgagaactgcaagttctgttttctctaattcttttgaagattcttcccctagcctcagttactcttctcacatgcatgcacttatcagtactttgctgagtgctccagaggaatcctctgcagacctctggagttcacacatacatatacaccctatagacagagggagagagtgtatgtgtgtgtatatattgtcttgtgtgtgtagacatatatagacatacatatgtatatgtatatatatagacatacatatgtatatgtatatatgtatatacaatgtatatgaagacaatatatacaagtgtcttcattctggtactcttctctgtgaacttcagcttctgtggactcaacagaccctcagatccatcttttcaattctgggaattggttgggctctgcttagattcctcctccttgcatcatgacctagaaactttctctagacagtaaactggaacaatagtaggcctaacctcatttgtttcctacctttcagggatcactgcccttttttacttgatgtcttttgccttaaaaaccattttccaaatatattttaaccaaattttttagttgattcaggatggagggtaaatgtggtccctgttactccatcttgacgttaagtggcaatcactgccatggttttgaatccttgatttctttttaaaatttgacatggaatgtgaataaattgaatgtgacaatgtagataattgaaataattatcacaactagcattagcttgtaaatgcttagttcagttgttctaatcaatgaagactatttattaaatatatcatccatgaactctaagactgagaacaaatttttgtaaaggaattaataattggtatgtacagtaataaatattaatattctaatagaaatcagttttgttctacaaaatgtttcatcaaaaggtttgtttcaaggtaatatcgttcaacatatttaggcttataattgctgattcttaactctttttaaataatacactgtagactgctttggggggtaggggaccttattcccatccagcaacctctttctacatgtcaacgaaccatttttcttaatggttcatacttaacgccatggatgctgccactaaatcacatattcactttaatttggtttaaatcaatttaataaatattcaaggtacacatactgtattaggtattaaataggtcaaaaagataataagatagtttcttccccatgaggaatttatgatctagtacaagagtcagcaaacatcatctgcaaaggaccacatagtaaatattttaggcttgcaagccataaggtctctgtcacaattattcaactctgcagttgttacacaaagacagccatagacaacatgaaaacaaatgagcatggttatgttccaataaaaccctgatccaatggaaaaaagcagagaaacacaacatagaacaatagatatatcacaaagatgaccagaaacaagtgtcatgggatgtcaaagaagggagattcatatcttaatacttgatttgtaaatacaatgaattggctaggtgcagcacctcacgcctataatcccagcactttgggaggctgagttgggaggactgcttgaggccaagagtttgagaccagcctgagcaacatgatgagaccctgactccacaaaaaataaaaaattaactgggtgtggtggtgaacacctgtagtctcagctacttgaaaggctgaggcaggaggatagcttgagcctagttgttcaaggttatagtaagctatgcttgcaccactgcactgcagcctgagtgacagagtgagactgtatctctaaaacaacaacaacaacaacaacaaatgaatgatttaagagaggcagcaatatctaagctgatgtatttagacagaattacgaaaagcaggaatgacagggtgtattagtccattttcacactgctataataaaatacccgagactgggtaatttataaagcaaagagtttaattgactcatagttctgcgtggctggggaggcctcaggagacttaaaatcatgatggaaggggaagcaaacacatccttcttcacaaggaagcaggagagagaagtacagagcaaaaggggaacaaccccttataaaaccatatagtgcatgaaaactcacttactatcatgagaacagcatgggggaactgcccccatgatctaattaccttccacaaggtccatcacccaacacatggggattacaattcagattacaattcaagatgatattttatttttatttatttaattttttgagatggagtctcactctgtcgcccaggctggagtgcaatagtacgatcttggctcactgcaacctccgcctcactggttcaagcgattctcatgcctcagcctcccaagtagctgggattacaggcacccaccaccatgcccgactaatttttgtatttttagtagagacagggtttcaccatgttggccaggctggtctcaaacacctgacctcaagtgatccacctgcctcggcctcccaaattgctgggattacaggcgtgagccaccacacctggcctcaagatgagatttgagtgaggatatagagccagatcatatcacaggagaaaacctgaaataactaacagtgatgagtaagcactgaagattttgggaagaagtacatagttctgtttggctggtatgttgattatactaaggagtgtaatagaaaaataaggaaaatgtaaggtctttggataaaccaaggcagaaataatgtcttcctcttgtagacctgcgaagctcctgtctttggtcttttattttattctgccttatattatggttatttttgcacttctgtttgttcctctactagacaatcttcacatttagggcagtgattatatcccattcaactttgaattctcattgtttctagcacagagatagaacccagcagcagagcaaaaatattgcatggttagtaatgaaaacatccacttcaagcccaaaccatttggacttatcaaatagacattgaggtcctacagaaatggtttaaagactagcctactgacaaggaatgaaaatgttcattccttatattagcacctttatttttcaacaagggctttggttagagatctttcaactttatgtgcgttaattccctcataatgtagatttgaccatattagcagccacttgaaatacaacttctaagttgcaattctccacaatctgtttcgaggagagaatccagatggataagtactggggttttagtttttaatcaaaaggttaattaagtgaattaatctttatgtttgaatacattttgcatggaatttggagtaaataaatgggttaaaatcaaatcagtataatattaaaatgaatactaaagcttaggaaatgagttaaaagcttatgcgttctattatgtagcagcagacaaaattgtctatgtcaagtttaacctgagaagagaggaaagctgctaataaagtattctcaaatcctcctggaatcactagtatcgtcatagaaatcattttttaaaatgtataatgtttcacagacatagtttccaagcaattctttaaagaaaaacaccaagcagttagcatttaaataaatcttttgaattgcaatgagagtaaataactgcagaattataaatgagctgtcatgtccactgagaaaatgaagacagcaaaaatggaatctgaccacacacatgtggctgagggaagaagaggccgaggataatttaatgaagattttctagaagcaaatagtgccaccatccgtcatgaggatctgtttctataacgcttgtgtgtctttgagactacgtaggtggtagcttatgagtagtaatgttcttttgttagtaaatgtcaccaaataagcaaataagagaaacatgaaggccaaaaactgtgttactattcaggagaaaatggacggtttagcaacaatacaatgtagacttcaaaatatgaaaaatcaaggaaatttctgtcattgtctttaagggcctccagagaagtattaatttgttctttatgtgaatttaatgagatcatgtgaaatgtatgtctcatgttatgtctattgaaaacaattcctagggagaaattttgggtactgtatatttcctatccccaaatcatggggatcaaacattgcagtttgaattgagagcaaagagatgcttccccttgtgccctaatagaatcactgctcctggtatttcctggaccaactgagattgggtcaaatgaatatgatagggtatgtccaagaaacacaggagccaactgaatgagttcccagtgaccaaagctggaactatttaagcaacaaaataagtaaagtagtattgaattattacccacatcgtaaaacaaatatccataaggtcatactgatataaataaatgattgcataaaaataattgaggtagaaaaaacaaatctcccatgcagaattccaaataactcatatagatatattctgccctcaaggaggtagagcataactccctattacttaaatgtgggctgcccataatgacttcctcccatagggtacagtatggaaagtagaaaaaagagtaactttacagtagagaaacctgacaaatacgaccttagtcaggtgatcaaggtcagtatcaacaataagtcatattgattgtatataacctcggtatgatgtgatgagaagggcactttatctctgtggtcttccttccaaaaacatataatcccagtctaatcatgaggaacacatcagacagttcccaatggagggacatgttacaaaatacctgagtggtattcagcactgttaagttcatcaaaattaaagaaagtctgataaagtgtcacagctaaagggatcctaaggagagaatgataactaaatgtaacatggtatcctggatggaatccttgaacaacagtaagaaaaaaagttagataaaaactaagatatcagtattgatctattaggtgtgataaatgtaccacgccatagtaagatgttaacactaggggaaactaggtgtgcggtttatgaaaactgtattatctttacaactttctataaatctaaaactattctaaagtttttaaagtttattttaaaaagtgataaatatttgaaagcaactgaaatgtctcagaatctaagaatggatgtgtgcttaggcattcaaaatggactggaaggctggaaaaatctggaggaatcctctttctctgtctctgaataagagacctaatttgttctattctctctctcattcttccttgtcccttatccacaaaaggtagaaagcctggctatggacagtgccaagatattcatgttaaaaaaaatactagacacctggagaggaactgctctttcttttgacccaattccacattctcagaggaaaggatcattcactttgaggcaggagttcacttctgattcctatcatctgtgatgggggtagggtcagggaagggactctgattagcctagcttaggtcccctgatcaccctggacaaatgaattgccatcaagtgagtagagttacatgtatgtacctgacttcccagtgtatcacccctgtggatggtggggaactatgggggaggtggaatgagaaagaaaaggcgcttctcccaggatgaaaagtggtggaaaggacagaacaggttccacccaataaagctaaaggaataaaaataaagtatctaagtgagagagggagtagacttaatatgaaacataaatatttagcacttctgaaaatatgcaggtctaaaatcttctatccacacttatgaaatctcctaagctctgaaaaccaaaaggtttcccacagctcatttggcagcaaaacctgttctgaactgatgggaggctaattataggctttgcatatcccatttagtgtgaatattcatactgttttccaaagaaatattaatgtgtttgattacagggtcttccccaagccccactgggagtaaggggcatgtaatacattgtatacgtcacagtattaccttaataaaatctgaataactctgagttacagtgcataattgctcccacaggtttcatataagggatacatttataatactacacataatcacataaataaatgtccatttttatgtagctctgaaaacaagaaccacaaaaataaaaaccatacaagaaaacaaacatgctctttttttaaaccatctgaagaagtcctggatataagcaaggctaatactagtattacattttagaaataaaagaggggtacttagagaagattttactagagacagggtagggtctgagtaccaggtctcctaaccagtaatccaatgtctttgaactgccaccctgcatttcagatgaaaaagggttattgaaatggcattgttagcatgtaggtaaaagggtaacaaaacaacttaataggtggcttctttgatatttggagaagtatgaaaaggaaggtttgccaaggatttttggggagggtggtggtgggaggatggagtagagttgactatataggaatctgcacaatgtactttcaaaacctataattataacttttgccatatcttcaaaaaaacctattttcatggtatttttccttgcttttgcaactaacagctttcatgatcttctttattatttatatgaaggccaagtttcaaatattgtttctcattcaaataaacatgtggccatttactaatgaggaattttattttgttatttttacattaatggtaataatgaaatattatttttatccttccataaaccaatgatttccattacttttgggtttgaggaccttccttttaatatcaaaatatgccatgtctcctagatgaaagtaattttatgtttggtatcaacttcctgaaaatataattgcaaacacaaaaagctactatgaattcaggtacattcacaccagcacctatatgcatttgataattaggagcatataaatagaaagtataatatttattctactcacaatgtgttgtggaaatatgaattcctagaaatgtctaaatctccttgtattatagtccattcctgttttgactaatttaataaaatttactaatattaaaagccaaacagagtaaatggaatttaaaatatatatttgatatataattcaaataccataatgtgcttagaataatgcctctcacaaaagtaggcactcaataaacacttgttgagtgaatacctaaatactcaaattcttggtgaggcagtcttctacagtagataaaacatccagggttcatacttccttggatctgaatcctttgttgctggtaaatacccttgatcaagccaattattacacttgctacctcttaaggctgctgtaaggtcttacatgatatattccgtaagtaaagtctaatgtggaatattcaataaaaggtaattatctttctctctcttccttcaaattcctgctaatcttcctcaaggagtcactcaaacttccttcccaggagactcaatgggaaccacttcccagtgctgagaaatatgacactgtagaccttatccctcatgagggcagagaaccattgtgtacccagcacagcagacatcttggtatgaagcaggtgttcaatatgtatttgttgaatgaataactagaggaaaattaagaatttcccaatggaggaaatcctgtatcagacaaggaaatccttaacatttaaatagttaaattaggcaacttaacagtcttagaggaaaattccctcctgcactgcaattacttatgtttttctctattcagtgacaatgcttccctattttagtgccagtgtgggaaccccagggacaactgtcaaaaccagctcttcagttctgtgccctgtgctttctacccctcaaacactgcacatcattagcaatgctgagacttgtgttgcctttgtaaaatttctaaattctaacaaatgcctggagaccctaccaaaacaactgaaactggtgtaaacttgaggaaagtttactctcatttaaataaatccctgtttgttcacttgccttatttgttctttttactgtgaatgttttcatatagatatttaaaaactttattacttggcagaatatttgtaatgatacaaagaactgctacacagatgttaaaaatattcatagtaaaaagtttttaaatgatatatagaacaagtatatttcatatgtgaatttcacatatttggtgatccaagtagtattcccaattggaagaataccttgcaactctgttcctatgccattgcatggtttctccttctttgcattgtcacagtatagtaatgcccaacccaaaccatggcatgtggatacacattttaaattgatataatttttaatgtttgctttccttaaggatttgtgtttattttttttttaaagcaagtcttaaacttcccactactttgccaagagataggcaatatacaacaggcacttttaagaaaggaaacgtgcaatgcctcaccatgtttgcttggaagatccctaacattacgtggtaaactcatcacaaaaaaacgtaatcactcagcaaatatattgcttgtaccatgagcaaaggaatatcatgcaaatgaaaagaaaataaaaaagagctaaaatgtcctgttctatcgcaagtaaaacatttgtcagacacaaagtcttcttttcctttttctcagagtaaaacatatacattaaaatgcataaaatgcccatgtacattaaaatgccataaaatgttaagggtacaattcataaatttttatatatgtatacatttcagatcaagatatggaatatttctagtgtcctaggggtaactactgttctgacttgtttaactattgttacttttgcctcttactgaacttcatataaatggaattttgcagttcgtattctttcataactggcttctttcacaaaactcaatccctgtgggatgtatctgtgttgtttgtataactgtaattttttcccttttgttgtccgttctcctgttggtgggcatcacttccaggttttagattattatgtattaaatcttctatgaaaatttggtacatacttttgatggacatatgcacacgtttatcttgacaatatatatatatataggagtagagttgctgggctataaggtattgacatgcttgactccagtgtgtattgacagttttcccaagtggttgacacaatttacagtcccctagcaaaatatgagagttccaattgctccacatccatgtcaacactcattattgtcaggttgctacttttttcaatgtagccattcagatgacgtttagtggtagctcattgtggttttaactggcatgttcctaactactaatgataccaagaaaacaccttatcacatgctcagtagccatttagttgtcttcttttgtgaagtgcttgatccaactttttgctcattattttcttacccaagcacaagtctggatttgaactctttatccaagtactctatgttgagttctacatgattttaataaaacagtctaattaagtttttcataggtaataatttttgccttttttgaaattctctgtggtgttttcaaaagcagtggttttaaaaggaccattttttcaagagcagcattctatatggcaggaattctgtcttgcatatattatcagaagtaagataaaatcccacagtttggtggttcagatgagatatttgggttcaagccatatgaagttagttttatttacatacctctgatacctcatctataaaatgaggataataataggacctgcctcatagtgttgaggagatcatcggaatagacctacatgaagctctttgggtgatgcctagtacattgaaagccctcattaagtttggctattggtaacattcttggggtgtcatattaggccctcattgtgtccgttaaggttagaacattatccaacacactggggaaacattcacgtgttgatctggaccactcagacataaactgggtggattgggtctgaatctccaggtctagctgtgtgaaatgaccactgaaatgattactgaagcctgttgtaaatgtactttctggtccatctggcttttcagacccaccatatgcctaatggctctgttggtatatgagttaggagggcccatgccaaattatacatattcgtgactggtaaattgttcagtctggctctgggtagaaactaaaagatttaggagggaaagagcagctccctttacaggcagcccaagacacaggagcactttaataaaatagaaacttaggttccacaagaatcatcttgtaaaatctgcagtaacactcctataaaggttatatattccagggcatccaagtggccagagaaagcaagtcaaatgtgacaggagaggaaattgcctaaataagagaacctcctctctgccagtaacttacagggggccatggggtttttctctcattaagtccatctgcctgggctgggtgcctggcagttcttctgctaatgagaatctgctcttcctaatactggaagaaataagtcttcatctctacctctttgcatgtgccagtggcatgtcagaaacaatttttctgtgcatttcaaggcacagctaagtatgattattcagtcacccagctccttggccattggatgcagaggacagagaacagcgctgactgcctgtccttcttctgctgagtcattggatttcagaagggaatcacatcctttatcaatctatgccatcaagatattagcttcccataaatgcttatgtgaaaatgtgcaatgatttgcatctggtcatgatttttttttttttacaatacatcatgttatagctatattaatttcttactattatatatccatatagcatgtaattgtttttattttgcttagtttttttcaactttctacttcctgaattttaagaaattgacacaggaattatttggctcaagggaaaaatagactttgagtccttttgcatattcttattgatcaggtatggtaggcagatttctaaaaatcccttttcccatcaagattacatgcccttttcccctagaaccagtgagctgataagatatcatgtccatgattgcatcatggtatatggtacagttgaccctaaaataggaagatcatctaggtgggccagatctaatcagactatcccctaaaaacagagatatttctggcagaagagaaagtcagagagatttgaagcataagagagattcagctgtggcttgaaaatagcggtaaccacaggagaaggaatgttggcagccttaagggattgaaagaagcccctggatgacagcgatcagggaaacaggtatgttagttgtgtaactgcaaagaactaaattctgccaataataggaataataaccttggaagaggactccaagctccaggtgaaaacacagctggttgatgcattgaattcagcattgtgagacacaaaacactcagccatgatgtgtcagacttccagcctacagaagtgagctgatacatgggtgttgctttacaccactaaatttgtggtgatatgttaggcagcaatagaaaaggaacatacctggtttcttctcattgcattcttttaaatggctgaccagtagatgataattgggtagaaaaaattaaatggcctgagaaatacccggggttagtttgggttatttgaaatcatggggttatttcactagaaagagactccaattgacaccatcatgctcataattattgcaatataattgagacaaggaagaaagaacatcaagtctgccagtgctatcataagagttcaccaggtgctgagtttgacaaccatttttccttcaaatttgaattataccaggaatgttatttgctttttgagctctccttttatatttggtgtatagagtgcttccccattcctgtaacaacataggcaaggttcagtagtgccatgacagctccatcaatgcaatgggaacatgttgacattacatgtctttgtcacaaaatccactattaaaacatacatagcctaggtgtcacaaggtgctagaaaagtggaaggtgggaagtggtgattaaaaatattaaatgatttccagaattacattacaggaaactataatatatggatccagaaatcctggaagagaaacaggatgaaaggatgggtcctgggtgtgtctaacacagagctaaaataagaaactgttgagagagaagaatacacttctctgtcccagcagctcctgggaagagatgtgtaggccttctactctggtgtggtccactcaccttgggctctgctttccatgatgtgccaccaatcttgctggattttctctacactcctgacctcctttgcccttcttctgtggccaggaacagagccctttcagttctcaggataagatttttttcagaaagatttccccataatagtgcccaaatagtgctgttttccaaagcactctcctcaacagaggtcacatctcttgctttgttggatgagtttagatagactagtgggatagtcgaatgaagaaatacagtagttttttttaggaagagggaaactgagggtcatggattttcataaatgaagggggcaatctagatatttagaaaatccctctttcagagactatgctaagctttctaaatattataatagatatattctttacagaaaaaagtgtggttttcatgacctgctacttcaaatgagataagaactatggcattctctacagccaaaatctcaaaataaaaagcccagggtgtcaaatcagggtgatttattttattatccttactcacagtgtttcttttgcctacataagattttagagaatggattttattgctttttttgttcaaattaacatgcttttaataaaactagaaggcttgttctaccaagcaataattttattccctacctaaacgagtggttctaaattatctaaagtattactctgtccttaaacattcttgctagtcaaatgctgatttgagggaaagacaaacagaagaaaataattcagttcagtatcggcttttcagtttgataaaagcaatttctttcctacttgcttatcttctacctttctagtgctgaactctagtactaatcacagcactttaacgggtgttgtaaatgctgttcacggttggatctctgaaaacataatacttaagccttcatcttcaatgtgaagaagaatttggatggtagcacgaataaaattgtggcctgcacaactttactatatggccattaatgagaaatgttggttttaaaaaactgatgtgacttccatgatccatattaatagcataggtaggtaaagatgaacagaaactccatgtttgctctgtgcatggtttgattaattgacttgggtagacaaatgatgattgtagggtggagggtatatatttccttgatttgagccacaaaccctctttacatacagatcaaagtgtctaatacatagtcttcctttccttatactagtaaaggtgagaatttagttgatgctttcatttttctcttctccattcctcatggctgcacatggttcatatttttattgggttctacttcccagtatcttcctctgggatggatcatctatttgtcaacagaaaatgagaaaattatggagaaatgacagtaaactctatgttccctcctttcctctgagctcataattagacaccgtgcccaaatatacgtgcaaatggcagagccatttttcaaagcaaaatactttgaacatagatccaaacaaaacacaactctaaattcattatctcacctctttgcaattaacctaaaggagaaaccagagcaagaacacaccacagctttcggtggagtccacctggggcttgctggacttggtgcatcattagataacttgttttcccacagagtgagatagatgtgccttgaacaataattaaagggctttcatctgttgggttaattaaaactgcccatttgtttgcctattcccatgctttgctgtcttccttgtacaatacctccattgatcctctgtgagctgagaagtatcacaaatttagtctacaaaaaattagctcttctaccttccaacctgactgcatgaatacaccattaaagcacttcctctgaaaaaagtggagacagttggacaatgctccagaagaccatgattaagtagttagggaggggaattacattatcctaagaaataaaaatagccaatttaattgcatgccaattatgtaccaagccctcttctaaaaacgatttctacatattatgttatttaatgcttaacacaaccccatatggtgaagacactgctattatacatgaagaaattaaagcctacagagattaattgtctagacttagactgcatagccagtaagtggcagggacaagatgagaacctagagatttataattctgaagccatgtgcattatggctccattctaggttcctttaattggcacaaaatactgtacttgtattgactgcttacttggtactgggcattgttttgaattctttacctgattaatattttaattaactaatttaatcaaacaacaaatgaggcagggactgttactagcccattttatagtttcataaactgaggtaagagaatctcagtaacttgctatcttcagaaaggacgtatggcagaactagaatttgaattcagaaaatcttgctccaaagactgcacttttaactgctacctctccctgtatcactaaataactaatttgaacctttcttgtgataggaagtcagcaaagtaaacttaatttgaggagccagtctcagtctcataccagtccagtggacttgaaagaggataactgggatgtgcaggtagacatacgatagagaagacttagggtgatatagtccagaggtgggagtttaacaaaggtagagagaatcaattagtggagaaaggtatgtatcccagtggcaataatttcacagctttacctagggaggcacgatcttttaattgtgttaaaaataagaagtgacagtttactctgggcttccactttcccttcttgccgtatgtgtcccaggaccttgtaaaagacagtgacaaccaccttggggcagggctttacaactgcaaaacctgattaaatcaagcaaaataggtcaacattccgccttcatattagctgtacagagcctgacacggggaagcatgaacagatgttgggcagtgcacagagggatccaaaagcatctaattaaacacagagaaaagtgcagaaggaaccaggagagttacaagctcagggctcaccttggtacagggagattcaggagccaagagccattggaagtaacaccaatgtgggtgccccagaacacatttgtcccaaacatttgtcttcagctgtggggctgacagatgcatgaatttaagctaaagactgatttcaatcatgcttataagagtttgtataacatgttaaatttacaaatgactttcccatccattgtattattaatttccagagcagccttcaaagacaggcaggagtagatctcctttacaaaggaggcaattaagggtccaagctctactaccagtgcttggcagtaccagagtcggaatccatttcttataactcccagtctgtgtatacataaggctgaacagggcaatgtggagaaagggaaaacaggagaccaatgggaccctgctaatagaggaaaacatgctacaagtcaggagaatgggtattaagagaaaaatggtgagaagctaaggaaaaacaccatttattttatttaaggtaaagatggatggatatttgtggttatgtagatgaagaagcattcacatttatgtggtcatttatctagtcagatcatgggaaggtacataaaagtggtggcttttgagatggctatgatattcttagggagaaatgaagtagagagaattccaaggtgaaagagatagcttgaatgaatgtaaaaacgtagaaattaagggcatagatgaagaaaaatgaattgtccactttaagtgttgcaatggatatgtaaaaggaaatagtgaaaaacaaagctggaaaggttggaggataatatcatagaatcctttaaatgccaggctaaatagtctgatcttaattcattaggctttgaaaagccaacattagtttacaacatggaagtaacacaatgtctgcctcatgaaattcttgtgagattttaatgagaagttgatgcaaaaatgctttgtaaaaatatttaataaattaatataattgtattcctttgtttatgtaacaagtacttattgagagtctgttatttattaggcatggtctaggcattttacataaacaaataagacttatcactatgcattgaagcttacagtctagtggggaaaatgaacatttaaataaataatcacgtactctaaggtaagtgtacatatgatattatgaaaatacagagggtttgatgaactcttcctggaagaatcacatgggaaatgatatttgaaataaatcttgaataaacatagatctaaataaagtagctaaaattattaacttctagaagaaaacagcagggaaaatctctgagacattgggttagagaaagtcttctcagatcacaaaaacacaaaccattaaaaaatgataaaatagactttattaaaattaaactaacatttaagaaaatgcaaaagcaagccatatacttggagaagatatttgtaagacacataactgaacagaacgcttatatccgaaacacaaaaaagagctcttaaaaacaatgggccaaaaaatttcaacagaccctgccaaagaaggtatacaaatggccaatttagcctaatttaacttaaatttaacaatttaatgctcaacatcattagtactaggttaatgcaaaataaaatcatgagatatcattatacacctactagaatggttaaagtttaaaagaatgattaatgttggtgagaatgtggagcaactgaaatcctcatgcacttctggtggaaatgcaaaatgtttaaaaataatgtggtagcgaattataaaattaaaaaatatggctgggcgcagtggctcatgcctgtaatcccagcactttgcaaggccgaggcgggcgaatcacaaggtcaagagatcgagaccatcctggccaacacggtgaaaccccgtctctactaaaaatacaaaaattagctgggcgtggtggcacgtgcctgtagtcccaactattcgggaggctgaggcaggagaatcgcttgaacccaggaggcggaggttgcagtgagccgagatcgcgccactgcactccagcctgatgacagagtgagactccgttttttaaaaaaaaaaaaaattaaaatatacttaccatgtaacacaatgatcctattcctaggtatttacccaagagatattaaaatatacatctacacagagacttgtatatgaatgttcagagtagtaatttttacaatattcccaaatacacaacccaaattccatcagtagtaggatgagtatgaatactgtagtgtatctatactatgaactttaagagtataaggactggtggtgatcattaaatatatgtgtacctatagaactaaaactaaattatggctataaagaagaaaacatagtagataatggctttatgttctgacaatgcagatacagtacatctagcaagaattagagatggagaagaataaactcatgaccttgtaatttaaaaaagttaggccactttaaattaattgtatttttaatgttgagagattaaaataacttttaaagtaaataaagtccaagacgcaatacatgatatttcttcctaatatttaagttttctctgacctgcctaatctgactccaaatattcctaagtcttcttccctacctctcatcaggatacatggatttttactgcttactctaaaaaacatggagtttaaaaatgttaagcagatataaaatgattttctaaaagttgatcattaaaacacttcattgttctgaattagttgacaactatgaaatgattgttcaatgcaaaaattctaggtaagccaaaaaactaccaagttacagattcatatgacaaataatattcaagcccaggtagtattgtgttgcatacattaaagcttaataggaatattttagtttctgattatcacaggactactgaactaatcatcttcaataattaataaaacattggtgcgaggaaaacaaaatctaaacacaccataattactatagggaaatctttgatgcaatattacaatatataataaataacaattttgaaagctttttaaaactgtgttttaatcacgtttgcctccattaagctgctaagttaattaaataggcaaaccaacttgagacaaggaaattgattttctacataggacactctcaacagagtagcagacataagaaaacgatcaatttttcttcatggtgtgcaaattaagttctgttcagaaaaaaaaaaacaaaatccctgtttccttgttctcttctgctcttttgttctttagtgacaggttaatcaaataaatatggcaggaagggaaaatacatctgaatattccctgtacctttcactttcgggaagtctctagtgtcagagagagcttccaaccactccttccagcctcctctctaacaaagcctgggcacccaggctttctacccattgagaaattctagcagcaatctatttaccatggaccaaaaaaaatgtaacttgtgcattgcaatttttaattataatagacagtctattcctttgtcttccctttcatcacaatttcccccatctccacacctttcccaggtgcacaagggtcttactttcatttgcatcccaaaagagaaatcaggaggatccacatttgcctgtatttataaggctagagaaagcttaactgtggcatcccaagcttgaactctctgacatgggattttattgttttaaggacttcatcaatgtccacttataatctggaataagtgaatggagggatctttgctttgatgcataaaaatcaaaagaatatccctttgtgaattctgatgctgaaaatgtgttcttgtttggagggtagaaaaggggaattttcctatgtcctttgcttattatgacattagtaaagatcgctatagtccagaacatatatgtcaacagtccaactatcatagtgtagtattcgctgtagtgtgccatctctgagataattttgtacaaacatgaatatattttttactcttttgttgaatgtgaaccacaccaagacatttatcacttgcaaaagaacttgtagggcttcatgagggaagaatttttgaatacataaaattcaagcaggagctttaaataattccagaaaactgttttcccatactttgtaattccaaagctggggataggaagcagtgtagtttttttagatgtaaatatctgagttgtgagaaatttcaaagtaaaattgatattacattattatataattattataatatacagtcatgtaccacacaatgagctttttggtcaacgatgaaccacatatacaatggcagtcccataaaagcatagtactgtatttttaccatgtgttttctatgtttaggtatgtttagatatacaaatagttaccattatgttacagttgcctacagcattcagtaaagtaacatgctgtacaagtttgtagcctaagaactataagatatgccatatagcctagatgggtagtaggctatacagtctaggtttctataagtacaatctataatgcttgcacttcaaaattgtctaacaacacattttgcagaatgtatccccattgttaggtgacatgtgattgtatatagcctaatgccatgttattatatccagatatcccccagtaaaatcagatctattatgaaataaatgtttgtgtctcaccaagatttcttgttgaaaccctaacctccaatgcgacggtatttgaagatggggccctttgggaggtaattaggttgagatgaggtcataagagcagggctctcataatggaattagtgcctttgtaagaaaagacaccagaaagcttacttgctctctttctctccctccccatatgagcacacaatgagaaagcagccattcacaagccaggaagaggaccctcaacagaacctgaccgtgctgggaccttgatcccagactttcagcttcccgaactgtaaaagaatgattttctgttgtttaacacacaagctatggtgtttaattatggcagtcagagctgacaaaggcactaacttagaacatattcaactaactttgcttagtgtgctttacctagactgtcatctagccactgctttgcttgtctgagcagaaactgagtcaggggattaccggacataagtaagggcagaaaatcatcctggtgtccttgacacagcagaataacattgtttttgttgtccctctgcatttctctccacatatataggcgtatctcattttactgaactttattgcatttcacagctattgcattttctacaaattgaagatttgtcgcaaccctgcaccaagcaagtctataagcaccccttttcccacagcatgtgctcactttttctctgtgtcatattttagtaattctcacagtatttcaaacttgttcattattgttatgtctgttatggtgatttgtgatcagtgatctttgattttactattataattttttgggggtaccaggaaccatgcccatataagatggtaacttaattgatcaatgttgtgtgtgttctcacttctctatgaaccagctgtcccccagtctctctccctctcctcaagcttccctataccctgagacacagcaatattgaaattaggccaattaataaccctacaatggtctacatgtttaagtgaaaggaagagttgcacatctctcactttaaatcaaaagctagaaatgattaagcttagtaaggaacgtaagtaaaaattcagaataggttgaaagctaggcctcttgtgccaaacagtcaagatgtgaatacaaagaaaaagttattgaaagaaattaaaagtgctactccagggaacacctaaatgaatatttaggctcactgttgagatccactgctcagaaaaaaaaaaagattcttttcaaaatattactggtcattgacaatgtacctggtcacccaagagctcttatggagaggtacaagtagattaacatttttttttaatgcctgctaatacaacatccattctgcagccaatggatcaaagagtattttcaactttcaattcttactattttttaaaaaatgaatttcataagactatagctaccatagacagtgattcttccaatggatctgggcaaagtaaattgaaaaccttctggaaaggatttaccattctagatgccattaagaacatctgtgattcatggaaggaggtcaaaatatccacattatcaggagtttggaaaaagttgattctaaccctcatggatgactttgaggggtctgagacttcagtggaggaattcactgcaggtgtggtggaaatagcaagaaaactagaattagatgtggagcctaaaggtgtgactgaattgctgcaatctcatagtaaagtctgaatagatgaggagttgatgaagaaaggaagtggtttcttaagatgcagtctacatcctggtgaagatactgtgaacattgttgcaacaacaaaggatttagaatattccataaacttagttgataaagcagtggcaggagttgagaggattgaatccaattttgaaagaagttccactgtgggtaaaatgctatcaaacagcatcacatgatacagagaaatctttcgtaaaaggaagagtgaatcaacacagcaaactacatggttgtcttatttaaagaaattgccagctgggcacagtggctcatgcctgtaatcccagcgaattgggaggctaagtagggaggatcacttgaggccagaagtttgagacaagcctgggcaacatagcaagactgtgtctttacaaaaagtttgaaaataagccaggcatggtggtgtgcccctatattcctagctactggaaagactgaggcagaaggattgcttgagcccaggaagtcaaggctgcagtgaactatgatcgtaccactgcactccaccctgagtgacagaatgagaccctgtctcttaaagaaacaaaacaaaacaaaaatcactgaaattaccactgtcacccaaccttcagcaaccaccaccctaagcagtcagcagccatcaatgtcaagacaagaccacatcacaccctctaccagcaaaaagattacaactcactgaaggctcagatgattgttagtattttttagccatgaagtatttttaaattaaggtatgtacattgttttttagacataatgttattacattgtgctatgttttagacataatgctatgtctaaaattttagacatttttagacataatgctattgcatattgctattgcacacttattagactataacttttatatgcaccaaggtaccaaaaagtttgactcacttttttgcaatattcactttattgcagtggtctgaaccaaacccacaatatttctgaggtatgcctgtagttagcatgtgggcatgttttctatcactaatgcattttaattctctgaaatcagtatccacctctagtgaacttatatttaaactcagtgccctaagcatgatggatactgaaatatttttggttgaaggacatggtagcctggattttcagagtagttgtattagtccattttcacactgctgataaagacatacccaagactgggtaatttataaagaaaaagaggtttaatggactcacagttccacatggctggggaggcctcacaatcatggtagtaggtgaaaggcacatctcacatggcagcagacaagagaaagaatgagaaccaagagaaaggggtttccccttataaaactatcagatcttgtgagacttattcactaccacgagaacagtatgggggaaactgcccccatgattcaattatctcccactgggtccctcccataacatgtgggaattatgggagctacaattcaagatgagatttgagtggggacacagccaaaccatatcaacagtattccaaaatggaggagagggagagctgtttggattagaaaataataataataagccaggtgtaatatagacactgagcagagactgcttgcacatggggacttctctaaagatggaagtaagtgattacttgggtaaatcacagaatcctgaaatttcattctgcaaatatggagaagttaggtaaaaaacaaactaggtgagatggaggcaagctaggttgtttggagcatctgtggagcacagagctgggtgtctgccaaggttctctattatctttgcagtggtgggttcctgttctccccactgtaatctgggcgaggtcacctgtaacaggcttaacttcatttttgttcagccactcctgaattacttccttctgtagacttggaaaggttatggccagattatgttctccatgttaaatctctgttattcttgatgaaaataatccaaactgagggttcctgcacaaactccccatctgactctttgatgtccactgttccctagagaaatgtgaagttggctcctgcagctgcacttttggatttgttccattctcagaataggcccagaaggatgtttctacagcttggtacttattctcagctcttagaatattttcttaattgcttccctccgcatcctcccagcacttgtgagctatgcttccactgggcttcgttgcctgcatttgtacattgttggtttcccattttttccccaaatatgatgtaacctccctattaagtatggggtctttgccatgagtccatctgtgttgtaatgtggctctctgtacttatttcataactatgcaaatacttttttttctaacccaggtcacttacactctagaacctccccattcaaagtgtgatccacaaaccagcataggcataacctgggaacttactggaaatgtaggatctcagtccctgtcccagacctactgcatcacaatctgaaatttaacaagatcctcaggtgattcaggtgcatattacaatttgaaatacgctgggctacagtggtggtttttgaagctggttgtacagtagtcacatggagaacttctaaaaaaatatcaaagttgggtcccactcctagggattctaatttaattgatttgaggcagggccctaatatggatattattttcaagttttatatttgttccatatttacttcatttcacagctgaaacacactttcctagaataagcaatattaggtgaaatttgtgcccttttagctgtacatgttgtatattctgtgttagactagaagatccttgaaggccacttccacattttctatgttttgtgaatcctccaaatcatccttggtatggtgttaagtgtataatcattgttcaatgacatgttcatggttgatggggtactaaagcaggggggagatgactagcatttatgtcctggccctgtaagccatgacctctttgaccctgagcagatcacttaaacctctcagaagtcaatgtttttgttcagtcaaatgtgaatgacttctaactctagtagttattcagtcattcattcacataataaatgtgtatgaacatctgttctttaacagctactgttctaggcactgaggagatagtggtcaacagccaagacagaaaaagcctttgtcctcatagaacttataatgggagatataaataacaagcaaataaataaaaatatgaagcaggatagaggcataggtagtaataagtgctaagaagaaaaatagagcacagttaagtgttggagcgtggtaaattgttaggtgacagtggggagactttatttaactaggttatcacagaagacctttctgaagaggggacatttgagcagagacttgaatggtgtaacaggaaagctaggcaaagatctgggggcaggaaagatctttctaagcagacagcctccaataatagaagtcctgggtcagaaacaagctaatgatggtcaagcgctagacaaagagcaagggtggttgtagtagcattctttgtggatgtctctagtctatgacttaaaggatccgtatttaagtcttaaaagtatcaaagctttagagcacttatgggaaacataaatcacctgcaggcataaatgcccaatattggggcagcacaaaagtaacagaaaccaagagtgtcatcatcattggctcaacttctgtactttccaatatagtaatattttactttaggatcagcaggatcgtgagaccaaacacatacagagataatatttacttctctaggcagtgccttgagttcagcaaatttactcctgctctcttgtgtgatgtaaaggtccatttaggcactctcctgcttctgtctcttcccctttgagtgaactgctcagaaaacagggatcagcacaaagagccagccctctgggcatggtgtcctgggtgttggggcatggctctgattccaaactgtttgagtctctggttccagccaaggggctgagtggcattaattttgttgctctcttgcttcttgaaccattttgtttcagatatcatggttttatttctacagttcagctgccaaagtccatctagggtccatagatttgtgtcccaattatagaaaccttaattgcaaaatcttgaagttaaaatatcagccctcaaaggaacaatgcttgatgatgatgattggtgatgatgatgattatgagtaatgtaaccataatgggtctcctctttttcacatgtcatttgactctggcaatgcacattaaacatttataatataacaacatggacttacacaaaataactttaattctatttcatctctcttctaattaccttatatgtattatcaaattcgatcccccttctgtattaggcactgtcttcattaccaggaaactgagtcacatagacattaggcaacttgtccaaagttatacacttaaccaggcctcaaaccccagcatttctgattccaaagcttgagttcatagtcatattgcatatcttcctgagaaataaccacttattttacaaaattcggctcaagaatctactctcaatgaaactttctcttacctgcccctcatcaggtatacacactatgacaaagactatattattatcattttcagttcttattctgtgtcaagctctgtgcttggtgttgtgcttgtgtaacccttataaagttaggctgcctcctggccatgcaataaaatggttttattcaaagtcctatactgtaaaattaaatcgttttcgtctttattgcattatctttaaaaagtccagaaagataatagtattcataacacagaacaacacttctgataatctttctctccctttgtcctcatcctccctcatcataagcaatgcatgagagctgtatccaatcccacttcttccaaactctaaaaatctttcctcaaaactcattccaggtttgatttgctcctctgtctcttcctcgtttccttctttcctcctttttctttccaaatctagtttattttttctccctacagtagttttgtatcctttctagtgtaaataaatctactgtgtcttaagcttcttcacactggcagttctacacacccaatgagatgaaagctgaatcaaccaacctcatcaaacaggcagccctagcaacaaaggaaccttagaagaaaaaagaaaaggcaatggccattcatatgtttatattttccccttgtcatatatatattcttatctatcatcaccactcttaaatggctttaagtttttgccatcttaagatgaaaaattgaggatcagagacggttatctcttacccaaagtgatagggtaaatgaatacaaatccagaatatgaacctactctgagtaaataaaagcccctgagtttagccagactagttattggatgtgttgcctaatctcttcactctgccttaaaggctccagtgtcctctatagcaggggtcagtgagctatggcccatgagccaaatccagcccactacctgtttttgcaaataaagttttattggaacatagtcacactcattcatttacatacatctatggctgcttttgcactacaaaggcagagttgagtagttctgacaaaggctgtattgctctcttaacttaaaatgcttactgtatggctttttacagaaagtttgctgactccagctctagaagaccctcatagcacctcttacagttaaccagaaacaggccaattcaccaaaaatctatttgtagattatttatgacatttaccatactatatttaccaatctaacaaaaatatatttatttgaactacttataggatttaaagcaatttgtgttgggtgaaattaacagcttttgaatcattctgcaaaggtttctttgcttggttcttatgttgttttcttaattaatatgtcagtgatgctcagtttctcattgcccttgcatcctgctgagttagctggagggtttggggtagagaaaggggaccctgagtctgggggaaggcagagagaagagccattttagagcacatcctgggctgccatcaagaggagtgaacctgggagaaagaaggagaaaggccaagcacaggaagataggagaccctgcagctgggggcgagtatgacagcccagaactctggattctagctactcacaacattaatgagtgagtcctactatcacatccaatactaatttctgtcaacctacaaatagttttaaaataatttggtaatttgataaatttgttcaatatgacacgcagatcattcagtggatttatctgttgcaaattgggttctggcaaatcgttttagttaacaagttcatcaagaaatgtttatggggcatctactatgtgccaagtacccttgggatttaccagtcaaaatttaaagacctccgtaatcttcttataggttatattccatcagggggagacagataataagtaatatatacaacaaataagcaaattatatggcactttagaaagagttaagtgctgttggggggcaggaaagaatcaatagtgtaatgaagattgagactacaaatggaggaatacaattttaaatagtatggtcagggtaggcctgattgagaagataatatttgagcaaagacttgatggagtgaggagaaaggcacatagacgtctgggaaagaacattccaggcagaggaaacagtcagtgcagaaactctacggtgaaagcaacaaagaggacagtgtgtctggagtagaaagtgaagggagaattagaaaatgaggtcaaagtaattatggtggatggaccatgtaggtccttgttgaccactgaaaggattccagcttacatactaggtgaaatgtgggccatggaggtttttggacaaagaagctgcatggtatgacttaggttttaaaaaggatactgcagctgctttgttgattatagactgtgggtgaacaagggagggagcaaggataccagttaggagattattgaagttatcaaagcgagagatggagattgggaccggtggctagcagtggagagatgagaaagggtcagattttgctgcatgtacattgaagtagggccaacagaacttcctgatggattggatatgggatttaaatgaaataaagtagttaaatgttttgcgtagtaactggaatgatggagttagcgcctacttgaccatgagaaagactgcgattagaacaggttaatgtagacagctatgagacatcaaagtagagtcagtgaataggcatttgatataggagtgtggagttaatagaaggttttggctaaagatacaaatttcactgattgaaatacagctcctggcatttctttgtttcgtttactagactgtaaattatttcatggcaagagcctgtctcattcatttatctccagcccttaacatggtgccagaaacataataacactgtgttttgctgatgttcaaagatgctacatgaatgaatgaatgaatgaatgaatgaatgaacagacacatacttttatgacgctaacttacttatgcactttgagacaagaacattttcctcctgtggaaggaaaaagacttcaagttgtttcatttacctctaatggtatttagaaagcttgcatgttcaagcaggtatcatagtaaaggatcaaatatggactttgaacttggcagtgtgctatcttttccatcatttaagttgtaggaagagataatacatatattgacagtccaagttattcttgctttaagaggatgactcatattgatcaaagaagagttgtcaatttctagacaagctggatgatcagagtaactaaagtctaaagtaaaaggtcaggaatattcatccatctgagaaaaaaaaatgtatagctgacagactaagacaagagaaaaataataacttctaggaagtagataactttattatagcttaatttaaaagtagaaaatggctgggtgtggtggctgaggcctgtaatcccagcactttgggaggccaaggcaggtggattgcctgagctcaggagttcgaaaccagcctgggcaacacggcaaaaccctgtctctactaaaaatatgaacaattagctgggtgtggtggtaggcgcctgtaatcctagctactcgggaggctgaggcaggagaatcacttgaacctgggaggtggaggtttcagtgagccaagattgtgccactatactccagcctgggtgacagagtgagactctgtctcagaaaaaaaaaaaaaaaaaagtagaaaacatttgccaatatcatccacagtctaagaattaagtatatttttgcagcttactaataaatttttgaggttcataatatctcaagcctatgatgtattcaaagtagcaactctgcccaaataaatatactaatataaatatttttatcaattttaatttccagctcctatttaagaaagggaatggaatagtttggtagatagaactgatgtatcaggacaccgagatttattattttcctgaatattaccaagtttgttactataattccttctgttgagttgtgacaaatgagaataaattatacattttcagatctgttcctttgcaattcataaagcagaataaaacacacacacacacacactcttacatatacacagatacctattaataaaaattcatgatcaacaaggcagttttatttaaaggagcagatataacttgatttcagagttgcagaaagcttggctcacatttttttacattaatttcagtatatattactgcacagaaagatgagcaacactattttcttaagctaactcatttttaaaactgtaatttcagatgtgaatgatgatagaaagcagagaaattatcctgataagcattccaggctccaaacaaaatatatatgaatgttcaggctttaaaggtttaggcacacatgagttataaaaatatttatttaattttctgaacaagaatagatttacatgaatgctatatatgatttgttttaaagtcttccctgaccacatatactatgggcacagtacctaagtttgcatctctgtcaacaggcaaacaatttatatatttattaccaacacattacagttacaaagttaacttataaaaggattaaaacataggatactgaacttttctatgacagagcacggaatgtcttttcatttgttcaaatcaacttttgtgttcttgcacatttcctgttaagtttattcataaatattttattatttttctgttgctattgttatttttcattatattttgtatgaataaaagttattaatttccacatattaattttgtattttactactttactgaactctctaaatatttatactagtagtagtagatttttcagttggttctcttgagttttccagatagactgtcatatcattcacaagtagctaccatgttaccatctcctttctaatttgtatacctttagttatttttcctaagtgccttaatgtctaccttgagtacaatgttgcataataatgctaatgtaggtatccctgtcttgttcctggtactagtcataattctatatttccccattaaacatagttttggcttttgtatatatattttccctgaattagtattattaaagattttcatgaagaatttaggttgaatgttgcaaaatctgtttagcatatcagtagctgatcatataatttttgcattagattccaggcgcagatggattcatagaagacttctagtataccttgaaaaagtagatgatgctaatttgttttgtcaattccagaacctaatgtatgaaagaaaaacttctaaatcataaagcaagcataacaatcatgccaaaattactagaaaagattacacacacacacacacacacacacaaaataactgaagacaagtctcacttaggaaaatggatgtaaaaatgctatgtagcaaacaattcagctagaaatttaaaaataagttatgaccaagtacgatttatttaataatgcaacgataatttattataagaaaatctattactaaaatatttcatgttaatttatctaaggagaaaaatcatatggctaaatgctgaaaactgtagcccttgaaaaaatttttctagggaaatgggctacttagattttttaaaaatatctcctcagtttcagtaaagtatatttttctacaaaactgtccatttcatcctgattttccaatgtatatgtataagttaaagtagtctcttaagagtcttttaattttctgtgttctttcccattattgtttcttattttatatagctatattttctctctttcttgattagtctagcagtttagtttatttaaaaagctagttcttcattgtatttattattcagctaatattcttttttaactcattaactcctgcttttatctttattaattcctttattctattttcccctagtccattttgttgtttactgataaaaatattaaatctcattctgagtatgtctctagataggtcatataaattgtggtataaattgctttattactattttgtagacactgtgcaatttcagcttgtatttcttctttggttcaaggactaagaaattcatgctttccccagaaagcaaaatctttttatttcctacattttgttgttttatttttagttttatcacattatgggaaaatatttgctatattgtttttaatttttgaagtttattgagattgtctttgcagtctagtacatggttgatttttatgaatattctatgggtacttgcaaagaaggcatattctttatttacagaattcagaaaataccggttagattttccgtgttgcttatgttacttagatcttccatttgatctcccttcagctgtcagcttactagagatttccatagatattttctcaaacttgcacaacctgaggccagatgatctccttttctctgcttttctagcacctgtacttcctgctactttaacaattcttgcattgcattataatttacttgtccatacattcaaggtccttgaaaacaggacctgacagctgttagcacatagaatgacctcaaaatcatttgttgaatgaatggatgagtattttataactttctcccatttagaatttctctttaaagagaaggctggaggggaggggtcagggaaggagacactgggaagaaaatattatagatacattggaggtgtccggcaaatggaaaatcttccaaacaagttctataattctcagtcagacactggcagcctaacacattggtactcagatatggatcagtagcacgccatcagcccaactgcaacaggaaaaatggcaaatgggccagtgttcatcaccagcattacctatttccctaattttgtaccctgcctctgaagacaccactaatctcatattattattctggcttcaatgtttagaaacttcctcagtccttttctcccttttgcaatgaaaattccaattaggccagtctcagttgagtattggttttattaaagtaacttgcaaggagttgtgactgactctatcaacttaatttttcagggcatattttctttgccaaatgggagcctgctaatctaaatacatcttctgaatagctcttccactttcatgcctaatcatactttgtgaatgcatggaatcagcatagtttattggaggcggccatatacaatcttgccctttccctttcgtttcctcatctgaaaaatgataaattccattagctgatttagaaagttgtctcagctctgaagttctggcatttagcctttgtaaattattttaaataaccccaatcaccattggagaattgctgagggtaagcaaggcaaatattgaattcataataaatcctcaaacggcagatggcatggtggaggggatgtatagtcagtctttgaccatccacagcactgaggtatggcacaaatcatcttaacagtggataatacagaaataggttatcaatgatcaaagacaaagaatggagaaaggcctaagagatcatctggtccatgtcctttccatagacataaatcccctgggaaaaggtagtgtaggttaatcaaatattcttattaattgctaggtgcaagataccaggaaaactaatgctgaaagaattagagtaaaataaaagatattccaagtggtaaaactagaatgagtatgtgatgtcacagtggaaataaagctggaccaagaatctagctccaggcttggtttttctcttaactggttctttgagattgggaaaatctctcaagctctctgacctcagtatttgcacaagtattgtatgtagagatagaatgagttatatattaactttttgaaaaattagtttatcctacacaaaatacataataattgttcacagtgacaatgtgcttcatgtgagagaaaatcaggcaaaatgatacaaacttggtattttcataatgttactcattaatgaaaagccttcattatcaccactatgagtcataacactggataaagctcaacaaatgtttatggtaaaaatcaaattcaattatgcattataaaagcataaatggatctctagcatttgagagactatacagttgatatacagtttatccaaaattccatggaaataattttgcctggctttctgaaaattaataattaatagttttagatgtaaaggtaaaactgagctgtttcaaaccaaacagtaattttaaagcaagaattgtagcaggaaagttagcccctctctgatagcattgatgtcaagaaacagcagttttcccatatctcttaagtgctactatccaggaagaagtcacacaagaatgactcccacgtttaactttaatgaagatcctaaattggatgaaactattaattaatctaactaatttgcagcactcagggcattgattctaatggccggatagaagtataaaaggtaattccaccatgatgatgagagttaacatgtttgagcatttacaaggtaccaggcccagttctaaagcactacctacttgttatttcacagatatctcaatacttacagcaaacctattaggtgggctccattattatcctcatttttcagctgagaaaactgaagcacagagtcattaagtattgtgtccaaactgtacagctaggaagaggcaagacaggatttagaccctcaaagtccaatactagtgcttacagggtttatcaccactctaactcagcactgatagagtgcaagtcaatcatctattctcttgtatttatttacctctgtaaaacagattacacaagggcaggaaccaaatgttaatcatctttgtatacttctcagcatttcacacacaaggaacagtctacggtgatttgttgacttattgctgaaaatatgcaattcattttggggccccatatctgtgtatacaatgacaagtggaaattgagatgagaatttatttaagtgattccgtaataaacccttacaattaaatgttttaagatatgaattatccagttttactttttatgatcattaaaattagagaaaatttgttgattcagactatattaggtaatgattagcttgaattaaaatataggattaaagcagtaattcataatactttttttctataaagagataaatagataacattttaggctttctgggcttaaagttctctgttgcagctactcaactctaccatggtaagtgggcactagagagccatagagaatatgtaaatgaatgggtatggctttgttctaattaaactgtatttgcaaaagcaagtagcagaacagatttaactgatggacagtagtttgatgactcctggacttcagcttaggtaaactgattttgaatagctacttttatacatgttcaagcatggagcctacttgaatggatagattaaaaatgaatatattatggtttttcttctcttatactgattaattatcctcccagataccttgcttattatttttaaactgaacttttctctttaaatagtaaagaaaaaaaaatcaaatttttccaaattctggattcatgaggcccaaaataagcaacttatctcccttttctcatcttttttatctatctatatttctttctctctcctccacaacaaagataacatatattaactgtcaattgctgcataacaaatttctgccagattttagtggcttaaacaatattttaatcttacagtttttatgagcatttttatcttgtagtttctatgggttaggaatccaggcacaactcagctggaacctctctttcagagtctcccacaaggctgaaatctcacatgatttcatagccaaggctgtagtctcacatgaaggctcaactagagaaggatctacttccaaagctcactcatatagttgttggcaagattcagttcctcctgtgctgtcagactgaggcctcagctcttcactggctattggctgaatgctaccctcagttccttgctaggtagccctctccacaaaggcaacatgagaagagccagcaagagagtgccagcacgaaagaaagtgcaagcaagatggaaggcagtcttttataacctaattgtggaagtaacatcccatcaattttgacacattgtatttgttagaaacaagtcagtaggtcagcccatagtcaaggggagcagattatccaagcacatgaataccaagagacacgaatcattggggcccattttagaaggctgcctaccacacactattttaataaaactaactctgcattggtcttttagtgtaatgctgtttgtattagtccgttttcacactgctgacaaagacatactgaagactgggcaatttacaaaagaaagaggtttaattgacttacagttccatgtggcaggggaggcttcacagccatggcagaagatgaaaggcacgtctcacatggcagcagacaagagaagagagcttgtgcagggagacttccatttttaaaatcatcacatgtcgtgagacttatttactatcatgagaatagcacgggaaagacctgcccccatgattcaattacctcccactgggtccctcccacaacacgtggaaattcaagatgaaatttttggtggggagacagccaaaccatatcattctgcccctagcccctctaaatctcatgtcctcacatttcaaaaccaatcatgccttcccaacagtcccccaaagtcttaactcatttcaccattaactcaaaagtccacagtccaaagtctcatctgagacaaggcaagttccttccacctatgagcctgtaaaatcaaaaacaagttagttacttcctagatacaatcgggatacaggcattgggcaaatacagccattccaaatgggaaaaattggtcaaaacaaaggggctacaggccccatgcaagtccaaaattcagcagggcagtcaaatcttaaagccccaaaatgatctcctttgactccatgtctcacatccaggtgactctgatgcaagagatgggttcccatggtctcaggcagctctgcccctgtggatttgcaaggtacagcctccctcctggctattttcacaggctggcattgaatgtctgcagcttttccaggtgtacagtacaagctgtcagtggagctatcattctggggtcggaaggacggtggccctcttctcacaggtgcactaggtggtgtctcagtagggactctgtgtgggggctcccaacccacatttcacttcttcactgccctagcagaggttctccatgagaacatcaaccctacagcaaacttctgcttgggcatccaggtgtttctatacctcttctgaaatctaggttcccaaacctcagttcttgacttttgtacactcacaggttcaacaccacgtggaagctgccaaggcttgaggcttgcaccctctgaagccacagcctgagctctatgttggcccctttcagccacagctggaatggctgggatgcaggtcaccaagtcccaaggctgcatgctgcaaacagcacagggaccccaggcccaacccatgaaaccacattttcctcctaggcctctgggcctgtgatgggaggggctgctgcaaaggtctccaacatgccctggagacattttcttcattgtcttggtgattaatatttggcccctcgacttatgcagatttctgcagacagcttgaatttctcctcagaaaatgggatttacttttctattgcattgtcaggctgcaaattttccaaacttttatgctgtttcccttttgaaactgaatgcctttaaccacaccgaagtcacctcttgaatgctttgctgcttagaaatttcttctacaagataccctaaatcatctctctcaagttcaaagttccacaaatctctaggccaggggcaaaatgcctccagtctctttgctaaaacataataagagtcacctttgctctggttcccaacaagtttcttatctccacctgagatcacctcagcctggaccttattgttcatatcactatcggcatttttgtcaaagccattcaacaagtctctaggaagttccaaactttcctatattttcctgtcttctgagccctccaaactgttccaacctctgcctgttacccagttgcaaagtcacttccatatttttggctatcttttcagcaataccccactctattgtaccagtttactgtattagtttgttttcacactgctgataaagacatatctaagactgggcaatttagaaaagaaagaggtttaatggacttatagtcccacgtggctggggaggcctcacaatcatggtggaaggcaaggagaagcaagtcacatcttatgtggacggcagcaggcaaaagagagcttgtgcagagaaactctcatttttaaaaccaccagatctcgcgagacttattcactatcatgacaacagcacgggaaagacctgcccccatgattcaattacctcccaccaggtccctcccataacacatggaaatttaagataagatttgggtggggacacagccaaaccatatcactgttaaaacctttaactaactgatgtcctgtcaacaggagtaatttgtactttcgtaatatccacatccttataggctcaaaatgtaactgtgactctgtcctcctaaggagctcagggtgggacagattatttatataacatttctgcaaataaggtgctctcattatctgaccccaggagagttggcatatgctgaatgattctcgcacagtattagacaggaaatactagtttctgtttcagctccattattctaattttataaatttaaaactagctgtgcagagcaaaaagggaagtgataggtgttaaatcatatgggcaatataggtcctaaattgatttggtacttactgcttgaagaatgttttttgattcatgtcaacactccattcttactggtgatgggcaagccagccaggcataggatatttgctagtaagaaaaaaattttcaggatgtgtttctttgctatcctggttctaaatggcaatgatgtggcaggcatcatttttgtgataggctctcctgatctaatttggggtttgagtcatttgtttcagtaaactgcagaccctgtgacaagcatttggatgcagtttatttgaaagatggtgacaagaaagacaagagagaatgtggaatgtaaatagtgaaaagagaaaaggcaaacaagtgtattattgagttggttaccatgagggacaactagtgttcaattatgctagggatcctccaaaaactgtgtagaattctcttcagattgccccaacaagtaccaggaaatccagggtctttatccaccaacccccatccttccatggttgaggactgcccctggtagtgttctaggcttccttgcatgcatgtcaagaaagtttccaaggtaccagagaaatctcttaggcagaaaagcagagcttggggtgagttgctgagggtttatgtgagaattgtccattgaatctgcaagtaaactcagtgtatctgctatgcacatagtattgcacatgcaattgtttttcctgaattagtactatttgcttctaagcaaggaattcactattttaggcaagtcttgcctggcacatagaggcattcaatgaatagacattatcagatgatactgaaagtgctaagaatgcagagtagagggcctgaaggctgttactgggactcacagctctgatcaccttgacattgggaacccatactgctattgatgtggtttcctctctcatcactttttatttcccttgagtcacagaatcttagaatagcagaacccttgaaaattatcagcccgatccttttatatcccaagtgggagtgtgagaccccaaatcgtgagataatgtgcccaaatttgcaatgtgagccagtggcaaagctgaggtccacatttttggcatcttctcatggctctctctaacacagccttgctgctttctcttactttagatagtcatactggattgatttccgccaaggggctgagattgatctaaactttctgaagcagatgtatgcaactgatatgttagaaactgaggcactcaatgagcccaaccaaaatattttcacacttacactttatcttttaagcattctgtacacttccatattgaaaaataataatgctatctgatggcatggccttttatttcttcaaagagcttacacatctacttatgtcattttactcaagaggcagtaggatttctttttaatcattacagactcctgtaggctagtatctattgcaaataggtatttaactattaatgggtgatttgtgcttctggtttttttgttaaagagaaaggaatggagctgacttgtatcaaaatgctgctcaactataggaagtggatacagtagagacataatctttggtaatttataactaacaaaaagtgagatcaacagcccagccagaagcttttgaaccacattaattacaaacctttgactgacctgtagctccttttcttgttttctcctccccacatggaacctggagcgtggtggatgcctggaatttttccatttcagtttcactttgaatagtatgaaacagtaggtagctgattaacttcaagagctttaggttagaacacactaggcttgagcgcccagagtgccatgccaagaagggaaggtgtctggcaagttggctcctatcgagacatccttgatgatctgcagcctccactgtgagctcacattaaagtacagagctgacactaaatcagtccacaagccagagtctgggtcggaaagcttctcggctaccactgactctaccattcaattgaaattcatatttcacactatactctcatatattaaatactctatggccctccactaaaggaatccctgttctcatccccaggatgtagcatcacagtgctcagagggttcaggtgcattggtggagaagttcagcaccagaaggggcctctttgtatcctggagttatcacaagattctaggtattctgaggaaatgatttctccatcactgcaacttgaactgggcttctaagactgcctctattttgtactccagaatcacccattccctacatatcttacccactgttcatctcaggagtacatcatccataattgttatgagatgatgacgcatctgcacatagtcacttaacacaggtacacccactcactctggtaaggttctgagtttgagaaatggtcaggggtgaaaggtttggccactgcttccttcctgatttggctcctcatcccactataggaggcataggcaacttggaaatcataaaccaacaagctcagtccagggagtggagacctgtcagctcttccatattcctctacccatcactataaaccttacccaccattccaaggcctttccaaataacagttattaaacttccctcttttatttccttgcttgtaagtatgaattttgaacctgggttagggtagggagtaaatgcacaaatagtatacaagtagtcgaggcactaattgctgactgagaaaacaaatgaagattgcggttatctgccatctatgaacacttatcttcacagtatgtccatggctgcaggtgtgacagtgctactgttgtttcttgcttgccagtcccactgcatgtaccttctcacctcttttccacatcagatgttgtcatctggtgtaagcacagtctgtgagtaattcttctgactcatcgccagagagggaggttcccacaggggtcagtgaggcagaaaagcacagaatttggagtcaagccagatttaatgcaaatcgcagctcaactattcttttgctgtgtgatcttggtaaagttaatgagtgaactcagcttccttatccttataatggagataactcatagaatggtggtggtgtaagctttttgttgatgatagtggtggtggtgattttgttctgttttctttttgtaacagcatatatcagtccccatgatatacaggagtgctcactgcaatgaagttccatttatgtgaacttagattatgtgaatttaaagcaaagcaatataaaaatactaacaaagtcttagtccatgcacaaaacatcaaatacaagatattttactttacattattcctgtggggaaaactgccttgaattatgcaagttttgaattatgcagtgtcttcaggggctcatcccttacaagccaatgtgtctgagaatctacaatctgccaaatgagtgttaagttttatataaagtatcttattcaatccttcaatgaccccatgaaactggaatgtgtgggcccctactttgatatgaagaaatcaagattcaaaaaggttaagtaatttttccaaattcattggtcattcacctaggattcaaatccaagttggtctagcttcaaaaatattcattatttttccttttttttctttcttccatatcttcatagtctcccagtttttctcttctctttctttctccttttctctctctctctcccatgcacacacacacaaacacacacactctctgactacacaaacatttattaagtgaagcatcatctcatcatctccccaaagcccattgttgtctttccaatactgagatcacccaattgggtcttttcttcattgagattgtttttccaccagtgggcaatttgttccgaatccccacttcccccttattcctgcccttgttagataataaacatacatcacttgttttgtcactgaaggtgcaggcacaggaagtagactatggcaggaatcaatgtgcttgtctatcagccaaaaatgtagtgacgtggcagacataagcacagggaagaagatgctgcattgccctacttcctccagatgctaacccctccttcaccttgactctctcagatgcctacatttgcaggaggctgagacttagaggtgcctttctgcagagtgtccctatggtgcctctaacaatggatatcacctggtgttgcttgtgtattctagggctggcagttttactcttcttgtacctctccactcatgaaactcacacggatagtaagttttggcaagctactttaaacaattttctgaccaccataatggagagaaatgtattcatctttggaaagaatatcaactcactaggcctgtgtaccgtccaatgcccaacaaactaattggtccccaaaggtccatttataattgggtggttcctgcagataccaggcttggaggcattgccactcagtgtctgtttctgcaaacagcactttaataagtaactctttactcaactactcagtatagaactcaacaatattagatatggagagaaaatggggtgagggtggtgacactgggatgggccaggtagtcagtgctgtcatcatccatctctgccaaggaaatctgatttccccagcattaaatggcaggtgtgagctccttaattaggcaataaaaatggcaacttggcagtgaaactataaacatgaaattgtacagcaccatgaatctttggcaccaggattaacttgactatatttttttctcgtgatacagttactgaatataggtaagagatcaaacagaaaaagcaaagccagaattctcattcccacctctgttaattactagctatataaagtttagatatgcatttaataaactaatttccccccaaaatgggaatggaaagcatgatggtatactttatagcactcaataaaagataagttgattggagttaccaaagccttctattttatgtaacagaaacacatctcaggctactgtggccaacagttatctctcatttcaacagctgcattaatcaaggttaattacatattttccacatataaattagataaaatgaaattgtactgtacagaaaactattctgctttaccaatagttttcaggcatagtttgagaataattaaacatttttatttgtataaatgtaagtggcacaagtgcaattttgttacatggatatattgtggagaataattaaacattgactcaagcaggtggatatgaggaatcattccacttaaagaaggaatatctgaatattttgagattgccctatgaatttcattttgtttcttttctattacaaaacaacacttgatcatagtcatttgtgattttttctccactgtagtgaactgctctctgtacacattcattagcaatcctccttgattagctgctggaggaatgtcgcagttctctggggtcagcctaggggctgggaatgtgaatatactttagttggcacattatcacatggaagtgccttgcccatgaggaatggagagggtatccaagctgtaaggacattcaagtaatccttgtacaatggtgactcattcttctgtcctggggataaacatcatgtagaaaatgtcccaaccaataacatcaactggcttcatggcacaggaaacagtacagtgtctgaacacagacaaaacaaattgtggggctaaagtaaataaattcatgacttgattttctactttgaaactgaactaatgatgtaattcatgaaaaaaattgactcaataaaacttgccaaagttttcaaaaatgccaagacagtattaaaaagaatattaatgggaaacacctctaagaaatgtctatacaatgcgaaacaactgagcaactaaccaaattccaccatctcacttatctgttcaaacaacagataaatgcttatctagcaccatgaaactctaaaccacttgactggttctactttcccgccagatatatttgcaaactacataagttataaagtcatctaaataataagtattctcctttccgttaatgaaaataaatccagagtaatttggatatcaacaactatcatctctaaaagaccaaaactacatttttcttctttttagttgtcttttttttttgtagcttaccctttatataaagcaataattgtgaaaggaatttgaatttatatagcacttggaaaatttgacagtcaacaaaaacttacagggacacttactatatgcacaaaaacttgtccttggtggcatggatacagaagacattactggatctatattcccccaagtatcctatactttagttgggtggataaaacacatatgcatgaagcgaagactaaactggatgattctatctttaagtgcgttacaaattctaaagatgggcaagacgaccgtgggctagaataggcaaagaaattatcaccttggggatggaatttggtctactccttgaagaattatctggaaataaacagatataaaatgtgggaaatgtttctatgctgggagaagagtgtagaccagggtttttccaccttataacactattaacatttgggactgggtaattatttgtcataaagagctgtcctttgcattgttgggtatttaacagcatccctggcctcaacccactagaaaccagagcaactctttacttcccagatggaacaaccaaaaacatcttctggcactgctgaatgttcttcagagcaacatcacttctggttgagaaccactggactggatatagttacctcggttttttgtttgtttgtttttgtttttgctttctctctctcagggttttccaacctcagaattattagcatttcgactggataagtctttgttttggatgctgtcctgtgcataataggatgtttagaagcatccgtgacctcaactaccagatgccaatagcactgctccctggttgtgacaatcaaaaatatctccagacgttgccaaatgtcccctggagtgaaaagtcaacctcatttaggaactactggtgtagacaaagtcatcagtgggaatggatttggcttactcagggctaagcaaaattgtttaaacaaaacaccaagcttgtgttatgaaagagtgcaataagattgattaactagggtagacacatgctgtgcgaggccttgaataccagagactgcaataggcagccacagtaattcctaagcagatgtgtttcaaaatgaaattggtgttttaaatttaatttcacagaagcaaaagactaggtgccatggggaagaactgaatgcagggggactggttaggaagttgttataataaccaggcattaggtgttgatggataggattaaagtgacatctttggaatggagagagtaaagagtaaacccaggattgctttacagagagaaatgttgagtctgtgcaatagattgagtattagagatgaagacaatggagggggaaacagtggtaaaaccaggttgctagtgagaagaaagatttaaatgagatgaataagaaggaggtggcatttaatatgtttaattttgcaaatactaactagctattttagtattatcacagaatgctgctgtgaggtcagggctgagggaataatttgagagctttggaaacacaaaaccttcatatcctcaatgaatttatccactcctatagctttcttcttattcctgtagcttgacaaaataaaaatttccttctcactcacattaaactctactatggggttggtggccctaggtcttttggggatccagccttcttccatcttacggcactgccatcttaaaccggtgacatctaaggtggctgcagaaggtatagtcttaagggcctcatggaagattttagcggtcctaacatgtgtaacttctgcctacattccatggaggatccaaaagaagtggcaaatccagcttactggtagaggaaatgaaatttagaagaatatagccagtctctgttatagcgctcaacatacacaccaccaccaccaccaccaccaccaccctgacacacagaaataagaagaaagctataggagtggattaattcattgaggatatgaagatagagtgaaaactgaggaggagagttcaagaaatggaaataccaaatggaataagatgtcccaaagagagtaaggaagatcagatgattcagagatgttggagagcctagaagagaaccaacctatatagaggtgaaagtgccaagaagacggaaggtaaatttccataaggaggataatgtctactttgctaagactcttgctttcatcagaggcaaagagcatcatgatgattgttaaaaaaaaaaagaaaagaaaaagacaccttatacatctatactccacctcaaaaccatcattagcttatctttacaaatttttgaaaccccaaacctatcagcttggctttcaatgccttcttttgccagcccagcctaactgtccacccctcaccgttaactcccaggtgcccagcatatcccggtcactgggttgctcattattcgcaagaccaccatactctctcccatctttacagctttgattttacagcttcttctacccaccaaagacctggctctcctcaagcctaaaacaagtgctacaccacctaggaataaagcctttactgatttttccatcgatattaacctccccgtattctaccgactttttgtccttcctttactttgtcatgtggaaccatctactttatatcacttatatgttcatgtgactgtttccctcagtagaccatgggattcttaagtggtgaagcagggccactaagatgtacaaccccaagaaaaacaagataacactaaagtctaggtcagaggctggaaaatgttttctgtaaagagccatatggtattttaggctttgtggccatttggtttctgtcacaactactcaactgtaccattttagttcaaaagtatccacagacaatatgtaaatgaatgaatatggctgtcttcaaataaaactttatttataaaacaggcagtggactgaatttgatccatggactataatatgctgctccatgatctatgtgaatgatactttctagagcacagcatgagtggggtcccctgaaatataatctgggaagtcctggggagaattaatatacttcttagtcatctttgtatcttttaccccatttcccaccagcacctagtagagccttcaatgtagtatgctctcaatgtttgtttttgtttttctgaattaaatatgctatgcctgaaaagataccaacttagttaatcataacagcactttgagaacttcattaccttttaaaactatcttgcaagtttgtagtaaagtagttcaagaaggaatcttgtaagcccaagaatcataaaaataatgtaacaggggaagatgtgagctcaaaacatctaaggattagcagctgaaagaagagaatctgacatcagagctgggtaaaagcaacaaaaaggcatttcagttctgagaaaccagcaccaaggaacatcacatcatatgtgatagatgtctcacaacaccctctaaatccatgtgaataatgcatttaatgccagcacttcaatgctggaaagatgttcatgatttggaggaaactcagagagcaaccaaaatgattaagagactgaaaggactcatttgtgagcagctgaaaaagaagccaaatatgagcttggtctgctgattgctagaagatggggaaaaggtgtataaattactgaatgctgtaaacaccaggaagaggaggaatgatggtcagctctactggacttagctcttggtaggcacatatctcgggcattaacacattcctctcattattgggtcttaaaacatttatgggccatgtgaataatatataactggaaatgctgtgattggtaatgttctattattacaggaaaatagtataacttaattatactttaagttctaggttaaaggtgcacaacgtgcgggtttgttacatatgtatacatgtgccatgttggtgttccagaagagcaaatacaagacaaactattaaggaagcaaatgttccaggaatgttaggcgagctaagagaataaaaactcactaatagtacactcttagaagtatcaaatatatacaatcgtgggtaacagtatatcattcataactgtttaaattaaagcacaaagatgcaaaaatagctagatatttccttcctttccttccttgctttcttccttccttccttctttcattcaattcattcattcattcaaccatcagtccatccatcatagatccatccaccatgtatttatccaccaatccatctatccatcccacataactactgcctatgcactatttgctaggtcctgtgctggtgatacaaagtaatactgcacagggcctaaactaaaaacgaaaacaaaaaaataaacctacagtctaagagtagggtcagggaatactttaaaatataactggccgggcacagtggctcacgcctgtaattccagcactttaggaggctgagatgggcaaatcatttgaggtcagcagtttgagaccagcctgggcaacatggtgaaaccctgtctctactaaaaaatacaaaagttagccaggtgtggtggcacgtgcctgtaatcccagttactcggcaggctgaggcaggagaatcatttgatcctgggaggcagaggctgcagtgagccgagatcgcgccactgcactccagcctgggcaacagtgcgagacaccatctcaaaaaaaaaaaaaaaaaaaatatatatatatatatatatgtatatatatgtgtgtgtgtctatatatgtatatttatgtgtgtatatatgtatttatatatgtatgtgtgtgtgtgtgtgtatatatataaatatatataaaattgtaagttgagtgagatgagggacatcttccatgtaaaaagtgggctaagaaggaacagataagttcaatagagagtgataagggaacaaagaaacatggcccctaactcagatgagagaaaggggaaaggtcgggatattcccaggggaattgatatcttggctaagtcctaaagaattctgaggcatctattaatcagaaggagtgggaataaccatcccaggtaggaagaataatatgtttaaaagactggagataaagtgctagatcattttatcacaacacatgtggaactgatacaagtacttcagattgttttagacaaatagtgtaaggcaggtggtgatcttaaaaataataattagaatatattatgattgtgggtgagttttatgttccttattaatttttgtctcttccaaaatttatccattaacaaaatcacacccttctatggccaaataattgcaaacatttataaggacttattctgtgtttgaaactattttaaaatctttttttttttaattatactttaagttctagggtacatgtgcacaacgtgcaggtttgttacatatgtatacatgtgccatgttggtgtgctgcacccgataactcatcatttacattacgtatatctcctaatgctttcctttccccctccccccaccccacgacaggccccggtgtgtgatgttccccttcctgtgtccaagtgttctcattgttcaattctcacctatgagtgagaatatgcggtgtttggttttttgtccttgcaacagtttgctgagaatgatggtttccagcttcatgcatgtccctacaaaggacatgaactcatccttttttatggctgcatagtattccatggtgtatatatgccacattttcttaatccagtctatcattgatggacatttgagttggttccaagtctttgctattgtgaatagtgccgcaataaacatacgtgtgcatgtgtctttatagaagcatgatttataatcctttgggtatatacccagtaatggggtggctgggtcaaatggtatttctagttctaaatccttgaggaatcgccacactgtcttccacaatggttgaactaatttacagtctcaccagcagtgtaaaagtgttcctatttctccacatcctctccagcacctgttgtttcctgactttttaatgatggccattctaactggtgtgagatggtatctcattgtgcttttgatttgcatttttctgatggccagtgatgatgagcagtttttcatgtgtctgttggctgcataaatgtcttcttttgagaagtgtctgttcatgtcctttgcccatttgttgatggggttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctaatggtattgcctaggtttccttctagggtctttatggttttaggtctaacatttaagtctttaatccatcttgaattgatttttgtataaggtgtaaggaagggatccagtttcagctttctacatatggctagccaattttcccagcaccatttattaaatagggaatcctatttaatgcagtgcaccagcatggcacatgtatacatatgtaactaacctgcacattgtgcacatgtaccctaaaacttaaagtataataataaaaaaaaaagcagaatcagtagggccatggagaattcttagctaagaattttattatgggcctataatgtctatgacattaatttgatgggattttgctacgtgaatgtacagaatagtaaaacttgggtttcaaaaataaaaaactaaaaaataaataaataaatggggaatcctttccccttttcttgtttttgccaggtttgtcaaagatcagatggttgtagatgtgtggtattatttctgagggctccgttctgttccattggtctagatctctgttttggtaccagtaccatgctgttttggttactgtagccttgtagtatagtttgaagtcaggtagggtgatgcctccagctttgttcttttggcttaggattgacttggcgatgcaggctcttttttggttccataggaactttaaagtagttttttccaattctgtgaagaaaggcattggtagcttgattggggatggcattgaatctataaattaccttgggcagtatggccattttcaggatattgattcttcctatccatgagcatggaatgttcttccatttgtttgtgtcctcttttatttcattgagcagtggtttgtagttctccttgaacaggtccttcatatctcttgtgaactggattcctaggtattttattctctttgaagcaattgtgaatgggagttcactcatgatttggctctgtttgtctgttactggtgtataagaatgcttgtgatttttgcacattgattttgtatcctgagactttgctgaagttgcttatcagcttaaggagatttttggctgagaccatggggttttctaaagataaaatcatctcatctacaaacagggacaatttgacttcctcttttcctaattgaaagccctttatttccttctcctgcctgattgccctggccagaacttccaacactatgttgaataggagtggtgagagagggcatccctgtcttgtgccagttttcaaagggaatgcttccagtttttgcccattcagtatgatattagctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttccatttatacgctggattacatttattgatttgcatatgttgaaccagccttgcatcccagggatgaagcccacttgatcatggtgggtaagctttttgatgtgctgctggattcggtttgccagtattttattgaggagttttgcatcgatgttcatcagggatattggtctaaaattctctttttttgttgtgtctctgccaggctttggtatcaggacgatgctggcctcataaaatgacttagggaggattccctctttttctattgatggcaatagtttcagaaagaatggtaccatctcctctttgtacctctggtagaattcggctgtgaatccatctggtcctggactttttttggttggtaggctattaattattgcctcaatttcagagcctgttatgggtctattcagggattcaacttcttcctggttttgtcttgggagggtgtatgtgtccaggaatttaaccatttcttctagattttctagtttacttgcgtagaggtgtttatagtattctctgatggtagtttgtatttctgtgggatcggtggtgatatcccctttgtcattttttattgcgtctatttgattcttctctcttttcttcttagtcttcctagtggtctatcaattttgttgatcatttcaaaaaaccagctcctggattcattgattttttgaagggttttttgtgtctctatctccttcagttctgctctgatctcagttatttcttgccttctgctagcttctgaatgtgtttgctcttgcttctctagttcttttaattgtgatgttaggttgtcaattttagatctttcctgctttctcttgtggcatttagtgctataaatttccctctacacactgctttaaatgtgtcccagagattctggtatgttgtgtctttgttctcattggtttcaaagaacatctttatttctgccttcatttcgttatgtacccagtagtcattcaggaacaggttgttcagtttccatgtagttgtgtagttttgagtgagtttcttaatcctgagttctagtttgattgcactgtggtctgagagacagtttgtaatgatttctgttcttttacatttgctgaggagtgctttacttccaactatgtggaagtaattttggaataagtgtgatgtggtgctgagaagaatgtatattcttttgatttggggtggagagttctgtagatgtctattaggtctgcttggtgcagagctgagttcaattcctggatatccttgttaactttctgtctcgttgacctttctaatgttgatagtggggtgttaaagtctcccattattattgtgtgggagtctaagtctctttgtagatctctaaggacttgctttatgaatctgggtgctcctgtgttgggtgcatatatctttaggacacttagctcttcttgttgaattgatccctttaccattatgtaatggccttctttttctcttttgatctttgttggtttaaagtctgttttatgagagactaggattgcaagtcctgccttttttttgttttccatttgcttcgtagatcttcctccatccctttattttgagcctatgtgtgtctctgcatgtgagatgggtctcctgaatacagcacactgatgggtcttgactcttaatccaatttgccagtctttgtcttttaattggagcatttagcccatttacatttaaggttaatattgtcatgtgtgaatttgatcctgtcattatgatgttagctggttattttgctcgttagttgatgcagcttcttcctagcctcgatggtctttgtttttgcagtggctggtactagttgttcctttccatgtttagtgcttccttcaggagctcttttagggcaggccttgtggtgacaaaatctctcaacatttgcttgtctgtaaaggattttatttctcctttacttatgaagcttagtttggctggatatgaaattctgggttgaaaattctttcctttaagaatagtgaatatttttccccactctcttctggcttgtagagtttctgccaagagatctgctgttagtctgatgggcttccctttgtgggtaacccgacctttctctttggttgcccttaacattttttccttcattccagctttggtgaatctgacagttacctgtcttggcgttgctcttctcgaggagtatctttgtggcattctctgtatttcctgaatttgaatgttggcctgccttgctaggttggggatgttttcctggataatatcctgaagagtgttttccaacttggttccattatcctcgtcactttcaggtacaccaatcagatgcagatttggtcttttcacatagtctcatatttcttggaggctttgttcatttctttttactcttttttctctaagcttctcttctcgcttcatttcattaatttgatcttgaatcactgataccctttcttccagttgatcgaatcggctactgaagcttgtgcatgcgtcacgtagttcttgcgccatggttttcagctctatcaggtcatttaaggacttctctacactgtttattctacttagccatttatttaatcttttttgaaggtttttagcttctttgtgatgggttcgaacttcttcctttaacttggagaagtttgatcatctgaagcctcctctcaactcgtcaaagtcattctccttccagctttgttccactgctggcgaggagctgcattcctttggagggggagaggtgctctgatttttaggattttcagcttttctgctctgttttttcaccatctttgtggttttatctacctttggtctttgatgatggtgacgtacagatggggttttggtgtggatgtcctttctgtttgttagttttccttctaacagtgaggaccctcagctgcaggtctgttggagtttgctggaggtccactccagatcctgtttgcctgggtatcagcagcggaggctgcagaacagtgaatgttgctgaacagccaatgttgctgcctgatctttcctctggaagcttcatttcagaggggtacccggccatgtgaggtgtcaatctacccctactcaggggtgcctcccagttaggctactcgggggtcagggacccacttgaggaggcagtctgtctgttctcagatctcaaactccattctgggagaaccactactctcttcaaagctgtcagacagggacatttaagtctgcagaggtttctgctgccttttgtttggctatgccctgccccgagaggtggagtctacagagtcaggcaggcctccttgagctgctgtgggctccacccagttcaagcttccaggccgctttgtttacctactcaagcctcagcaatgacaggcgcccattccccatcctcgctgctgccttgcagttcgatctcagattgctgtgctagcaatgagtgaggctccgtgggtgtgggaccctccgagccaggcgcaggatataatctcctggtgtgccgcttgctaagaccattgcaaaagtgcagtattagggtgggagtgacccgattttccaggtgccatctgtcaccccttcccttggctaggaaagggaattccctgaccccttgcgcttcccgggtgaggcaatgcctcaccctggtccggctcacgctcggtgggctgcacccactgtcctgcccccactgtctgataagccccagtgagatgaacgtggtacctcagttggaaatgcagaaatccctcgtcttctgcgtcgctcaggctgggagctgtagactggagctgttcctattcggccatcttggaacttctttctgaaactattctaaaatctttatgtatattaagtgattttatccacttaacagctctatgaggtaggtactattattgctcctattttagggatgaggaatagaggcagagagaggttaaataacataactgaattatacagatagtagcagagcagcatttcctaattggggcatcttactccagaatctctgcttttatgtccactgtgctcctgcaaaccttctaattcaagagcctgttttcatatctttacttctgtaactcacctaaaagttgatccaacaaataatcagggacacagtcaagtattttgggagaagaatgttcatagcagcaaaacttacagtcataaaatattagatagaaaataacctatatgtcctacaatgtagaatgtttaatcatggtatagaccattaggcaagcattagaaattatgatctagaagaaaaataagtaacatgggaaatgctcagtataaaggtcaaagggaaatgcaaagatacaaactgtgatcctagcaatgtgtttgtgtgtgtgttcagaaaggaaatccattagtcagactgagttccaattccaatcttgactctgtcatttattacttttgttaccttggataataatttcatccctctttaccccagttttctcatcagaaaattgggatgagttgttgtaagggttaaaaaattcacacatgtaaaatgcttaaaatactggctggcaagcacttgacagctatcaaaatataggaaactctatttaaaaattagaactgaatagtacacattcagatggtagtttaataagtattctttgtagtctaggatccaatattttatagcttcctccaattatttttcccttttacacttgaaaaaataattgtaagtcgagtgagatgaggggcattttccattgcaagcaaaaagtatttgctttcagaatctactttgtcaaattataagacttactaaacacttaagcaaacactgaagggttatcaaagttttctttttaaccagataccttctcaaggctgtattcctcatattttactttggttgaatactctttaattgtgaggatttaaaactatttagaactgtgttttcatgtcagttaggatcagtaaattgaagaaaattacaaattggcttttgaagagcctaaggccatatatagtttatttctcatccatgttttgaaattatcttaattatattgatttttaaatttcaatttaaaaaatagaagtgagcagtttgaataatagcacccatctattttgcctcaaagttttgtttttcttgtctaattaagagaataattatttttaattgataagtaaaaattgtatatatttatggtgtataacatgtttcaatatatgtacacatcatggaatgtctaaattgagctacttaacatatgcattatttcacatatttatttgtagtgagaacacttaaaatctgtcattaaggaaattcttgaagtcattggagctggtctcaggaataaagctactggttcaggggcgtgtgactttcagtgctctgcccagaatcttcaaagtagaatcaatggcttaagcactttcttaagaaaacgctggaaaatcattgaccaaggaaattaggttattttgctgctcacaccattaagaatctggtttcctggcaggctttcatagtctttctttctctctctctctctctctgtgtgtgtgtgtgtctctctctctctctcaggtctcctatgtaaaagcgattgacatctggatggcggtgtgccttctgtttgtgtttgctgccttactggaatacgcagcggtgaacttcgtctccaggcaacacaaggagttcctgcgcctccgaagaagacagaagaggcagaataaggtatgattgcccctcagttcagacaatgtagagcttgagttggttagctaggcaatgtaattcagaaaacagaagagcacacaataagcaagaagccaaggttaatttttgttctgatttgtcctactacactgacttagtgctcagcttaggcctttaaaattggggaggattgtcagattcagcaaataaaaatacatatcatggagttaaactggaatttcagataacaagaaacaatttttagtataagcacataccaaatattgcatgggacatacttatactaaaaattgtttatctgaaattcggaagtaactgggctccctgtatttatctggcaactctaattggggatatatacttgatttgacaaagttactttaaaatcctggttcttctaaatattgactgtgtgtgtgtgtgtgtgtgtgtgtgtgtgtgtgtgtgtgtgtgtgtgtgtgtgcgcgcgtgcgtgcgtgtacatcactgatctgattgactttttttcatcaattgctctggctttatgtaaattatgccgtacccatgtagattgcaacatgataaatccagtgagactggcctcattatctcaacttaaactttagtgcagaattctaagctttacactgtccagagacttcaggtttgaaatgcatagctcaagatctccagtcctgtggttcccaaacttgcctgcacattagaatcgcctggggatattttaaaaatcccaagccttagacacaccttacaccaactaaacctcaatgttaggaggggcaccagcctctgtatttctgcagctccccaggcaattctggtgtgcagacatgcttggaaagcactgttctggtttataacccaatctcatagaggctatcaaaaggcttgcacctgttttccatttcaaactctgggagagaaacataccctttgatatgaagaatgttacctcctgtaacaatattgcttgagaactaaagttaacattttatgtacagtagagagagaaagatttttcaaaatctgttccagaaaatatttgataaattaatcctgctggtgaagtaatagttatatgctactctgttggaatgaaaacaaaaatatttcacagtccctattaatgctgcaaatacctagatgtaaagctgaatatttgttgtgagacattgcttatattgaggagtttatgtgggtatgagctcactgagttctgactgcatccactgaaaggtttcctgcacatactctgggctggaagagataaatctatcctgttagctgccctgtctcactcttcgctacctctcaggaacattttgtcctgccatagataaggaaaacaagtaaacaagcacaaatatcctctttgctgtacattaccttttaatgttgtgcctttctcaattttctcctcactgcctccctgttggtgctaacgtttctttaatcacattcacagaagtccagcacacagcagcaaaagttcaggatcacttgtgccacctagaaaatattcttacattacgatggtatttcaacacaaaacagtacagagttaaaagaattcatgctgcaactgtctattggtcagtggatggtttaagtccttcaacaacttcttttacatatggtaatactgctcaggtttcccaaacttaccttatcataatgagactcacctaggacccttgtgaaacatactaattctcagcaaaattcctttcagatgttgatttataaagttgggtggaatacaagaatctgtacccttaataagcactctaggtgattattatgatgagataaatttaagaaacactatcctggcttactgactgcatactctcctagaccaaagatggaaaatgggtttcattttgcttcccaattctaaatagttgttagggaatttttgaaatgctgtgtgaaggattcttagactgtacctgggctctgtgggaatgagatctgtcatcaattagcaatgtctggcattacataataacagatattaaagactaatttttaaaaaagtataactagcaaacaaggggggttggatatggaataataaacagacaaaatcaatctaaagcaccagcatggcacatgtatacatatgtaactaacctgcacattgtgcacatgtaccctaaaacttaaagtataataacaaaaaaaaaaaagaaagagggaatgcagaaccagacagacaaagagaaagcaaatagagaagtggtagattaaacccaaatatattataaatgcagtaaagaaaaatagaataaatacctctattaaaagacaaacattttcagatgaaatttaaaaataaaactcaactttagtcagcctccaataggcacacctataatataaagatagagaaagcttcaaagtaactgtggataaagatatctcatgcaaacactaaccaaataaagccagtttagctccattaatattagataaagtagactttaagaccaaaattattactagaaatagagatatttcataatcaaaatgatcacttcaatagggggatgtgattactatagatatgtctacaacgaataacatggcctcagaatacaccaagtttaaattgacagatataaagaagaaatagacaaactcacactcatagtgaggaattgtaatatacctctcagcaactgatagaaaaaaagcagacagaaagatcagtaaggatataaaacatttaacaacataattaacaaactacaccctcaaatgcagtaaacatatacttttcaagtcagaagaaacattttggtatatttatcatgagttggactataacgcacctcataacaaatatcaaaacactgaaataatattatctgagtaaatagaattaggctaaaaatcaatggtacaaagataactagaacatctctataaattgggaaataaccaaatacttctgaaataattcaggaatcaaaaagaattcacattggaagttagaaaatattttgaattgaaagataaattgtacatatcaaaatatatgaactgagctaaagccatgcttagtgaaaaatgtatacttcaaatgcatattttataaagatggaaagctgaaaactgattatctaagaatctatttcatggagacaaaatgaagaataagatattaaatccaaagagtgtagaaggagtgaaaaactatgaaaaaaaacacaaagagcaaaaattaataaaataaaagaatggtccattaagtttactgattatcttgtcatgaatgttttcaaatcagcatttgggaagaaccagattgcagtagtttaaggtaggtgaggatatggaaaaagcaagtatagattacttgaaaatttagctctcaaagggagagagggtaaaacaaatttctgcacaatctcactccctgtcatcattagactactcacaggttaaatatatatattcattcaaaagatgtttattgagcacctactatgcttaaacatggaaagctgtgaatatagtagagaatgagagggacaaagaagtagaaaatgaggttgaaaaataggtaatttcaagatttatttgcaagccagtataaaggattttattttattctaagtgattggaatccactagttagtttcaatatagcaaataggctattgagtggatagttgtggtgtcaagagtagcagcagataagttaggaggctattgtagaactataggtggaaatgttgatggcttagattatggtattggtcatgagaatgaaggaaagtggttaggttcaggattctttcatttgttccacaaaaatttatttacttcttactatgtgccaggcactgtgtaaatccttagaatacgttgcttcacaggacagaaaaaaatgcagccttttgatgaaacttacattctagtggttatgctttggaggtaaaaccaataggtcatgctgatgcattttatgtgaagagatgagaagatgaattgaatatgactcacagatttttggcttaagcaactgggtaagtagtgttaccatttattaagatggggactattgtgacaagcgcagatttggagtggaacttgagtcacatttttatgctcttaagttcagatgcccatgagacatctcgatagagttggcaagtaattagatagaaatatatgttcaagaaagggataaaatctggaaatgtatatttggcagtgaccagcaaacagatactgttttaaatccacaaaactaagtgagattacacattgagataacagaaacaaaaaaaaaagctctgagaatggagcattccatcatttagaaagcctatctagagtggattgggcagaaaaaggaacaaaggaaatggtgacaaaccttagatatcacttgcaattgcctttactgtgcaggggaacatagaagatggtatggaataaaatgtgtgctcatggggggatatattttttccaaaatggaagataaaagaatgcatttggcaaaggaaaagggaggtattcacattgcagtgaaaggagggcataatttcaagaacaaatgtcttaagaaggtgagaaaaaataaaattcaaagcaaagggtcagggttggcattacatggagacaactatttcacccattttaataatgacttaaattattgccagttcatagatggagatactgaagcacaaagaggttaaatagcttgctcattctcatgagccaagaagtggtgtagtgggtctgaagtgagatactgtgttcccagagtctgtgtgcttcaccattgtacaaacaaaatgggagaatgactatggttgctagccaattggtatgtccaattatgataggatgtaggagctcctaactaatagctcctatcatgtccatgaattctgaggctatcagctaagagtatggtggaaaaaagaaacataggtttgaggaagaaggatcaagtattaaatagtagtttgggagggtaaaaaagccattcctccaagaagagtaatggggcagaatgctgaggcagaggcagtgggagtgcccatatgagaactgtggttatgactttaaagtgtgaacaatcaggaggtatgtgtttccccccagcaagcttccaggatcagattcaggtactgagataacaggtacttcggtttaactacaattgaagttttgccaaatgagcaggaaagtgagtggaagacaaagagaagacaatagaggagttgaaagaagagaatgtagaagggaagaaggaaggaagaaagaaaccaagaaaggagaagaagggagggagagtgggagggagggagaatgggatggagggagagtgcgagggagggagggagggagggacggaagtgaagttaagggaggttgcatggcagtagttgcagtgatgaaccagaaattctaaggtggatagagaggggaaaacacggaagagacactgtattcaagagagagaaagagagagactcaaaattaagatttcacaggaagtaaagacaaagataaggttatgatcataaataagcatgtgtgactaaggttgggttgagaaaaaattattgacagcaaggcagtccaggaattggaaggccgaggatggggtctattatccatatgaatattgaagatcccccaataaagatgacattagtatgagtgttgggttgacagggaaatggatgctaaagtcatcaactaataaaggagtacaactaataaagggtaacagcacagataggtaacagcagtgataaggaaaatcagtagtgaagtctaatgacctgagcttcagagacgccaaaggatctgggtttgaggaaggaggaaaaagatatggtttgggcattgcagtggggagcaaaaaggataccttagattaaaagatgttttagagatgccagttggcagttacaatccctgctatgtttattgagaaatgcaagtttgcatgtttgacatggagatgttcttaagtttgtgtatggctattcagaacataatgttttattaccaaagttaagtcttggggggagttgaagagcaaatcaaatcatgcttaagctttgtggtcaagtttcctaattatcaccgatggttgaattttgaaaaaataggcaagaaatatttccaattatttgtcccttaggaaaggcagcatttttcagctttttaaaaaagtctgaaccatggttagaaaaaaaaaaatgataacaagagctaacatttattgagggcttactatatgccaggtactcttctagatactttacatatagtaattcatttaatcaccactacaactgtgtgagtaatgcaatcatacagcccagtttacctgggaaagtcttgatttaggcctatttttccaataccttgtgtgatttagaatttgtcctggattactcattttaaacaaaatgttttttattaatagttgcattaaaataagtggaaacgggtttggttgacctccactttatagacctggattctgtcatagggtgatcctccggtataggggtatgcatgtgcagtgaacgagttctcaccttaacacatggtgaaatcgaaaaaataataataatcactactatccaggcatcttttcttcatatgttccagatgcagtgtcataactaacactccctttccaggatagcttgcgggaggggagcttgcttataaaatgaagtgcaattggacaccagaggctggggacagatgttgctctctatcagtgatgggtcactgctgcccctactggtcacttgggataccagccttgttctatggcatggcatggcatggcatgcaaaatccatgaagccaccgggctatcacttcatagggtcagtgggaaacatggaaaatcacaggttctgtacacataaaaaggaaagaaaaactgagcagtcttgctgttgagcatctgaatgctcataattgagtgatttttttcatttttgtatgatataaatccgttttaactacgttttattgtttgataaaacttttttttactttgcaattgtcaacattatagagttgtaatgtctgtcagtgccacttgccactatcaaaattgtccttgtttggattaaattgagtaaattaactaataacaatgaagatactgttcttatctcaatttacagatgaggaaactaatgcaaaaagaaaatagggtgaggcaaggtgaagcaaatagggtgaggcaagtgagtcacacaagtacagggtcagatcctgttttattttttatttaatgttttgttcaccatggattttttgtattaataatgatattttcaaacattgcattaaatatcatttgagtactggagttttgggtaccccctcagattttgcccctgaggcctcacttgttttcccctagtttggggcccacctagtcatgaactactaaattaattttcacagaaatgcattgtggcctgagttaatttttttttaattatttaaaaatgttcaatattttggccgggagcggtggctcacacttgtaatcccagcactttgggaggccgaggtgggtggatcacctgagggcaagagtttgagaccagcctggccaacatgtgaaaccctgtctctactaaaaatacaaaaatcagccaggcatggtggcatgcacctgtggtcccaggaactcatgaggctgaggcaggagaatcacttgaacccgggaggtggagattgcagtgagctgagatcacgccactgtactccagcctgggcgacagagtgagactctatctatctcaaaaaaaaaaaaaaaaaaaaaaaaaaaagtaaatattcccaaggcaatatgtcatctctttaatttcctactgagaaactgacctctgaaataacatacaggttgatattttagaaggtataacaaaaaacaagagcagatcatctcccaaaaagacaatggcattaagctttattcagggaaggtatttattgagagaacacctgagattacatttacatgcatgggaagagtgtctggtatttactgagcaatcaagttatcaaatggggtcactttcaaggagtggccgggcaatgtgcaactaggtgtatttgctttgattatcttttctaggttttgtaaagcagccactgtcaattttatcaaaacagagtttctcagaaacaatcacgcccagatcttccctgacagaactggccaaccccagtctattagaagctgatgccccaggtctatgcaataaaactctgttttaatgttatcgcctctgctccaataagaaatatgtgcaccatgtgaagttataacaacttctctacaatgcagcctcacctgcatttatctcccactttcattttatatctggctgcaccatgccttacttctggcattgtacctaatttcaaatgtttccagttacccagatagccctgacttctttttgttcagctactaaatagaaattgtggctgcttgagaacatggttatggcatgtgggccacctaatgacaagttgccttttacttatttttcttctattttgtttttaattgacacataatagttgtatatatttatggggtacaatgtgaggttttaaggttttatacattgtattatgatcaaatcaggataattactgtatcaatcatatgaaacacttatttcttcaccaaatcatctcttctagatattttgaaatatacaatacattatcattaacgattttcacccaactgtgcaatagaagaccagaacttattcctcctatctaactgtaacatagtacccactgactaacttctcctcatctctccctccccctcattttctctaggcactgataaccactattatactgtctacccccatgagatcaaattttttagattccacatatgagtgagatcacgtcctttgcagggacatggatggagctgcagggcattatcctcagcaaactaatgtaagaacagaaaaccaaataccactcattctcacttctaagtgggagctaatgatgagaacgcagggacacatagaggggaacaacacacactggggtcttttggagggtggagggtggaaggacagagaggatcaggtaaaactaatgggtactaggcttaagacctggggtgatgaaataatctgtacaataatctgtacaacagacccccagttacagacatgaccctcagtgtgggataggtgaaatgtgagagatggaggtagcgatgtccatgaggcagtccagcactcaggagagaggactgggttggacagacatgctgagaagtcattaggatatagatggaggttaaagctatggaagtggataagattacccagcaggagtgtacagagtgagaagagaagtggaggagaaaggttgagaaagagcaggaaggggcagggacggagcaggaagagggaatggaaggggaaggcagtgtaagggaaggcagtgtaaggcaaggcagagggctgagggcaaactcctgtgagcaccagcatatcagagacaggcagggggaaaggagcccatgagagagacagagaaggtcagacggctatgtaatcactcagaggctagaaaaagaaacatattcaggaagaaaattcatagtatctaaagatgtggagttcacataaaataaaagctaagaagcagccatggattttaggaagtcagaggacattggtaacctcaacaacagcaggctcagtggagagacggaggcagacacaagattttaggcagtgtagtagtgaagtggacagtgaggaagtgaggacattgaatgcagccattttatccaagaaaaagaggcagaagtggctgaggaggcatataggccatggatttttttgttggttggttggttcttttgctttttatttagtgttttttttaatgagcaacttgagtacatttaaatgctgatgagagagttgtttatagagagaataatattacttacaggagttttgaggaaaggtgggagagcatacttaggtggagccactagccatacccagtagaaggtattccttctgataactgggagacaaaagaaggaataagaataaggacatggcaagtttgtgggtgggtgggtaggcggacaggattttgaaggaatccccacatgatggcatctgattgttttctgtgacacaggaaacacattcattttcagagaataaagagggaggtgacagagtaggaggtgtgagaacagtgggaaaactttgaaatgtttgtgaattgcgaaatacatcaccaggaacccacagaagttttctcaagcaggcttagggtccatcggacgtaggggaaattggatatgtaggggcatcaatgtgctggattcggtgaggttctccagaggagctcagcagcctagaataaccagatggtgggttccacaattgatccaggcaggactgactgaaataaaaatgggcaacccctggttcaaaaacaattaagaatttcaagatggcaacagcagagcattaaactaagcctagcacccctctgtgtatggaccctgtgtgtctgcacaggttgcatgcccgtgaagccaatcttggatccaagctgagggttttgccagacaggatggatgaatggataaaaatatgaatcacgtgatggtccaagcagggtagagaaagggggatactgtaaagaagagatgagaatgaaaggagaatattttacacataagtgaaataaatgtaagcaataaaatgtggcagttagcccacttatttattctttatttgcaataaaacagttaactctagcttttaatttcaatgattctttatatttctatagttaccaaatttagttgaagttctagttttgcacagaccttcttaagggagttttgctttacagattttttgaagggagttcaatgtttaaatgagaaagaaaacttgtatcaactagtgtcctttttgtgttgttttgtttactggggtagacaggctcagacaaatatttcagtgcagaatgttgtgtgctgtgggaaaggtttaagtgcatgatttaaagtgatgactgaggacaaagcatcttctccacttggtagtgccagggagttgagcctttgtctgggtcttgacacaggagtagaaatttgccaggtcaaaaggaaaattaagaggatatccaggctgaggaaacggttatgcagaggttcagatgttagaaacgacatgatgctttcactacatcataaaaagttgagtcaggaaagtgctaaagcatggggcctaaaaggaaggaagacttcagttgctcttgaactgggagccaccaaaaggctttataaatgatagaatgctacaatcagattggaactgtggaaacatcactctatatagaaaggatcagattggaataaggcacaagatcaggaaaatgctgcttcagcatttcaacttaaaaacacccttaattttataagtagtctacacttccctgaagcccctccctagaggcatagatcattattactattttggtttgcctttttgtaattttgctagaactagctttccaaatctgggatgtatattataaacttaccaaagcttgtcttaagtgtgaatataaaagtggctttctggtttgaattctttgcagtaacacaggtgtcttatcattgctgtaacaaatcactacaaacttaatggcttaaaacaggaaaaacttattatctacacttctgtaggtccaaaatgggcctcactaggttaaaatcaaggtattggcaggactgcattgcttctggagggttgtcacgggggttcaagggattgggggccatatcaaagaaaaagatatgaccacgcaggcagtaatacacaacaaagtttattgggtggcacttggacagggttgcgtgaaaaggtggctcctcacagcatgaaatgatccagaggcttagagacaggggccaccatacagagaggagaggacaaggggactcccagtggggaggtgaatcagagggggctcacttgtctaggtgatgttgctcagctgcacagtgggggagcctctgggtcagagagcttcaaagagcagcagtgccatgggaccttataagtgcaaggaccagcagatgctaggcatggtttcgtgggctatgcaaagcagtcagggtctagatggctaaaaatctgcttgtttaggctatttttaaaataatggaatgtgtaaaatttgagtttggtgccagcaagctttggagataacaggtctcaacctatagtggggaaataaacaaccaaggggacaatactcagaggccatctttggctcatttatataacagtgttctaggggagaatctgatttcttgacttttccaacttctagagctacttacattccttggctcatagtcccctttctccaaaggggaaagttgttcaaagccataacattgcatttctctgacccttcttccattgccatgtgtacctctgaccacagttgagaaaggttctccatttctaagagtcatgtgattaagttgtgagcacgtagatcatctagggccctctccccatccttagtttcttaatcacatctgcaaagcccctctgctttgtaggataacatattcacaggttccaaggattaggacacagacatctttggtaggcattatcctgcctgccacaaacagcaatggtttccactgcaactctgagagcatccgttgggcactgtagcatgctccatgcacactcaggacagtccagaagtaccaggaggtgaatgctacaggagtggccctcaaccaatgagaactgggagttggtggccaaataccaagcttcctcaacccttggtaagtcaagtctcagtctctcagaggtttgagccccatttggcaaccatggtcacctgctgattattcacacatcctttattgacttttctcctttccttgtcctacacttccccactccctcaccacactcctgttgttgcctcccaagtaaacctcttgcatgcaatccctcatctcagggttgctttggagagaacaaaaacaaactaaggtgcaatgcctcctaggccaaggacctcatgagaatcacaacccactgaaccccatcctcggcctccccactaaacaccagattctggaggactttttgtgcctaaagtgtggaaacagagggaatctaggagcagcaagtgtcaaacaatggtttattgtaccttacagttggcattgctaaaatatttctgtgctgctgagcttctaaaataggtttcataacacaattctattgctttatgtccctgaaatcaagcctgtgccttcagctctactagtgtttcataaaggctatgatggcagataccttgaaccttcttctttcactatctagctcttaattggtgtaagattctttttttccactttaaaatccagatcctgcacaatggtttaagattcttgatggcaacttgagctgtagttatttcagcataactggactctcataaaaagatcgagctaaatgacagaaaagtctggtgcttccttggcattacatcagagatgtgggtttgcctaatcatagtagtaatttgtctctatcactgttattcttgtttttaacaagctgatttggggacaatatgcttaaatggagttatttcccacctgattgatgaggcagcatcagacgcgagtataaccgtttataaaataaatgaccttggctctgtgcaggagtgggtaaaaggaaacgacccctgccttcttagttttcattctaagctgctagacaatcctagatttcatttcttcaacaaatagtttttgaatgcttgccttgtacagtgttttgttttagataaggggcagataaaaaaaactgcttgaaacctgttttcacaaaattttagaggtcaatatcagaaaaaaagtacaaaaatgttctaatatgaggtagagaattttaagaaccataagagagttatagttggagctgtggcaattcccaggaagggagagtatagtgtacttccagctcttaaggagggaggagattctcaagaaagaagcagcatttgtaaagttcattttatcttagaatgttaactgtaagttattctaaactcatcttgttattgtcagtaaatgaaacagagattaaataattaaataggtaatgaaaactacattctttaaggtggcatttaatgctcattagaaagtagccttatcctgccttgctgatacacatttacatcagatgaacctggagagcttcccactccaagaccttcaagaggaaagtgagagtcagtgacacggaagctttgtttgatctaaggcagtggttctcagccaggagctatttttccccaccccaggggacatttggcaatgtatggaggcgtttttagttctcacaacttggggttggggactgtgtgtgttgctgaactctaatgagtagagaccaaggatgctgctaaacatcctacagtgcacaggatggtgcccatagcaaagaatcatctgacccgaatatggatagtgtcaagtttgaaaaaccctaatctaagggacagaagcatgctgtgcacacagaggactgaggtttagcttcatgagtgcaagctgcttatgaataaagatgtcactcctgtcaggagtaattaattagagctagtataacccagttgacaaaatagtcagaaaaacctttcattaagaatttcctcttttgtaagtgaactcttttactctacataaagttctttttatttacatcatatagcaaatcagggatccaaaatatggttctttgtactggtaatgaacaggggcatgaattttgttgggtgtatgatttaattgcttttcaaaatgttgacatgttgacatgggtgtaaaaacatcaggaggttaagttattaaatgcctccacttcattccactctatctgctgctgctaggatttgttcaagagcaacagaagtcataccagaaatgagctctggtattttctagaaacaaggtaacccattacagcatggttctcaatcctggttacacactagagacacctgggagctttttaaaatctaaatgcccagaccccacctcagaccattaaatcagaatatttaggtgtagagcccagacatcttggttttataaggcttcccaggtggttgcaatgtgaagccaagtttgagaaccttgcttctttaaatgtcatctgttgaccagcagcatcagcatcacctacagcttgctagaaatgcagcctctcaggccctaccccagacgtgtggaatcaaaaataacaggattctcaggagattcactagcacattaaagcttgagaagtgctgctctagaatatatcgcagagagtccacttttaaattgtatgcatgttgcaatatgcacagtctaaaacaaggcatactattactattaagacatggtaaaaagctccaaagctttaaatagaattattttcacttggtaagaaatattaagtttattactgtggctgcttgtgttttgcactaaattttatttttaattgtgaaagatttcaatcatatagagtaatttaaccctatgttgcttgttgttttgtttctctcaagaagagtaatcactaagtagcctaggattatcattctggtattaggagccaaatgggaaccccatgaaagaccttttcctataactgagaaggttccttctcagctctgtgttcacatacacaaggaggaaatgatctgaaatggcatgtaacaggatccatgatagagtgaggagcttcacctttgttaacaagattgaacagtgcacacatgcattgtagtaaaacaataattctaaatagtcatacaacttcattctggaaagcacaaaatgcttcaaattatggtagtttggcagtgatatctccacagggagtttataaggtttgctgaatgtcgtacagccaattcctgactgccagacctgagacgccttaattcaacacagaatcattgaatgttctttcacacttcctgtcttttagggcagattgattaaaataaaacttacaaaaatacctgtcttaaagtcagccttcttcatcccagccaagtaccctatcctgtcaatatgtttcattacagcaccatttcctggaattactgccattgaattcccgtcctcttaataacatatactttttctctccaaaacatgcaaaaaagaatatgagagagaagcatgacatagtgacacatgcttagggccaggagtccagctggctgaatctaaatcctggctggtgctttatttgctgggtgattagagtcatggcctaaccactctgggtctcagtttcttcatctgtagaaagagtctaataaagtcctttctcatgggctgctgttaggagcaagcaagattatgcacgtgaagaacagtgccttgcatacagccaatacttatgaagtatttcctttctcttcctttcgcctgctttttgacatgagaatattgcatgatacagagtttggagcatgaatcccttcaccctggtagtgagcttagaacctgataggtagttttttaacccaccccccaccctccaccctctaaaaaaaccaaaaaacaacaacaaagaaaatatcatggtatatcctgctttgtaaaagtaaatactactttgtgaaacttttgttgccattagatatattaatgtgtgtggaagtgtgtgtatgtgtgtcctggttagtaatggaaaatatgttttcctactttgacagcaaaaaaggtgtgtgtgtgtgtgtgcacgcgcgcgtgttgcatgcactgttagatgacagtctttattttttttctagctttaaggtataattgacaattagaaatcatatatatttaaggtatacgacttgatgatttgatatatgtatacactgtgaaataatcaccatgattaaactaattaacatgtccatcatctcacattgttaccagtttcttttttttccttcctttctaccttctttccttccctccctccttctttctttcatgagaacactaaagatctacccccttagcaaatttcaagtatacaatacagtattgttaactatagtcacattgttgtacattagatctccagagcttattcatctcacagaactgaaactttgtatcccttgaccaacatcttcccctttcccctcactctatctcttggcaaccaccattctactctctgcttctgtgagtttgattattttagattccacatataagtgagaacctgcagtatttcacagcaaaaagttttgaaggccagtgctctcagggtggatcaggccaggtaaacaaattcacctgaccatctcaggcttaaaccttctcacataccctcaagaggcagtcacagacacagtaggaggggtcatttggttgccatgatgacagggacaggaggtatatgttgcactaactatattgcacctcactaaaacttgctaagccctcgcttttgtttgaccagcccacactcacacgccacctgagtattatgatgcccatgacccagtgggctcatcactccgtgacctgccttcagagttcaagctgtgtcatcctcagctggacacaacatctgcccaattatacagcacacagctgggagaaaagagagacatcaggccaggcgcggtggctcacgtctgtaatcccagcactttgggaggccgaggtgggcggatggcctggggtcaggagtttgagaccagcctgaccaacatggagaaaccccgtctctactaaaaatacaaaattagccgggcacggtggctcatgcctgtaatcccagctactcgggaagctgaggcaggagaatcacttgaacctgggaggcggaggttgcggtgagccgagatcgcgccattgcactctagtctgggcaacaagagagaaactccgtctccacacaaaaagaaaaaaaaaagagagagagacagcaactcaggagttaagtccattttctatgaaaatatatcgtcttagaaccatatcaggttttcctttttgcctctgattataactattgtattgacatctttgaaaacgaaagggagagctgggcccagtggtgcatgcctgtaatccctgctacttgagtggctgagatgggaggatcacgtaggccagcagttcaaggctgcagtgagctatgatcacggcactgcactgcagcccggacaacagagcaagaccctgtctctttaaaaaggagtagggaagggctacagaccccccatcatgtgccaaatactgtgttacataccttcatgcacactttcttaactagaaactcagctggtcaacaattagatcaacagatactggcattattttcccatagtgaccaatctgtcttctgtgtttacttcaatcaatcttccctctgggcctacagacaagttttctctctgaaatattaaatctggtaaccgtaataatgaagcagagaaaagaggaactcttggaaatgcactacagatactccaccaaacaaactctcattttatccataattttccatttttttccagcaagagttgcgtataagaagctataagcgacagtgaacaaacaaatggttgcagggaaagcataagggagctaggacagagatgatctgcaaagctaaatcaatcataagccagaataatggagcatagactgtgtttctggttcactctgctgctttgatctgcagtccaatgctctacctctgagctataccccctccttactctgctgctttgaatgtccttgagagaagcaataggaaagtgcctcctgatggtttacagtgttcacctgcttcggtaactgctaattttaaaccagaacctacagtccatattcattaaagaagagctagcttaccaacatcattcaaattcaggagataagattggccagagaaagcaggtttatagtttttcacctggagaaacacatttgttctgcagctgtggaaagcaatgacatgatggcccatagatgtctctctcctcaggacatgcctcactgcccctctgctagaaacctcctaacacttctccaagtcacacctgggcgatttcatcatgaacctaacctgtctcttctaagttggcaggaagacatcgagggccagaccaaatatagatctgatcctagtgattgagttctcagttcttgagtttactgagccccctgcagaaacaaacaactcaccaaacttccactgcaaacagcattgactttcatccctctgagctacttccagcagaaattgagcagtaagagggaagaggggaaagaaagcagtggctatctggaaggttgatatcattgcttgaagcctctaggctatcaaaacaatataataaagacaggcctctgtgaacaccatgtgtcagcctctaaaaggacatacattcattatttacataatgtgaggtaacatgttactatatcaggagttttcttattctatattctatattttatatattctatattagagtcatcttcaaaattataacagcagcaaagggacttgttgcctaattaaaacccttaaaaatgatgaaataaaatattatgtacgtcaaagataattgaaagaggaaaatatgcctgaactgaactgttgttacggttgattatattagaacagggtttctcaaaactggactagaaacttctgagagattatggagggccatagcaggacatagcttatcaaatacatctttcctgaacttgggtcagcaccttcaatgtggtttaccctcttagacttcttaacttagcagtttttacacacagagactccataaatagaagagatataaattttcacctagtcccctaacccattcaacatttccaacaaatggctgaatacttgactatttctagcaatggtgagttcattaccttccaaggtggtatgttccatgttcagtcacagagttgttaaaagttcatcctcatatagagttgaattctgtctccctgtaatatcaaccaacagtctctgattagtttccttggagccattaatacaaatatgagtgaactcaaaagagcccttcattcttttgaaaatacttgtcatatcagccaggcttatctcttctcaaggccagccttttgttgttccttctattcttgttccttttatgcttcctcatgtgttgtcactttcaggaacattcaccaccctgggagggttcccttgcccccaaacttattctcaatctgtcctgtttgtatctcataatcctacccctttttctatccagtgacccagggacaactgtttataaattggaatatcaatgagattctctctttcaagaattcaaacagaggttctgatacgctaattagatgacagtgaggacttgagttgaacagtttcacatagagctgaggcggtgtgggcctgattggaacatgaatgattatgggaacctggtaagagaagagcagaaattggagagagcatgagccctgagaaattgagaacactctcacttcctgacttgctcattggagctcctgggctagatagccctgtgtataccatcatgctaacatttattgagcatacactatataccaggcatgtaaacttttaatgtacatttccctgaatcttctcaaaaaaccctctaaggaaggagatatcatctctattttactacaaaagagactgaggcacgtagtaagtgacttacccagttcccacaatggttagtggcagagccaagatttgaaaccagagttttcgctccagagcccaggcttctcacctttacagggcattgcttccctatccttggaaacttatgagattatcttacaataattttcttataataattccttaaagacagttccatttatttaagctactatgagtgagtttctgtcctttgtaacaaatcttccgcgattaagatgccagatggttaaaagataccaactaatggccaaatggcagaggcagtgcattttgtcatgttattatagaaaaaaatgccatctagctttccttcaattgccttggcataacattaccttttccatagtatctggtggtctgttcctttgccagagcagatatcacattatattatagtcatttgtctgtatcagggtttcccaaccttagcactgttgagatttgatgctagataattcatgctttgtggtgggggctgtcttgtgcattgcaggatgttcagcagtatcctggcctctatccactagatgccagtaaaacaccctctcccagttgtgacaaccaaaatgtctccagacattgccaaatatcccctagggggcaaaaatgaccctagttgagaatcactcgtctacatgttctagatcctctccactaatcgcacactgacttcaagtgcaggattttgtcttctttatccttgtttctgtccaacgcttggtacattaagataatcactcttaattgaaaaaaaaaaaactatagttgcttgcattaaagtggcgttttgtagttaaaagtctggagtaactgtacacctgtatccatctgggtatagtcatgaagacaaagacattaaaagtagtaccaaaatcaagggtttaatatagaaattaggctttatatgaatgtgggggagtaactgggggggttaaggtctaaaaggcaatagtcaaaggatgggacttaacatgaagttctgagtagaaaaccaagtgttcacagaaaaatctgagaagtcaccaggtctaggcaccaaagtaagatcataaagtgggagtccacagaaaggtctagccaccgtgtctaacaaagcagcctcttctgaccccaatgattcccaaaagtaatagcctctgcttcctttctgctttccagatcttccaagtttctcttactgaaaaatcctaacctgcaaccaatccagaagagaattctgggaaatatagttcttcccagccttaggcagatgcctaaggagtggtggtgccagataaacaacagataatcccatacaataaccactttggcaccaagtgtgtggatatatatagagagagaagttgaagcacgataaagatctagagaatttggcagtcagaatcatccaagttagtaaacaagcaaatgcttgatgtgatttgtcactgatgctgttattattgttttgagtttagtagtgggttcatcccctaatcacctgacccctccagtctcaacattcaccttgcaccctgaacagatggcaaatgatattaataatcaaacagctcatactccagatggaagatgttcaccttcatgcttcttagaattttgtgtgtcttttgagcactctagctagagcagaattgacagaaactgctgtgaaagaatttccatatgcaaggcattgcttctcttatgaggaattgaaatatcacagccatattatccatttctaaactactctctaaggctacagatgacattaaataaaaacatttctgcttgatagattttgaacagaaagccaaacaactatttttaaacaattacttctagtccatttaaaatgtggtgctgtaggtgaggtatgatccaaagaagagtgaaaaatatatttcactatagaaaattctattcaaaatatacattgaaaagacaaagacttcagagtttgcatggcccacaaagcctaaaatgttgactatctagccctttacagaaaatgtttgctgactcctgggctagagggagaacagcaggagttaaggtctgagaggtaaaggggatgttacaaggacttatgaggagaaccactggagagttttgagctgaagatgacctgatttgactggaaatttaacagaatccatttatttgctatgttgaaaatagacactattgttgggaggacaggtctagaagccagcagaccatgtagatgactactgcaataattctggtgggaattatcctgatgagccaccaaggggtggctcagaccagcatgtagtgttggagatggcaagaagttattaggttctggtttgaagcttgaactgattctatttcctggtttgaagcttgaactgattctatttcctgatactagatatattgcatagccccacataggtgtaggggaggctagaatattcagactttccacgtacacatttatgaccagccaaaacaggggttctcaagtagggttgatttactcatccaggagacacttggcaatgtcttgagacatttttggtgtcacagttcaggggcggggtgctactggcatctagtgggtaaaggccatgtaggctgctaaacatcctgaaatgcaaagctcagttcccaagaacaaataattatctagccccaagtatcaatattcctgcaggtaagcaaccttgaactaaagaaagatccaccattatgagaagaaataaagaatgggttttggtggtaactaggagttgtatagcccaactcaactccctatgccgccaccccagccatttacaggctgtggcaacatcagttccaagatttctgctcataccacaactgagttctgtttgttctcccctgcccatacattttccccactactgggggtgaagtctgtcatgaataagaggccctactggcatttttaaatgcatgaggcttgtaaaaataacatgtgtgatcaaggcaatgaaggtgatgttgtataatgatagctaaatagtacaaagcaccacagtgcaggtattaatttgttttaagagatttatgaagagaatattccattaattagaattttaagacttaaaaacggatgtttggtaattactatagatttacagggattttgctttccttgctaaacccaaatgaatagaatatgagttcaaataccctaatgttatacaaatactccttagtcttttgctatgggtgttaactgataagatcgaaatttatttggtaaaatatttgaatatatctaatatgtattgacttttaactagctttattattttgaattgtaaacacatacataaatgaaaaaaagtctttatattctaaaatttttgtctattccatttgttttccttgcaaataagtatgcactttcttttaagattcttaacagggtgaatctaattttcacactatgtggctgctcacgagcttaatacttggccaaaaaaatggacggtgtttcaaaaatagaaaacctcagttattgagtgacattgttaagcttaggtttgccctaattttatataaatccagtatgcaaaaataagccatatggtaaataagcaaggaaatgacttttcaagttacaaaatacttttttcatattaccattcacttaagcctttactttatacatatatgcattcaatgtaggaagattcagccaagtattattctaggcactggggatatcaaaatatgtcagaacgggcccctgcacttgaaagttacatgaaagaggcagacacgtaaatagttgaatttaatatgatgcagtagattccattatggagacatgtactacaggaggtaaggaggaacccatggctcaggatcaggggtcaagaaaaggcattctgaatagaataatggcagagtagaatcttaaaagacttgaaggagtttaccaggtaaaaagaggtgaggattattctatataaagggaagcagtttatagtcaaaggtcatgtaatcctatgagagaagtaggtgtaaggcaggacatgggggtccttgaatgtcacacaaaggagcttgggagtggtcattaaggagatgagaaactgttgaaaagtattaagtcttgaaatggaagcaatggtccaacggcatctattccactaaagtagaaggcagggatagctccataatctgcgtagcacagtgcaaaattaaaatgtaggtcccttgtttaaaaattattatgaatgtcaacatggctatagcagagcattaagccaagcacaggacccttctaagcactgggcactgtgtgactgtatagtatgcatactcacgaagctgaccctgtcagaaggtctcagggccggggttgaaagaagacaataaaacccttatttgcatgtgtctactccctggttgggaagaaaaatcttaaatatatcaaccagctagagattagtctcaaggcaacatactagccagcattatagtcctatacccacaaattcagaaaatggccaaatgtcctatctcttcattttaaagatgaggaaattgaagaacaaaaaaaaattgagggactgtcccaacctcacacatctaggttatagtaaagatgtgaattcaaccaaagcctttcagattctagcccagtgatttcctctgttcctctgcaatatccagtctatttaaagtgagtagaagaggatggaagtcctttgagggaagagattgatccagaggctgcagaaaggactacaattggtaaagagagagttatctgccaggagacaactgctgtcctctcccttcccccagggagcacgacttttctgtgtccttacttagaattaagaggatcactacaaacacaattattgagtaatgattaggaaccaggcaatgtactctagagaatagggctacagagttaattttgacatgctcccaggagctcacccctctggtgagcaaagataatagtgaaaatcagctatcaaaacccagagtccttgggcatctatcctttaatatgaatgggaagcaatattaaagaaaataataaaaagaaaaatggaaattaatacctaaaaccaataggtaactagaaagtctttttcagaataggagaatcatggatgatttgcacatcgccttgtatgtctcagcagtgttaccatcagtaccttcaccaactctggagacttcaggctaaactgaaccccaataaacctttgtacatatctcaaaaatatgcctcctattatactctatttcgttatttatgcccccttcaaaaaaagcaacaacaaatctgacgtgtccaaagtttagaagtatatcttaattatgtgcttccagagccaagtccagtgcctgccctataataggagcttctttattcaacattactgccgatggtcaataaattgaatggattgacagatgaggtcagtgtaactgggggcaccctccaagtggagggcctgggtacagagagaagctttcagtgcatcaaggtgagagaagcagggtcagccacatccaagagatacttctgccatttcactcttcttttatccttctgccaatttcttcacttaagaaagtaaaaaaaaaaaaaaaagtagatatcaagtcctttacctaggcttaattcttatatatactcctacacacagttttacctctcattgatcattttaaattgaaataattaaactaccttataggacacgggctcacttttctaaccaggtcaggttttgattgcattcattcacaatctttacctgtgcataagcctgctctaatatttatttgtagagatcatctttctttcttaagtttattttgtcatagagttgtatatagttatgagtacattcaactctgtggaatgcagatattatagaaaaggttaagtataaatcactttatatggagtacatcatgaattagatgagcttggatttactagcaactggaagatccttctgtaaagtaaaaaaaaaaaaaaaaacccatcggtcaataaacaaggatttatcaagaattttttgagcacgcattagattactcagttatgaatccaatttcaaagaaatcatccactgatttattgcttttatatggttcagatacttattttgaaaggaagcacacttgtgtttggttttataccagaggagagataggctgatgagtaaatgtgattctctgaaatggtacccctgagaatgtcgtcgggtacgacattggtttcctgctaatgtatcattactgagatgaagtcaagatgtttatttttcaagcagaagttacattctctatcaatatgacattacattatagtgctgctagttcttcagggatatgattgattcctatagtagggtggatataggagccttaggcagtgatgctgtatctcaagtgactaagataagatacaggcagctcactgcacagagagccactagccagtttacctagcatgacttacagagcagttttcaccaacactgtacttagactggcatttttagtcctacttttaaatttgaaaagccaaccagtggtcaatcaggaacacattcaatcccatatatttgtaatatttatcttactttatggcaggaattctaggtttagataactagctattgaaagtgtaatatttggcacaacgatgactcaaatagcctgttccagttactgtgctgaataaaccacttcaaacttattggcacaaaacaaccatcttactatgctcaggaatttgtaaaaggcagagtaggaatgacttgtctctactacatgatgtctgacatattagctcagacgattcaaagacacatgattatttgacagctaggagtcagtcatctgtagacttgtttgtccacatgtctggtgcctaggctaggaaaactctaagactaagactgctcatcagagtgcctacacatagtctttccatgtggcttgacttcctcacagcatggcagcctcagggtagttggattttttatatggtgtcccaagactccaggcccaagtgcaccagtgaacatggcaaggctgcattgccttttatgaactaacattggaagtcatacagtgtcatcttcactgcattctattacttacaagcaaacataagcctgcccagattcaaagggaggggacatagacccctaactctcagtaggaagagcttcaaagtcacaatgaagaaaccatgtgaatgggacatattgttgtggccatctttgacaaatacattttgccacagtccaccctcttcgcacaacaattcacatccctcccacgtgcaaaatatgctcactcccttttccaagaccaccaatattaaatgcacacctacaggaatagtaaaatagaaagctgttttttgttattggtgttttattttattttctgggtaaggggaaataattaatgacctataaaagacttcaatgggtgaaacattgattacaggtattgaactaaaatgtagctcaacctgaagaataggagaagacactttcaaactcttcatccaataagggatcaatatcaaaaatatacaaggagctcaaacaactcaacagcaaaaaatccaaataatccaatttaaaaatggaaaaagtatctgaatagacatttctcaaaagaagacatacaaatgaccaacaggtatatgaaagaatgctgaacatcactagtcatcagagaaaagcaaatcaaaatcacaatgagatatcatctcaccccagttagaatagctattatcaaaaagacaaaaaataacaaatgctagcaaaaatacagaagaaagggaactcttatatactgttggtgggaatgtacattaatacagccattatggaaaacagtatagctcaaaaggctaaaaatagaaataccatataatccagcaatcccaatactggctctatatccaaaggaaaggaaaacagtatgttaaagagatatctgcactcccatatttactgcagcactatttacaaaagacaagacataaaatcaacatacatatccatcaacagataaatggataaagaaaatgtagtgttcatacataatggagtactattcagtcttaaaaaaatcaaatcctgtcattaatagtatggatgagtctggaggacattatgttaagggaaataagtcaggcagaaaaagagaaatactacaatttctcatttttgggagctgaaaaagtagatctcatagaggtagagggtagaatagtggttactagaggaagagaagggtagaaaggagtgaggaatagggacagtttgattaacagatacagaagtacagctacataagaagaacaagtttcagtattctatagcactacagtaaacaataatttattgtatttttttcaaagagctagaagagaggattttgaatgttatcaacacaacacagtgattaagttttgaggtgatttatatactaattaacttgatttgatcattacacattgtacacgtgtattgaaataccacccttacctcataaacatgtacaattatgtgtccattaaaatatatttaaaaatttaaatgtagctcaaaactcaggatctcatcatgtaagtcaaatgaagcatctcaggttaagcattttggatacagttaaaaatgaaaacctgggaactaaagagacaaggtatctgctccacttactcaacagacaatatggagacatacagaggataactgttatagactcttccattcaaaaatagggggaacaagaggcacacagcagtcactagttaacaggaattctgagacctagaaaggtccatgttggaagatccttgtttgggggatatattccttggttgtcctctctagtttttgggtctgctctctggactcttattctgctatttgaaacatctttctttttctataagaaggggcacttgtttgccactgagtaacctttttagtctatttattgtctttaaaagattaggagtctaaagacctcctttcattttatactatctttgttgttttcagtccaaacatacaattccttaaaaactgttgggggcagggctgggcatgttggctcatgcctgtcattccagcattttaggagaccaagatgggaggattgcttgagtccaggagtttgggaccagcctggacaatatagtgagacccccacctctacaaaaaaattagccagacatggtggcacatgacccgtccaccttgggaggctaaggcaggaggatcacttgagtctgggtagtcgaggctgcagtgagctgtgatcatggcactgcacttccagccttggtgacagagtgtgaccctgtctcaaaaaaaaaaaaaaaaaaatactgttggggtttatatataaatttataatccacttcattagacaaaagctatactcacaaatattttcaagataaaccctgttttagttaggaggattacgttttagagatgtattgcatagcatggtgactatagttaataataatgtacatttcaaaattgctaaaagaatagattttaagtgttctcaccacaaaaaatgattagtatgtgaagtaatggatatgttaattaccttgagttaatcattccacaacaaaacactacattatactccataaatatatacaattattatttatcaattataagcccttgttatcttaggctccctgtgagtatgctgtgtggcccaacacccttaatattcgtagaagcttattgtttagaggagacaatctgtaaggcatgttcttatgatccttataagacctattgcctgtctgaaagagcttatcaggtactgctttagatatttctcaggttttaacaaagaatcgtacagtcccaccctgtatatgattttttcccctgaggcctgttctgatttgaggacccttcgcaggctgaaaagacttattctggatcctttacatttcctccaacttctacttggacacttaatggcctgttcttcagttctttgtcctctctcagtttggtatcagcagctaaaagccaagcagcatcctcagtgctctatctggaaatctccttaggtagatgatgaggtttattaagtatattttctattttccatgttaccacaggaaacaatgttggtaaacttttccccatcctccagctttccacagcaattgcctttctttcctcccagtcttccaacaacctccttgagggccttccagcttctgcctgctgcctggtcccaaagataatgccacaacatttcagtttttgatacagcatcaattatctgtgtagctatctattactgcataataaatcatccaacatcttagtggcttaaaacgataacaagcagttcattatctctcacactttctgtgtgttaagaatttgggaagatctcagctaggcagttgtggttcggggtctctcctcttggtgcagtcagacagtaactggggctggaacagctgggagttgggcaggcatcattctttcttcatgtactcacagggcttttccatgtgatttctccacatgggctactttgagttcttcatagcatggtggtctcagggcagtcagacagttgacatggtggctcatggttccaagcacaccaggattggagcttcatcactttttatgacctagacttagaagttacttagtgtcacttccaccaaattctgttgattaggagcaagtcacaagcccacttagactcaagtggaggggatacagaccccatgtctcaatggaaagagtgtcaatgataatactgttaagaaaaaagcatatgggatgggagatattgttgtggctatctttggcaaacacaatataatacagtctgtgacttctatatgacatatggaagcatgcagaggagaaagaagtgggaactgcttctcttctctttgccttgccaacatgccactatgctatccacagaccagtttgagagggccctgcagaatgagtgtaggggatcccaccagctgacctaaaccatggctactccataaagcttcctttggaatacttagctgacatgcagaatgatacttataatttcattttatcctcagcatcagagcaaagatttattctgaatccaaaattatttacaagtattgccttatctgggtaaaacttgaaaagtatttaaaagaataattttaactgtattggctaatggctgattttagcataagtcaccttcagtattttttgtcttgcaaacagtttggggttgaaaagaaagactgccagtcatgcattaaaatataaccaagtgtatgcctccagctgagatctctctgagttacagactgtccattgcaatcaatcacctaccccatgtatctattcgaatgtctcaagtgcacctcaatcgtattattttccccaaacttaatgtgatcctcttttggtgtcttctttctcattgaatggcattaatatccatctagtggtttaagctggaggttaaccttgacaatttccaatccatctctaagacctgttgattgcccctctatgtctctagttggcacattgctctctacctataccaccacccattaaatccaaatcattatcatctctcatctggaccattgctgtagctttgtaacttcttggattcacttttgcgttcctctaggcagtcatccacatggcaaccaaagtgatttatttcaatatgctgatctggttatgtcatgcaatctccattaaaagccagttatggctccccttggttctcaaaataaagcttcatcagacactggtttacagggccctatatgatgtagcccctggttcatttctgaaacattgtctcactccacactccccctgtattccaggcctcagttgcatccctcaattgcagcaaaccctcctatctcagacattgccaaaccctgccttcacctctttaatgcctctcattttttaaatctctaatgaaatatcacttcctaggggaaaagcttctcttatctgtcagattagaccaggaccccatttagtaagctctcatagcatcttataattttccttcagagcccttatcatagttagtaattatgtattcatgtgattactttattgtttcccttcatctcaaggttgcaaactccttgaaggcaagaatcaaatctattttgctctccactggatccccggcacatagcacagtgcctggcatctctgcaagccttttccaaccactcaatctaaaacactcccttctatgccacttgcctaagtctcttaccttaactgtttatttttttccaaagcacccatcattatctgtgtgtgtcttgtgtgtatatgcattcgtatatgtatatgtgtgtatatgtataaatatgtttgtgtgtgtgtataatttgtttacttgttactgtttccccctctagaatgtaaattccaaaaaatcagagacttttgtattcttgttcattgctgtaactctaccacgtacctggcacataataggtactcaataaatatttgttaaaaatgtgagaaataagccaggcatggtggctcacacctgtaatcccagcactttgggaggccgaagcgggtgcatcaccggaagtcaggagtttgagaccagcctggccaaaatggtaaaaccccgtctctactaaaaatacaaaaattagctggacatggtggtgggcacctgtaatcccagctactcgggaggctgaagcaggagaatcacttgaacccaggaggcagaggttgcagtgagatgagatcacaccactgcactccaacctgggtgacaaaagcaaaactctgtctcaaaaaaaaaaaaaaaaaaaaaaaaaacaagaagaagaatggcagttgctcaataaataaatcctggaagtttcttctttaaaaatcaatgataaaaatatgctgcactgagaaagagataatacattgacatgtttttcttttggaaaaattgcctttcacaatctgcccaaaatgacactttgacagttttaattcatttcagcacatgtcattaagcaacaaggggctatatttggtttagtttatttcaactttgttgttctgcaaagctcagtcagattcttcattcataatcttgaatggaagccatttgggatttgataatggaagccatttgggatttgataggggcaaaaacgtacacaaatcaaacccagagactttggaatcagttttagaatcagacagacctggatttgaatctcagcttcaacatttattagcactataactataggaagccacataacttttcttggcctcagtttccccaagaaatatgtgacttgaaagatcaattcagtaacaggactgaccatggttttaagtgaatggtacagactcttaataaatgctatccatttattattcatgtctattcccaaagtacccatgatacaaaggaggaaattgaagccttaacagttgaagaaaatttcccaaggccattcctcttatatccaggtctgtgattaagcatcattcaaccatcatttgcttgggagattttttcagtgaaaacccactgtatttggacacatattgcttcctaagacagactggagagtccattatgtccttgcattgagtgagactcactacaaccttcagttccaactgagaaatttcctgtcccaacagaaaggaggctcagtccaataaaaaaatctgggtgagaaatgcgatggaaagatttttaggagtccttttacttcctcctttctcaagaataaaagaaaaattacaaatatagactctgctaaaatcttttcatctgtaagtgccatgttctttaattatattgaaatcatttgcttatgacaaacaattcactacaatgcaactccagtgagctttaggtcaatttcccatctagacaagaattattctaaacacaggaatgagcaaattttacaataagtaaaactgatgcataaaatacataaaattagataataaatttcaagcaaattgcacagtgccatggcagtgctttatacagcagacgggattaaggagatcttatcaaagtgcgatataaaaattgcatgtgttgaaaccttgactggatgattcattttctgtgagaatttaactaatcagtgaataacaaaagagggtcagctagaagtgcttattgctcagttactaaagatggaagatgatggataattaattgagtttctggctaatcagaagaaatggagaatatatgcctaaaattaattatttccttactggaaggacctaactgagtctacctgtaaatatgctcaactcagctgtggctacagattgttctttattttagtttcagtttatccatgactcaagctcatttcatataggaatcttgtcatattaccataacattttattctgaacctgctagaaaggcaattagtcatttattataacacaaaaaaattcaaattggttgcagttatgttttcagaatcaaaaccatctcctttgatgtgaataccataaagttctatatttaaaaggcattgaatgcatcataatggtaaataagaagacccttaaactagcattcatacctcctgcacataaaaccttaaatggataatttttactcacaacaggtttatttttgtggcagagaattttaaagaattgattaaattagctataactatgctcagaagcataatttgaaatagtgttgaatgaatgaggaaagtattttcaagcatagggaaaaccctcttaaaattcccttttgttcattattcagcaaacatttattaagcccccacagtttgcatgacgatgtacaatataatgagattctaacctgacatccttctattctagctctgttaattgaatgagttaatctttttagctgtccattcacagtatgtgatgaaagactatagaaattaaatgaatgagtcaatctgaaaagacacgtggacatgtatatttaagtttccttttgtgtgctaaaaatagtttactacctacataccctttctatttctttaggggcttcagaatttaaaagaacattatcttactgaggcggtgaactatatgcttaatcatgagtttctaaaggtttatagaggtgagagctgtaatttgcaagattctgcagatacgcaaaggaaaaaaacagcacagtaaatttgagcagataaggagaaaggtattttgaggggttgtttctatttcaatagtaactttagacttaaaaatatagaataggttgtacattttagagatggacatcggaactcatctagaccagtggtttccaacattttacattagagtcactggatctttaaaaaaaatagaccctaagttctcatccccagagactggtctagaaagggctgggaggggaggcaggcatacatgtatttgtaaaagttccccagcagccagagctgaaacccacagatcccagctcagccttgacattattggcatgaggtccctgaggctttgaaagaataagtagcttgcctaaggtcaacacagcttataagccttggagcaggcacagaacagaaatatccaaattcccagagcggatctctctttactaaaccaactggcatcatttctacttcacactggttgagatctaattaccaattagtagtagttgggaagtccaagactgcctataacaagtcccctcctcctaatgacctgtatgtgcttccttttcttgctaagcactgagtaagtcttcagatagttatgaggacactgatgacactgtaataattaatatatccagttattccacattttgaaaggcttcacttatttaaaacttttgcatccataaaatattcatatttttaaggcaaagaaaacaggtttaatatttgaatctgagtcccactttaagtcttcattatcgagtttatataactgagcacatggaagtactccgatgttaggctggattttgtttgctgacttccttatatgataatacctttagtttggccccttccaccagattctgaaagttccatgcagatagagcccttgtccaacttcatcaattgtctcccagcacctagtacaatgcttgtcacagaggcaacactcaacaattaatggttgaattaaaaatcctttattatattttgttaagaaatgagacagagtgcctttagccaacttgtgtaggataatcccatataaataaaagtatggaaagatggctttataaagtagtagttttatagttactttttaaagacctttggtctgatttttgtgatataatggtctgattaaaggttacaactaggccgaggcaggaaaatcacgtgagcccaggagttcaagaccagccttagcaacatagtgggaccccgtctctacaaaaagttaaacaaaaaattagctgggcatggtggctcatacctgtagtcccagctactcaggggtctgaggcgggaggatcacttgagcccaggaggttgagactgcagtgagccgtgatcatgccagttcaccccagcctgggcaacagagtgagactgtctcaaaaaataataataataaaggttataattaattttttattggaagcactaggtgcagtcattaataaaacctactaatgtatcaagcaaatgaggtttctgttttcccacctgattttcctagagatcaaatttacatggcgaaggatgacatggaatatttggcaattattcacacttgctatctctccagctcaaattccaagtcattgccaggttgcaatggaatgttcagccatgtttagggctggcttcaccagagatactgtatcacaatgggcaatgtcgataaatcaaaagcctcaaggactgcgttgaactcttcttcattttcaggctgcatgtatctcccacaaagggaggtggcacctgggtactacactaatttagctaaatgagccacatagaagcaaatctgttctgccttgcaggttctgcagcttcccctctgagcacgtatactataatctaatctacctattctgaagtccttgcaccactctttaaactgttacctgctctttcactccccattttgcacatgatcaagtgtaattaactgaaatagttcttctcaccttccttacctctccagggatctgctgttgaacttacaaaactcatttaagtacacaaggtacaaattgtccttgttgtaccatttgagttttacttaggctgtcattcatattataagtccttcatttagtataccttttatatgtggatgaagacactactgacattcagtaagcattaatgaaataaagttaataccaagtttccttgtcttttgggaaacataaccattattattatctggcaagataaagagtttagtgcctctggtgactcagaggagttgcatgttattgtggaaggcagtaatctagttacagaagaagataattcaattgatggctgtttacagttaagtcatttcaatcccagcttttcaaccccaccttttcaaccccaccgtttgaccccctcctttgacccaaacacatacccagatcccatacatttttctctaaggctatttgtcctttacaccaaggaataaatacaatttttcagacttttatctaatttatgtagaaataatcatacaaatatcactgacatcagctaaaatgacacatttaaatatggtagaaatgattcaccagccaaataatcaatgttaaaaatcaacactggaaaaattaaattattaatgaatatttaatctctgctatataaatgagatgaactagagggctggagggggaacaggtatatatataaggggctcaccttagatgtaacatcaacattaaacctaatgttaatgggggaattgcgctgtgaatgaaccacaatactataggttccttagggccaggcacacagcacaggctcagtaaatgttttctgaatgaatgaatgaatgaatgaatggtcctcttcatagacttacagtgtaacactgggatttggagaactgctttaaaatctctattcatatctagggattaataaactagattttgggaaagtcagtactgaatataatgtaggtgtttctgtttgttaattaattaaaatgaccacagtcattattcttacccttaatttctcagtctgaaaagttaatcaactgtatctgttccatgaataattgagttgaacttgaaagagaactcgctattccaaaagcctcccacaccaccagttaactgtgatttatccttttacttctaaagaattttaagcatcttccatctaacttgactgacaaccaatctgtgcttcctctgtctttattccgtcaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgacagaggagaagattgagggaggggggagggagggtcatgggggtgggtttcctggcacctacatgaaaaaaaagacaagttatatgggtgatgaagaaaactgcacaaaattaaggggttgcagaatcacgggagcataataattcccttccataatctttagcattgttctttcagtcagacatgatatgcgcaacattcagacatgatatgcgcatcattcagacatgatatgcggggtcaagttcttaagggctgtttgccttttggtccttttggtttggtttggctttgactaattctggtactgaaaagttagctatacacacacacacacacacacacacacacacacacacacacacacacacacacacacacaaacttcaaaaatgcttaaccatctgaccatagtgactagcctatagtgagtcgaggaccaaactttttcaggaaaatgctgcctcgtttttaaaacaagcctcctaagctatgttctttacaatgtctgtaattagtgtttcacttgagaaagccttttgtgggtcgtaaattatttctacttatccagtaaataacaatgacaaaataaacaccaatgacagaaaaatttctactttactgtccatataggtgtgcattttaatatttttctttccaagataaaattttgaaacttaaattgtgtattgtgtaattaatttgatagtgtaccctcttaataaatgcccactttattttatatccaagttagtgcattatatatatatttttgctttggctatatttacacgtgactttaatcgcccaactgtgactagtcattgcagctactcagctacagtatttatggagatggtgtgtcctgaacagtgtagctcaggtcagcttgaactttccatttctgctctcattgtaggtgtaactactagtcctaatgtcaactgacccatgatttctactgtcagtcaatataagtgaacattgttttaaatatccttaactaacttaaagaattttaaaattgtactgtgattttcataacccgttgcctttttggtaccagagctacgtggtttgaattctggctacatgttttaagtaagaaaaaaaaagacgtatttttgcttactcagataaaagacaacctgtaaaaatataataattaaattttacatgtgctgtacaaggggttattttaaaaagcatttgttcaatttcaataaagctaagtgtgccgc

SEQ ID NO: 4326 - DNA, 200798 bp, human
catttttattattcaggaaaagcagctgggggattcatcagttctgaggctttgtctttctgggttaactgatggtcccaagcctcggtttgacctgaccatgatgcccaggactggcactttttcttttttctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggaatgaaccggcagctagtgaacattttgacagccttgtttgcatttttcttagagacaaaccacttcaggtaggtgaaacgactttgcatgttgatatttaaattgtttaaaagagaatgtgtcatgtaattgtgtatttatctgtgctctggactatattattttaattttatagaggaaagttagatatcttttgttcatttaaaacgcctaataattgtgggagggtggtaaatttttcacaaaagcaagttttatgatgcatagccgcactctatgcaattcaacacacattttcacagccaacgtgatattaaggtagtctgatgagttgcatgctctttacatttctatataagggtaattatttttctgaaagtaatttaaagagattattgggtgcagtgtttttcatataagatgattgtattaatttggcaggagcatgctcattttagataaaatataaaagatccctaattctcagccaacttgggacttctgttatatttcagaaactagaagcatactatgaggactacaattcaggaattttcttgaaatatcaaaaatttctttttactactatattctactattcaatctgtttggaaatggattgcctaccaaaatttagttaatatgacataattgtatttatgtacatatgagaagtggagcatgcataattttaaaaagtgagaaattactattttcatgcttgcattttctacatggtttacgaatagttgccaaatcaattgatacctcaaaatatcaaatcattaccagtaagtgaaatagtcatctaataacagagagtggaagactgagcagagacaggagatgctcttacaacaaagtataggactctaaatttaattttcattaaattttatggcattttttcacagaaccaagataaatggaacacatagtaataatgctatgaatactgggaaaacccactatgttcctttcaggtttacacctcctactatgattaagaaaaaatataggctggtttttattagaatcatcatcatcatcatcatcctcaccaccaccaccatcataatcaaataatacttgattaatcagatgaatctgcatatgagaatgtgagtatttatgcatgctcatatcaatttttaactcctacaaaatatttatatcatctttgcacttattttgaataccccttctttgaaaagctggcaagaatgtggtattttcttagtgatagaattcataagacactatttgttaaactattgaaaacaaagcttataaaatacatactttagggaagaaatttcagttaaccactatgtattgtgaaataattaattttgctacaaaccaaatatgctatgtttaataagctctttattacttttaacaggaaaatgaaaatctgagaaatttttcaccaactttcagtgttttggtgataaaaagtcaaaatgatttagaagtgtgttttcatcaatattttttagagagtcaacaatttaaatgcttatataagcatttaatatataagcatataaataactgataaaataatagaagtcatatacatgctcattgttgacctattttaaaaagaaatgaaatgtccaaatgaaggttctcttttagatatcacattgaaaaatattaatagttgatagttggattagaactagcagatgggaaaaataagcaatgaaataataagtttgttctgcccatcttattatatatttcttataaaaggtagatgacttatatttagggccgaaatgctgaaacaatttttttaagtcagatagaaatgattttaagacaatcacatgaatttaaaaaaatatcatctcatttctctgaatagttttaactatatatacataaaatctacaacctaaaactaaatacattgtctgttctcaaacatcttatggttaaagtttggaaacctgggtgacgcgactcaggatttatagttctcatcatttaaagttaactttagaacatgtacaagttcagaagttggccaaagagtttggatttttctagttttcttcatactaacatatcaaatatctttaccaaaatgtaaagttaaaaatgcagtgagcgttagctctcaagggatgcaaatgaaattgttgctaaaagagttaatgatgtgtttaggacggctttctgcaaagaccatgactccaggtctggaaaacaaccttcacagaccctatctccttcagatttcttggacaagttaatgggaaggacatcaggatatgatgcaagaatcaggccaaattttaaaggtaggttccacttaaacttacgttaagcctttgagaaatcttctagatgtttgaatagttaactgaaaaacattttcagggcttttaattataaaatgaaaatgacaagtatagtgttcattttattttggtattcttttgcgttagttactgatattttcattttacctgtcacttcccacatttgaaaactttccttgtttgtgttctatttcacaaataaaactagtgtcataaattatggccacagtccttattttttcgtaagtgggagtgtggctgaaagtgaatacaagagcaagtgatagacttgacttgcttgaatatctaccaggatgcatgcaagattcagtggttactccaaaatatttggttttgattttaaatacctacatcaaagtagagtttaaatctctataaaatatgccactttacatactttcaggcctctttaatttttagacttcgtaagaagaggttctaattttttgttcctttttgtttaagcattctcattgtttatttgaaattgtttatttgaaatcaacaaagatcacagaattttaaagtgcacatgtcaaagatggtggatactttctttgttcaattagaagcaaaccaatattttttgtttttatttgttgaacattacaaaaatatacttaatagtctgcagaaatgctttttaaatatatttagtttatttttattctgaatcagaaaaaaagaataagaatcaattactaataactgaatcatgttgatgctttaatttttaaatacatagtttaagtgatgttgtctttttcttgtaatgaaatttaacataatgcattgtgaagtgtttataacattttataaaaggagaaacctataatgttctggatattatgtagcaattcatgcattgcttacttttgtttattagcaatttaatggcacacttttcttcagtgttgatttttattattggcaaatataagcatgaaaactaaattttaaattcatttcttctttaaatgttacacctctgaatatacccaggtatgggcatattttataaagaaatatgtcagaattttggtgaaatagtattttttaagtatctccaagagagataactgaactacattcagagataaatttttctgaaaaaaaaaaaaagatggtcatgttcatcccatttcttaattttgtggtcattgctttggaagtcaatatttgaaataaaatcttgtgagtaacaaactgagaaccagctttcaatgggattgctcattcatatatttatccactaagtcattgaacaacttttgagtctggactatctgcaaaatactaactgttgggtgctttgtaaaattgggagatgaaacagtttaggtgcttctatcaaaaattttagtggagggaggagatgttacatgaatacttttactattagatggaaataggaaagtaccattaggaaatacaggtaaatcactacaggattccaagaaatggaaagataatttcctattaagatattaatggaaagctttatagagaaggtccagagatggaaaattgtttcaagtttacaagcatcttctttcatagctgttattcatttctttctagaaatactttttcaaaagggcaggaaagtacaaagagtaataaaacacacccatgttgacattgctactttaagtgaccacacaagaatgagccatcatttccacatccaattttttcctggttcttccggggatatcacctttgggaaatgatatttatcatggttccaaaggataaataaatgaggagaatgtcaggttcagcaaagtgtggccatgtttttttttttttttgatctatctactactttaaagtctaagtacaggatattttaatgacttataaaaaagaaatggggtggatatcacagaagactctaacattagtgggattcattgagttttatctccctctccctttaactctccaattcaatgaacactgctaccttttcataaaatttatttacatagaccatttatatcagatcaattatctgacatctcccaaagttctcttcatttgggggagcttgattattcctggatttaaaacactccccattattttagactacaataattttttcttgatgttcccatggaattttatatgtctaatatgatccttctacatatgtatattttattgatccattctcacaccacatctgagagggcagggaagtaccttattttatatatacatacatacataaaatattggtagtgtagggaaaataagtgatccttttctccaggataaggaaattagaaccaagacagagaggaaaaggtagatcaattaatgaagattagtgcttccaactggttgttgtagtagaatgtgagggtggtaacttttgagagaccagccagtagtcatagtggcaagcaaagatgatcttagctgaggtgaagagaaggaaagaaaagacagagaaaatagggaacttgtaacaaggaggaggcttagataaacactataatacttaccatagttgattagcaatgtaccaatgaggaatttaatatagtcagtagaaatgaagggagattaggaaatgtgaatgcatacagaatagtaacggtctccctgtaaatgtgaaaaagcaattttctgtgataactataaacatgatagtgatgatgatgttgacaattaaaataacggtgactgttaagaagatagaagggcaaaatttgaccaccagaataaaatcaagagccaaatatgggccactgaggtaaacagaatggttattctagaattcttattaaatattagcatatttctctgttttccttgctgccctgcattggcaagggaaaaagaagtgcataagtataatttttcttattggaaagaatttttcctgtatactttcaagtcagtaaaatattgcatgtctattccatattcctgatgggctttgaaagatgtcataatgggcatatatataagaaggaaaaatggatgtaagctagaaaagataaccaccagaaatgattcagacttagactctgtaattgagagacattcttagaaactacagggaaaaaatagcttttctgatgtgttgaagcacaagtgtataaacaaagtcatgagtcagagttgtcaattgaattttatctataagatccatagagacgtgtttcagatcttgtcaaaacatacatttaatgaaaatcctcaattcagataaaaacacaagctatatccattcacaattacctggttctgaaaccatggtaaatgttgattctatatcaagagatgaacctctttccccacttaggtgatttgtctcattttcagttgatttatcatggtgttattccatcatcctatcagatattcttctgtcagtattattgtatcttgaaaatgcactttaaacattaggcttttaatgaaatgttcaaatctgggcaaaatgcattagttccatttctttctttttgaaacaaagcctttatctattttaatgaaattttctttgaaaataaaattaacttagcgttacatcctagttttcatcccaatgtgaataaatacatttcactaaaacattctttttgggatagaatctagagtagataatgccaggagataattattcattccacttctttgtgcctgccatgcacactatttttttcccacatctagagacctaagttagaaagtgtaatgtgtgacattaaaacctacatttgcctgaaatatgtttttctgcaatttccaaagagctagcagttcaagaggtgtttcaagtatcatagatccacttccatgaaaccagaggttttcagattttgcccctggaaaatgatcatgtctgtagtcaagtggagctaaagttcaaatgttgtgaataccaacccctgtagaaggtgcttgagcacaagcgtccaccagggacacttggaaagggtgcttctttaagttagtgacaatgcaaccccagcatcgccatttctttgatcagcctggttggcatcagacattactatggaacctgagaaagaagaccaaaatgcttgcaagtatcagaagcattgtgcctgagtgcagaaagtagcagaagcctacaggcacctgaaaaagtaacttcatggccatgctgacattgtggttttattaggaaatacagacagtaattggttcaattataaatcaccttggaagtgattatggaattatctggattatctgcttgacagttaccttcctcacagaagaattcttattctcccttaattctaggtctcccttaattaatcaagaggcctgaggtaaatcactctttaatggctgagatgaaaaaaagccctaatggcactaagcccacattgaaaaatatgagagtcattattaaaaagtatacagaaaaaaagagttttcaggtgtctacgaatgtcaagtatgagtcagagttgtcaattataaaacttttaaaatgataagaatacagcatatgattttttgagacattatcttttaattatgaaagcagtcattttaaaatggcctagaactaagcccaattccaagacagttgacactcccattagggcaattactcttggctaaatacataggctatagttatcagtgggaaccattcattgaagaaattaaaggacaactaagggagaatagaaagaaggaaaggaagaatagatttattttaggacaaattattataaaattaccttgcaaagtacatatagcatgggggactatgtatatattagtatgtctatatatatgcacaaatgttgtgtttgtatatgcaatagaatgtccctaaaagatacacaaaagagtggaaatatcaggtgcttctgagaaaggtgactggatgccagggagatgggtaggaagaaaagttacttttctctgcatgcttcttgaatgctcatcattatatgtatttccaattcaaaagggtaattaattgttaagcacttctagagaggtaaagctcaaggaagcgcctctcttgggtagtatggtccatggtggcagattagagtcagtgtcactcttactttaagtgcagtaacatgcacgtggcctgatttcaatagtacccaagcccttgaaagaaatcccttgtccaataactattctaacctagcttgctattataatggctaaaattacagcactgttgcttctgttcttggattaaagattttatttcatattaaaactacttgatggaaatgacagtaagcccaattagtattttactccataatttgaatgagagtatttggttgtagtctggcactggggaagaatattgatggtgcaaggcattataaaacaaggcattataaaacattatcaataaggaaataaaatattgtttccttattgaaaggaaaggctgggagtaacaaagggaaacatatatgatagtttcattcagagacaatattgatgaagatttttgaacatcaaaaatcactggctgtgtcacaatttattatacaaatgtgttggttggtgttcatacagcttttgtgtgctgtatgaacaccaaacaacacatttgtatatactaggctcctactatggacccacaaggtttttcagggatttgaagtggcatcaagagggcatctacagcattctaatgcaccctggtaaagcatattgcaataagtttgtcagcatgtctttcattccatggtgacagggtagtatagtggaaagagccctgaacttggatctagaagacctaggttcaagttctggttcagccatttttgagaaaagatgtcttcacctatctgtgcctcaggttttcttctgcctttacctacctcacttgggttgtactgaggatcaaatgatatcatgagcatgaattatttgttttcaactgttactattatacagataatttgagttattattgcaattccaccatttttctttcatagccaacacttactgtgtattgtgaaaacagctgcttgattttctaaatggaaagaaacaagttagagaaattcgggcatcttagattcctaccagagtaaccataatgtagaggtcataagcctcagttggttttccttatattagttcagtggggaaatttccaacctgaaacggctatttcatattcctaaatataaaacaatgagggagccatttgtgggaaggaattatctttacccattcaaatcccatctctgattattttcttggactcattttaaaaaataaaccaaataagagaaatagaacaaatttaacttagtcctataaaggaggaccttaaatttaactgaagataatatgactgccatttctgatgtattttcttgtccagttactatagttgcaaggttcactgcacaatagtactgagatgatttcctattttagaattagtatttaaaagagagcatttggtctcacaacatggcaggttaagcgtaccagaaatggaagcccataatttagtctttgagaaagtactgcattgctccttggttgattctgggcgaccccatatccttaattttcattattgaatgaacttaaatattttatccttagtttatagaccttgctggtcctccacatcctgaaggataattcagtcaattttgctgataatctgagacttaaatggcatcaatattcaggtctcttggtgctcaatgaatggacagtataatgtgttcagttggggcagttaggtttagagtgagaaaaaaaataagtcattagtttgttcttgatggtgttggatatttttcttggtgtgttgctcagacactgtggaacagggtcttaaaaatgtaactatgtttgacgaagcctcaataacaaggtctttggaagcattctgggctccctttggaattaacgcctaggatgctgtcctgactgttgtatgaagcgtttgctcattgatttctttcctgagagagctactctgcacacttatgactgactacagacactttcagccatgcagaagccactaaagggagcatatgagcaaaaggcataggcctcaaatggatattctaatgtgtgcagtacatgtaagaacaaagtcaccaggttactcacttggagtctagtttggccagccaaccaaagtggttatgaggtaaatacaagagagaagctggaccctttctttgactcatgctatggtttgtgtatccaccattccattattaatatgatacaccaaatagtggctctgtatactcatccaaagggcaaaataaattctggattcagtaaaagtatgaaaagtccataggcaattatcatttgagaaaaggcatcttcacctatctgtgaagtatatatatgactggataagtcttgttttctattttttctttttttctgatgatggtggaacatattttcttgtggggaagaaaagccacacttgcctatgcactgtcaaagcaatagaataaatttgtggcaagggagcataaatgtaggcacaaagaattacatgtaatggttttacatctttatagttgagtctaaaaacacagttaatttgttaattattttaataaataattagtgactagtcaccatgtgccaggtaccattgttaggtgctaagtatagagtggtaaatagaaatttaagcttttaaatgtcagttcttactattactatctcacttaaataaaaactggaatataatttgtaggttgaatgcttattatccaggatatttgcaggaaagagaccacacatttcaatggtgtgagagaaaaaaacaacccttaaagggagagtgtagtattctgggactatcaacagaactgaagaagcaagggagggagtgattaccagaacctggtgaaggcagctatacagaagggtcacctaatgaaacctgtggaggaatgtagtcaatttgtgctatcctagcaggaagtaagcctgggaataaatatccagaccttgccctcctcctgttttccattctcctgtggaagcctttcattagccagattcaactaacagtcagagagcaagggagcccattgatacaaaccctgaaggacagtttcctagggtacagagaatagaagagaagagaggggttggggtggggaaatggaagacaaccagcacaaatgtcaacttaagagcaaactcaccccttaccattcaggtggttgagcagacatctccaacactgatgacaaatttagtaagccttctttgatcagtctggagaccatttggatatattatcccaatagataagtgctatccccaaaagcagagaagagagagaaatatagtgtaatgtgattgttctgtctcctaaatagaaaacaggaagaggtgcaataaatggattggagtatacgtgtgtgcgagagaaagagaaagaaggacggaactggggagggtgcaaggtggggaggaaagggagggggcactagaaataaagggagagagacaggaagagacagaggggagagaaagagagaaaggaaaaagagagcaagggatagagagagacgcggagggagaaaaaaaaagagagatcttcctgtggagcttacgaaaataattaatacagtttcctttctgtctgatttaacatatttgctaatattaatgtgcttgtccctacagtaattccctccaggctccccatgctgggatgtgttgtgggtttggatttgagcagaagatttaatgccaagtctctctggggaagcatttttgagataaattctttcccttcatgctcttctgctctgcatagaccttgagaaagggtgttagaagaaaagattgggtaaggggttaaaaaggcatgaagaccaggggcagagtagtgtgcatttccaggaaatggagagttctgggaacagttgctcatttcccactccttggctggtttgattatcacacttgaaatacagctactcatcttggcaattctcctacgttaggaaaagcccaggactactttaccacacaatttttacttcatttttaaaccaaacatacacagaaggtaatacaatgtatcttcttctaatttatttgcatttaaatacttcaagatgttgatttctaataaccacttcatgaccaacaagacagtcaagatttcttttatcaggctttctattagaaaaagcattttgcccatttcccaccacccaaataaatgtattcagaaaacaagggatccgtttatttatatttgaatctcagagtctctgaaaagtgaatgaggcacacatttggcaaaccaaacttaagttagattatgtgattcaggaaaatttataaatataatgtacggtgctgacaatggatttctcatattctactttttcctttgaattaactctggtttattacataagtttgtatatagtatgccaaatcaaaggatttaggatttaatactaaaacaaattaacaaccaaccagatgtgtttctcaagccatgtttttcagaagacctgattcaaagccacctgagagtctggttaaaaaggcaaatcctgggccccacacctctccatctacagaatatatggatgatgggatcttggagtattcattttgtcaacttaaatctataaatttggaaaaggaaaggagactttatttcttgtaaagggttatagtctgcaaagtgaccatcctgcagcctgggaagcatgtctttggacaagaccagagacaggcacttcaaaggaggaacggttggtataggagctttatgttgaacaggttggctaaacatacatattcaacaggttatagaaggctacgaatattcacaaaggtggttctgatgcatgtgtataaagcaaacatgcatgtaacatacaacccatgttcactttgaggtggagacttaacatttaaatgtcttacaattagggcctgtatgtcaaaaggcctttttaggacacagaggcatgcaagagtgatctctttaaaccagccagaatcatcagtccatggttggtggtcttcttattaggagaaagttactgacatcagtctcttgtccggtcaaagctgtagttatggttgatggaacaggggatcagttagcatctgtgaactggatgagttgtaattgttttaatattgcttatcttgagaccagtccttatttaactgctagagaagaaaaaaaaaaaaccctgtggcagttagaacatagtttattctttaagtgtaggggtgcatgatttaccccttgcctagcatggtttcaggtcctgtatataatttcatatctcattgccacaaagagtctgttctgtcagtcttatgatctctactttaacattagtgctggtcagttgttgtgtctaaacgccaaaagagaggaggtataatgagttgtgtctaacctcctgtcccattgtggctgggaactcaattttaagatttttctggagtccccttggctacaagagggcccattcagtcagtaggggcttaggattttaagtttacaactttaacaaagtcattactccctacaggttaagacctacaggactagaataagacatttttgcccttatatcagaaggatgataccttctttatagtatttttcccaagatcctatgtgcctatattgttttacgaaatgaagggggaaaatcccacaagagaaaaaaatatctaaatcgagactcatgaggcctgattttaactccagttttgacaattatgacctggagcatgccacttaacctctttgggagtcactcttgtcatctgcaaaaaaaaaaaaaaaaaaaaaaaaaggacttagaacaagatgtctctctacttcacttctaactttgatggtccctggttctaatagtctaaattaatatctttgggtatatccttttgtaaattgttgactcacccagagaacttggatgcacccaatcttcctagataatgtttcctttcttggaaattattaattctgtccagcatttttaacagttgtctctaccttatttcaagtcccagtatttcattcagaattgttattgcagggaagaccctggaaacttatgaggagattactgaagaaataagctattacaatttttgccttgctcttggtttggaggtagcaaattcatgtacaaaggctgcttctgggaaatgtagctaccaagtttctttaattcagcatctggccaaagatgtttcccaaaactgtagtccatgaaatgttctctaagtttttaaatgtaaaataagtataggaaattctgcaaaacatcctctgagagagacttaatatccattagcatattaaaaagttgtgagaaaatatgtagtaaaaataaatacacaaataaatattttaaaaacttttttttacacaggggtttgcttgatattcacttgatcacagattccttatcatgagtaacatcctggagaaccagtgttttatggaatattttggaaaatgtagttttggtaaaatccagaaacctaaacaaattttgccatgaaaatagatgatggggaacttaaacatacataaaatataataatttgccagaaagagaatattcataagagtgagaagggcccagcattcagtaaatgaggctttcattttgattcatggtcaacattagcattatgatgccacaagagaattactctacaagttagaatattattgcagtctatttttctcctgcttcatctacatgaataaataaacaaacagtggcattttgaaaagcatagagaaaagaaattagtcaatacatcaaaatacttggatctaataatcacctactgttttagtctttatgatttacaaaagctgacaaatatatacatttaaacaagtgacctttaaccttgaattagagatatttcttcagcagtatatgacaaagtttcatacctgtatgaagaattttcttttggattgctatcttctttctcaggcagctttcaaaaaatgggtaaatcttgtagttgtgcaatttccactcatttgctgagaatagtttttccatcacttccttgcaatgaaattttaaaaatttaaatctataccaaaaatctcatttaaaattgaaattatgcaatatttatcttaacttgtgcagatttaagattaacttcctatttattagtattaaatcactctaagtttctctgtttaaaaatgataatgtttcatatacttcaatatataaattccaaggaaaaactattgaaaattgtttgcaatgaagatggatgcagaaaatgaaatgtctttgaaatatcactaaatgtcttggggaaaggatgattatatatagatattcttaaatataatatatacttttaaattactagttcctcctccatgctttctctgagagtgtttgtcaagtaagcaagcatgattttttttcttccttcttctcaatccaagctcttaggaagagataaataacggagtaggggtagggaaatagtgatgccacctcagacttaatcaatggctcctgattcatgtcatttattttacacactaggtgaaaacacattggtgatggagcccctacacattctatatcaaactaatcctttatttgagacaaagtatccacagtgatgacattagcattgctagtattccactgtacagcccacagataatgggataccaattgtcttagtgcattttgtgttgctatgacagaataccatagactgggtaattttgaagattcgagatttatttcttacagttctggaggcttgggagtccaaggctgaggagtctgcatctggcgagggtcttcttgctgcatcatcccacggtagaaagcagaagggcaagagggcataaggaagaaggggaaggggactgaattcatccttttatcaggaagccattccagtgagaactaacccactcctatgacaatgacattaatccattcatgagggcacagccctcatgacctaatcatctcttagaggcatcacctctcaacattattgaattggggattaaattttcaacacatgagctttgggggacacattaaaaccacagcactgattaagtttgtcttttgattgaggttggcagtcttagatacactgcatcttgaagaagaactgaataaaggttaactataaagaagttatttgggcatgcacacatttgcttactttgagttcaaattttgttttatataatctgagtgcctgacttagatcctttgctatcatttgcttccagggtcacagcttctccatttccaagggacagacggtgtcattagatattggggtatgagaaggtggctttgctgaattattagttatagatgtcaaggaatatgaacaagaggataagattttctttggaatcctgagatttgctttccaaaggaagtatatacagtgtgttcccaaaatataaaaatttaagacatcatccctgtttgaaaggaaatgttacatatgcccagggtcatgccttgtgaataggaagccctggcactgaaaatttcacttttttcagaggcctttttaaatagatgaatgccaggctacctgttctctccaaaatctaaggtcacagtttgttaataaggttgccatactattcagtatttattttatctgaaatattaccatttcatttcctagaatccgtgcccactctgtaaccagtggcatgcttaacctgatctttatcaaactaatcctatattatcagatgtatttctctagctctcccaacataaaaggaattatccacagtctggaatatgtgttccttttatttcccccaagtttctgactcacgtttgtttatcatgcacatatgcctcatttaagtgcatcctttaatcaaatattctgagcaaatattcccacttaaaacccagcaggcggcttcctgttccatagatctcctgaatgccaacaaagtttataacatgcagggctttccgcagagtgtatgaatttgtgacttggggcaaatatcctaaaccctattaaaaaaaagatttccttggcaaaagaatacacttatctcaaggagaaaactccacgattctacttgtcaaccagctctgcaaataggataattacacacgtgggatttttttttttttctgcctacagttgaaactgggtttgcaaatggctcctgggtaaaaagtattctatagcacctccatctcccagaatgagttcatttaagaggtgccaatgtatagttaacagcactgtagtttggctgaaggaatctttgtgatgctcagtaagagtggattgacatgtgaagctttcatgattgagttattccttcatcatggggcctctctcattcccccacatattgaaaagaatataattattacataaaaatttggagccatgtgctaacaatatgtgccataataaaccatgcatacataaagtctcaaataagcaggtaccctctcagtgtctaacttttcatataaatgccagaataaattatctgcttcagtgatagagcaaagcacttgagggtattaacaaaaagtatccatcagtgacatcatgtaatatgctatatacatcacagaatgacacctttaaaaaatattattgactttagatgggtgatgtggcaggtgcaaagaaggcaaagaaataaagatgacataataaatagatcctaaaggaaagctaagatcaaaaataaactcctgtactttttttagaaaatccatagtgcagctgctctggggtgcctgattgcctatatctttatctgaatgcacagaaaaaggaagctgagctgtcacccaagggagtgcagagctcaaaatactagtatccttgatattctaggtctctcatgacccttgaaactctcctaggccttctcatcatttttggataaagtgcttgcacttgtacatgtctcacaaagatctctgtgtttaggttctttactacatctgtctgaggttgagtttccaagaagcagaccctgtgcaaaagagatttattaagaataagcaatcaggggagacatataagagagtgaggaaatgagacaaagaagtgggaaagccaagcatctatattgtcaatttcaacatcttcattccacatctcaagccacaccttcccactctatgttccagcctcgatgccccatttgccattcctcaaaccttttatttctggtgcttggcacttgcatttctctctaccatccctgcctttccaacagcttactctctactctgacttcaggttaatgtcatttcctctagaaagcctctcttaaactacaaatcccaacctttcctacgtgctcagtctagagtctatcttgtgattagttgcttctctatttctttccatcctagactagttcaagaaggttaggattgagcttatctcattctacattgtatctccaacacgtgacagtaggtaggttgtcaatagacatttatcaagtaaatttaaaaattgataacactaatccttaatctcagaatctgtaccaatgcaaacttgaatattaagaactgaactaagttattattatctgctaattattgtgattcacttaaaattcatgaagtccctccatatgtatcatctcatttgactcctcactgcattttcttgaatagaaaacagccagaattttatcattcttgttatttaggggaagaaaaagttatcctgctgccaaataggacttggacaaacactacctttccttatatataacctaggatggaggggagtataagtcattagaaaatgacaacagggacactcattccccatctgcaatactttattgaatatatttgtaacacagctgctgccctttctattacaggttgaattgaatttatctttgaagccccaggtttttgtgcactttctgtttatctaggagcttaataaatatttaatgttgagtaagtggatttatttacatgtagacatgtatcacgcatttattatgcataggacactgcgctaagtacaaagtagagggtgattcaaaggagaattgttaacttatcagcattctaacctgcaactttactatcccaccttcttctactttaccactatttcagtaccaatatcccatttataaaaagttttcttttccatgcctaataccgaacatggatggatagtgacatctaacttatccaaatagaatccctggcctaaggcactctcctactcagtgtctgcagtgttcagtaaataaaaccaaaggcgcataaatcatacatgttgataatattggatatacctgaattgccagggagttctgactgctaaagtaatttcaggttcacttcatggttatggcccatacttccttccaaccagtgagtctgtggttgggcatcttctgaaattctcctcttgagcttcatcttccagctttacaaaaaaattgagtagttctcaagtacaggattctcccagattatgaggcagtgaaccaaaaatctttacaaaagactaggggggctaactaaggtatccactaatagtgatgacctttatttttctctagagggcccgtggtacaggagaactcagttcactgaggaggaaaaagaagtagctctaggctttataaaagaggaggtacttgaatttggtattgagagcaaataggtgttcaatgaatgaaaaggggaatttcagatagagaactgtccatgtctggaaagaacattgctagtttgggggataataaaagatgagtatctctagaggaagtgaaagggataaatcatagaagataagcctacagaataaagttagttaaggccagaatgtaaagaagattattgaagcatagatttaaccacaggtaacaggaaggcaatcaaggtttttaagcagaagaggagcataattacataagatttctaagaagataactcaagatacctttcaaaggatatacgaaaaaggtaagggaccagggttccaggacaatcatccacaaaagagagatgatgaaggtttgggcttagggagtggcaatgggttagaaaacgggcaagattcacaagataaacttaaggtaaaattgcatcagacaagatgtagcgggtacaatagaaagagtaatgtttgactcaaggttccattttgagcaactgagcagacagtgattttgtttattcatgtcagggacacacgaggatatctaatctacagttgaaaattttaatctggagccaagaacagataccagagctataaatgtaggaatagtagtcatcatataatgacagtattgctaagatcacccagtgagaatgtgtagaataaatatagaagatgaataagaataggatttccatgagcatgaacattgaaagaataagaggaagagaaggactcaacaagggatacagagaaagagtggttagaaaatctggaggagaaccagaaagagatgcagtcattgatattaagggaagagggagttttgcagatgaggaaagcaaccacgacaagtgcagcaggaatgttgagtagaaagaacaagagaggtcattggatttgaccactgggacatttttgaccttagcaaggccaatttccctagagtggtgatacaaaagcccatactgagttggtagagtaaatgagatttgagaaagtggggaaaagtaagtctgtagatttatcgtttaaaagattggtgccaaagagaaagagagggattgaatactagattacagaatttgagggaaaggaggtttttttttttttaaaattaagatgagaagggtacatttgtagaataaaggaaagggagactgaaagtacgagtgagatagaggataattgatggaggagagttctggaaggagcaggaggaatcaatctcataaggaagatgaagagattacctttgcactgaaggaggaataccatttccttactctgataataagttttacaggtggaggggaaggtagtcagataagttcacatccaatgatctgtattttcttggtgaagtagtattctgtcatctgccacagaagggctgctgccacaagcatgggctggtcctgggcacagtcaccatgaagctaaaaaagagcatcaggcccttgatgctttgatacctgccatctttgccgccaggacagaccacaaagattcaaaaagcatttaaaaattttaaacacatcatgaaaacagacttttctaaaaaaaatttatacttctcagttggcttattgagtaggaagatattttatgtatttcaaacatatgtcccagaagatcaagccagaaggtattatgcacaattctcagacaaaagatgaacagaagtaaagggacttagtgtccaagttatccatcagctcacttcttagccagtgctttattcctcactgcacccatgcgtatatttcacaccattttcattgtaggaactcagaaattgttaataataacattgttggtttatattaatgagtccttactatgtgtcaagcatttaagcactttgcatattaactcatttaatccttccaataaccttacagagaaggttattatcatccctatttcacagattacaaaatagaacagaaattgtatttggttgcttatggtcatacagctagtaagagtgcagaaatggcttttgattccaggcagtctagcatgagtctgccctcagtgctattagtgggatagtaaaaaccttaaagatttgtgttgttatacaccaagcctataatcatttcttaattacagccatgctaggggcttgtgaatctggaggcatgcctaaggatgtgtttattatttaactttacatcctcagatttgagcacattaataatcctccataaatatttgatgaataatcaaatgaatgagcaaagatgatttctctccaatcacccaacagctttctgcttgggatgtattggaactagattgtagatcgtggggtggaggtatggtaaagaacagttggtggctaaggaaaacagaagagatacagggactacttcctccatgggctacacattacatgactttgtctctgactaacggcattttgtaaacttttttttacatctttgagtgcaaatttgtgatgtacttaaacatatttcaagaaaatgctatgatataccaaaaacatgccctttcatatgagattttatctagtcctatagtttgcttctaaatagagtttttctccggaccctaggaatgttttcatttaacaatctcaaatcatttgggcatagtgagagaaaactgtaagtctgagacatgaagtctataatttattctcttattactttccaacacacatgaagagcccaagcttgctcagggaataggaaagggaaaagtctgggggctgcttgctgggatgatgttccttcagaactaaggagaatgctctctgaaataatttacttgttcttttcttaagcagaggaagtacttgctgcttatgtacaaattcaagttaactttgtagtaaggtacaaattaattacaaagtatttatgagggacatttatgatgtgcctaacgtatagcaactttgagaacttacagaagcagtgacaggcaacttttgtcctttagcaatgcatcatcttcctcagcaaatgaaataacagacataaaacaagtctgagcaacagaagccaactcctctctatataattgtacagctatatatggaattatgtcatggagattagaagttctgaataaggggaattgataatggccgaagtgtaaggaagaggtggaaaatgacgtgaagacttggagtatgggtggggtatgcaaaggcaatgtgttcctcatgatgtgcccaacaacatgttaagtgtgtcatatgcatgctctcatttgttctctacaaaattgataagtactactgttaacgatatcctttttccaaatccagaagctaatgttcagaatccttagagctggcaagctgtgagagacagagaagctggtcaaatctaggcagtctggtgctgaggcccacatactcagcaactgtactacaccttatggtggcctaggcaggctaatcgtgtctgcgtttgcaaatatacaggtcatatgactggagatgaatgttttgagaggtatgcatcaacccaagccaataccccaaaagactcttagtaggattcttcccctttgacctggcagaccttctacctccattgcctgagggtaggagaatgaggccatttctcatcagagggcttgcttttctatagtactgctctattgtgtctggtacaacacacaaaattagagactctttaaagcctcaacaaaccttgtctctagcatgaaaagatcatgggtaaaaaccctattctgtttcattagcaactctcatgtcctcaaattataaccctctcaaggtcccaaggtgatgtcactgtctattatcatgagcacacaggcaatgatggtgtctagtgggagaatgacctcctcaatttcaagtgtgaactcaactatgatgaatgagaggaggccgtgtggcttcttcaatcttggagggacaaccgtattcggcttattatcagagattgtctcacattgagatggaggtagaaatatgtaatatcaaaatccggacatagaacagtttctccatcacctcaagactgtctaacaatacaaaatgtggtggccttcaaatcagagaaaggatatgcaataaagagcaattatgcagattcagccttcaattgctgattatactttggctagtgatatatactcactatgaaatagagccatatcttccccctcctctgcacatgaagagatacatcaatcccttgcaaagaacctctgctctcctttccctttctctttttctcatgcacaatttgttgcctcctctgccatgttcccttaaacactattgttattatcacatgacattgtaattagtctaatccatgtctttctgccttgatagatgatggcttttttttaatgcaaagattcagtacattttggtattcccaggagcttacaaggcatcagtgtctgtgtctttcccatatccccggtcccttaccacatcaacctgacttctacatggtagcagctgcatttcttcgttgagggcattctctgatccaagccattttgcccacccttgtggcagaccagaattaaaggtgaattagtgtctcctgagagtactctcatccaatgactggtggaaatcaatttaacatacaccagctccttctccccttgggcagaatagctctgaggagtccttctatactggcttccagagttgctcatgggacaaggcttcatttgccatcagaaaataatggacttattaacacaccttttattgtttgcctaacctgtcttacttcccgacgtctcatccagcatattacttacatccctaacaaatgactttcacctaaatccttgactcgaggagaacacaaactacgtaagcacccaatatacagaaggacttcaataaatgtccttttaataaaattgaattacaaagatgcatagtgtagcatgagataaaacgtggaagtgctatgctacgtaagtgctgggagcctatcagtcaaatttgagcacttgtaaacacaacaagcaccatgatttcaggatttccctttgcagtgggaaggcggctgtcctagttgttagtagagaagagtacattatcggaagctctggcttctatttttagacctcttgctgacatagaaaacctgtttcctaacagtactgtagtgaccttcccaccctcagagaaatggtgcagaatgcctaaggaagaaacaagtccccatttgtggaagccacagaggaacagaggagggaaatgagagcttaggtactattcgttggcagacatggtgctttaagatctcttttgacagctaaatagaaagtgctgggttgcctggcagtgcagtggccttgaacaggatttaggtctccaagctgctaaagcttggctctgagcccaagatgtccaaagagcaataatctctttcttttttaaaaacctcacatgaaaaaataattttccaaaataaggtaaaatcatgactcttacacagttatataattaatacatgttaaagattttatttaactcattagtcaatgagggaaccaggcagatggtataatcagttcaaaaaaaacctcaaagaacagacacatctatagataaaaatattgaaataaatgtgcaaatggaggcaaaattagcctcttccacagtgggggaaggaagtcacttgaacctctacaggacagaatttccatacctataagcaagggatattttgtattactattagttatataatttgcagagttttaaaatagctcccatagaatcagagtctgataacactgaaaggtatgctgtatggacaatgtatagttttttactgaagcataatttttccctacactcacgatcgtttgatttaataatgcaatatttctccaataagggggaattagactttttactagagcttacttatacttttaaaatccagctcattttcttaacactgtgtatagggatgagagtaatcaaatgcagggcagagatactatgcttgagaaaagtacatctgattgttaagaaaaagatctcaaggtttaggaggaagatccttccttgataggggaaggaaagagatggtaacagaaaagaagtagctgatatttcacatttacattatctcattcagttctcccaatgaacttgagagttaggtgaagatatttctccttttataagatgaggaaatgggagcccagagtaattaagtagcctacatagggtcatacaaatagtatatagtagagccaggatttaaacccagtctttttagccctgaagtttatgattttcttccattatgccatactgtactggtaaaggatgatgttaggatggagggcaacggttaagactttcctgatccccacctcaaacagggcagttcagcagtggtatcgaagaagcatgtagcagtgtttctcattggtgattgtcatatttttgtcataattttctcattctgttgagtgctctggagagataaacagaattggcttctgatctcataggtttagcttaaacatttgatttaaatgaattactttttgaatgaattactttttgaagctgaagaaatgaaggccgattaactgggttaaaatgccttaaaagttgttctgaatcagatttcctgggatgccactaaaagttccttacataaaaatggcttatattcttattaatagcatttattgaacatttactgaatgcctactatgtgctcagtactatattaagtgccaagggaacactacagtgaatcgggtaaaatccatgccctgtccagagcaaactagaaaagattagacacatataaaagtcgaccataatacaataagataagggttatagggttataggaatgctaggaaagatgatattcatatagggagaatcatgcaaaatttcatcaattaggtatcatttggctttggaggataagtttttaacttggaaacaaatgtgtatatgtgtgtgtatcctatcagccaattccattatcataactccaaacatagtatagtttcttcttaaaaattattaatgcaaaaaattctatttccaatttgtcagggcctaacaagttggtgaacttgttattcatagtagaggattcaattaacatgagagaaagtcatctttaattctatttttgttacttcctaaaaggaaaggatatgtcatttaggttcatgaaaaattctcaggtctttatatttcaaaactaattccaaatggcattcaaaatcattttcttctaaggctaaatggctctttatttattattcaccccaatcccaaatagcaagaatcccatgttttccagcaattctttgatgacattttattatagcataaatagaaatatatgtaaattattcttacaaattgttctcaacctgaaggttccatttagcctctgagatctttaaaataggaaatgaagcttgttaccacaagcaaagtgttctgaatctcccaaaacataaactgttcactttaaggtcactatgatcccgcaatgaacaaaaaagcagcagttcacttgtattagaaaaggcttagtaaaaatgccctctctgtgatgcttggttgggcagacacgttttgtttcatctgacatttcttgcagagtgactcaagagctattcagcaaattgtttctgacttgtccttaatgcctgattttcttttatttagcaccacaatttaccatctacttgtaggtcataagtagtagaagaccaagtatatactagacacataatgggtactcaataaatatttgttgatttaataagcgactgaggatttgtaacatgaaaatacacagaattcagcaaatgtctgcaaattcagttttctgattaacaaactcaacaaacgagtataagttctattatactgccatgtcttcacctaaagtatttctttttttttttttttttttttttttttttttgagacggagtctcgctctgtcgcccaggctggagtgcagtggcgcgatctcggctcactgtaagctccgcctcctgggttcacgccattctcctgcctcagcctcccgagtagctgggactacaggcgcccaccaccacgcccggctaattttttgtatttttagtagagatggggtttcaccatgttagccagggtggtcttgatctcctgacctcgtgatccgcccgcctcggcctcccaaagtgctgggattacaggcataagccactgtgcccggcccacctaaagtatttctaaatattttttaaaatccacactctttgctgaaacatgtgagactttttcataagaaagccatatgaccaagaaatattttaatatgatactagcatttgtttggtgaagcagaagagtaaactgaagctcatttcattattacataaaatgtgatctttgttaaataaacttcctactcatcctgcaattttaccttctttttataatttagtggttatcaactggggagattttgtctcacagaggacatttggcaatgtttagacacatttctgattgtcacaacagggggtgtgggagaagtggtgctactggcatctagtgggtagaggagggggatgctgctacacaccctgcaacgcacagaacaactcctaacaaaagagaatgatttagtccaaaatgccaatagtcccaaggtagagaaagcctattttaaaaaaagaagctggctgcaataatctcaaattcatgatggctacatgggttttccagacatgaagaatgtttatgcataattcccagaaacaagaaaggtataaaaggtggttgggtcctgccaagaagtcctgtaaagctaagaagaaaaaacaaaacaaaacaaagtttacagagaaaagagaatggaaataggataagatgggcattatttcagtaaagattggcatagaggatattggaagatctaagttgtagtctccaagatttcagtttatattaaaatgggtttgacaatgtatttcctacacaggcatatttttacaatccaatgaacgcacaataatgatagtaatactactaccattactataaataacagtaactacgatctattaaggaaccattacatgccttccatacattattactaattatcacaattatcatcaaagtaagcatcattatttctattctgcagaattaacaggctcagagaatttttggcagctgtttaaagttgacaggtggtaataatcagagttagtgttaaagataaaacagactagtagccaccatacttcaaatatatctttaagtagtatgacccaaattccaggttttctcaggactgccctggtttctgcctgattttcctgtataattattaatagcactcactttctcttaaaagtgatcactctttatgagatgatggattctctcttttctctttaaactggagaaatccacatcaggcaaatatagaaacttgctggcattctcaaagccctttgacatgtatctgagccatgtgtttatttgtccatttacttatccttgtgtgggagcagttgacaactggtggccatttgtgggaaggactcacagaagatgctatttggttcttgatatttaagctaccttaggtgttaattaattgctttgtctagaatttttttttttttttctgagacagagtctcactctgttgtccaggttggagtgcagtggcatgatctcagctcactgcaaactccacctcccaagctcaagtgattctcctgcctcagcttcccaagtagctgggattacaggtgcccaccaccatgccaggctaatttttgtatttttagtagagacggggtttcgccatgttgaccaggctggtctcgaactcctgacttcaggtgatctgcccacctctgcctctcaaagtgctgggattacaggcgtgagccaccacaacccatctgtatggcaattttctaatttctatcaacatggcttgtccaaagcaaatggtttttgatgagtccaaagctgtctcatcaggctgtgggaatctgtaaacatccagcatgtttacttctctgaatgttttaccctttgcacaaacctggaatgtcagcaaacaagctgaatgcagtaagactggtaaaaccatttgcgtatgagttgagcagaagaatcgatacataatttacggtgaattttcaaggagattaaaacagcacagtggcagtgggttagattgtggggccatttcttttttttttttttttttttttttttttttgagatggagtcttgctctgtcaccaggctggagtgcagtggctgcaacctccaccccactgggttcaagcgattctcctgcctcagcctcccgagtagctgggactacaggcgcccgccaccacgcctggctaatgtttgtatttttttagtagagacggagttttgccatgttgaccaggctggtctcaaactcctgtcctcaggtgatccacccaccttggcctcccaaagtgctgggattatagacatgagccaccgcacccagctttttttgtttgtttgtttttgtttgagatggagtttcactcttgttgcccaggctggattgcaatggcacgatctcgactcacagcaacctccgcctcgattgtggggccatttctaattacaatcatgacatttaaaaaatttctctattctttcagattaaatgacttaaattctctctcataaagggagtgccatgaagaaaagtcattccctctcccttgtgatcctcctatcctccaaggctctctctttcatgggcatcaaagcaccatgcaacgcaggaagccataataagaaacagtgcttactcatgttcagatatcaaggctctgacccttaactctacatcttcctgcttcttctgtgtgctttattttccccctttgtctattgagctaatggcaagaatctttatgctagacaaaatctttttattctaaaggaaatttaatttctgtatatgtcaagcccatatatttcatattctattcccatccaagggccacacattaaaacaattgtggtacttgaagacacattaagttatttatgtgaaattgcaaagtgaaaatgccacttttttctatttgtgacaagagagaaaaataatatcatttccatcttggaactcaaagatttccctctgttctcaagtaggcttttaccttaaaaggacgctgggaaataactaaggagaactaacaaatagtgactaattgtcttggtgttacacaggataccctattatttcccaatgtttatttttaaatagaatccatcacaatgcttttcaaaaaataatatttggccaggtgtggtggttcatgcctataatcccagcacttcaggaggctgaggtgggaggactgcttgagcccaggagttcaagaccagcctgggcaacacggtgagacccccgtctctacaaacaatacaaatttaaaaattagctgggcgtggtggtgcatacctgtggtcctagctacttgggagcctgaggtaaaagagcaaggctgcagtgagctgtgatagtgccactgcactctagcctgggggacagagagagaccctgtctcaaaaaaaaaaaaaaaaaaaaaaaaagaataatagtaacatttattgtgaacttagaaatctgtggtaaatacaaacatatatatatatacatacacacacataacattaacaagtgttttaaaatatagtcattatgaataatagaaaacatttttgttatctaggttttgaatatgcaaaatacagaagtctcatgtatgtttatgagcgatgtaagtcattataataactgagtcgtatatattaagtatttgttgtccatattatctggcttagccctgtttcacttccatactacctcctaacgcttgtgataaatagtgttctgattcaggcttgatggtttttcacctgagcccactccagtgcatctggctccgaggccatcatttcccatccattctttctgctatgactttgttcatgctacagagcacaatatcaaactcattgtagatagtcctacaggcagtccctatgctcttccatgtccatggtcagtcctcatttcatctatggaaagaccatggaatttataataattcctgttgttctctagcctcctagtctgattaggagcagggccaggcaaagttggcttacagaccgaatctggcctaccacctgttttgtaaataaagttttactggaacacagccacactcatttatttacatattgtctacagctattttcactacaaaagcagaattgagtagttatgacagaggccttgtggcccacaaaggctaaactatttaatatctggccccttaaaaaaatgatgttgactagggcactgagtttttaagacagctcagccaggaattaataactttgtcaaatccagttacaaatagagcttttcaatcacatccataagttatatctgcagactagagaatcataaatttagtcttaaacttatagataactgggaaaagttaagctgactttactgattttcctcttctattgcctctctatcctaggtacctactctgcagcccaaatagaacatttcttccttggcaggagcacagagttttataatagccctttgattgcctttagtcctttgaatagttctattgttatcatctaacatatatattgttcaataagaatgttttaattgaattaataaatgaaaaaatgtggatcagcattttcaaagctatgttttgcagaatgcttgctatctttgaaatgtgttccacgaaaaggatggtctatctaaaaaacaaaaaaatctatagtcaaataagtttgggaaataatgacacacactatttattttcaggaacaccatagttcacataggtgtattaaagttttggagaaagggagggtgacatcaacaaaacggcacagtagacagctcaagctctcaaaaagagtagaaactgtcagaaccaattttgtcagaactctggaaaacagtcaaaagtttacagcaaccaaatgtccacaaaatcaagaaaaaggtaacttcgaaatggtaggaaagttttgtggtattcccacttgcccttgtcccattccctccctagtatggcagtagttttggtttaaaattggtagcagcctacactcctagtatggggccctggtcccttgatctggaaggagtagaccaaaccttattcacaaattattttgtgtgtctgttctaacctttctataggctaccagaaggacaaatgcaaggagtttatatttgttttctagggctaccataacaaaataccacagactgagtggtttaaacaacagaaatgtactttctcacagttctgaaggccagaagtccaaaatccagatgttgacaggtttgctttcttttgagacttctctccctggcttgtagatatctgccttctcactgcattttcacatggtcgttcctctgtgtaaacacatccctggtgtctcttttctccttttctcataaggacaccagtcatatcagattaggggccaaccctcacttaaacttaactaaccctttatagaccttatctccaaatatggttacattttgaggtactgagggttaaggcatatgaatgtgggggggacacaattcagcctatgacaatgctcatctctgtttttacctaactcaggatggaaaggcagtgagtattaattaaaaaaatactgcaagtcaaactaaaaatcttaaagggcaaaatattacaattgaaatatacaatagaccatctaaaagcttggaagtgaaacttagagtttcttagggaaattaggacattcaaaatcgaccatgcatatggcaaatttagaaagccactgcattttcagggaaatatgtgtgctcagaaaagacccgagcaaacccttagctttcaccttgggctgatccctagattcagttcaagcccagctagttgttgaagggctctggcatagagccaatctgcaaagactgggagagttatgttttgtttgcttggttggttggttggttgattggttgctttgtattttggccccagatactcaagaaaatctctcataaaattctagttgaacacaggctgagaaacaaagactatagtgaccacacatgagaaggaatattacagtcttcgcagaaatagttttggaaagtcactaagcaaatggcctactatacccttcaacagtcaaaacattcagcaaattctagagaaggtagataattttcagttactacagtatgataaatatacagttttcaacaaaaatcacaatgcataaaaagtaacaagaaagtattggccaattcaaaggaacaaaataaattgatagaaattatccctgaggaagttcagacactgggcttactaaacaaggactttaaaacaactgtcttaaatatgctcaaagatctaaaggaaaacaaagacaaagaatgaaaggaaatcaggaatattatgtaggaataaaatgagaatatcaataaagaaatataaattgtaaaaaaaattctgtatctgaaaggtaaaacagaaattgaaaattcactagggtagtttaacagtaggtttgagcaggcagaagaaagaatcagttaatgaagataggaaaactgaaattgtcaattctgaggagcagaaagaaaaaagaataagtgaaagtaaacagagcctaggataccaatgggaacccatcaaatagaccaatatacacattctagaagttccagaagaataaagagtggaaagaatatatgaataaaaaaattttgagaaataacagttcccacattttatgaaatatgtaaatctacaaatccaagaagcacaataagttccaagtagggtaaacccaaagagatccacactgagacatattataatcaaactgtcgaaagccaaaaacaatgaggacactgtaataacagcaagagaaaaacaactcattacatacatgggatccctagtaagactatcaactggtttctcagtggaaaccataagggccagaagacaatgggatgatatatttaaagtgctgagagaaaaaaaaaaactgtaactgaaagtttatatccagcaaaactgtcctcaacaaatgagggagaaattaagacattactagaccagcaaaagctgagggagttcattaccacttggcctacgagaaatgataaagggagtccttcaagctgaaataaaaggatgctaaacagtaagtagaagtcttatgaataaataaagatctccagtaaaggtaaatgtatgggcaaatgtaaaaacactattattgtatttggagtttataactgcacttttatgtcctacaggacttggaaagacaaatgcataaaaaattattagttgattttattgtgcattcaataaaaagatataatctgcaacaacaaaaacataaaggagagagaatggtgttgtataagagtggagctatcgtatgttattgaagttaagttggtatcagagagaatggtgttgtataagagtggagctatcatatgttattgaagttaagttggtatcatttctgactaggttgttataaatctaggttgttaaatgtaattcccatggtaatcacaaagaaaatatgtgaaaagttaacacaaaaggaaatgaaaagaaaatccaaatggttcactacaaaaaaaatcaactaaacataaaagaggtcataatagaggaaatgaaagaaaatccaaatggttcactacaaaaaaaatcaactaaacataaaagaggtcataatagaggaaatgtaggacataaaaagctatgagatattcaaaaaacaaaatgatagaagtaagtccttgcttatcagtaattactttaaatgtaaatggattaaacaccctaatcaaaagacatatactggcagaatggataaaacaaaccatgattcaactatatgctatctacaagagactcactttagtttcaaagtcacaagtaggctaacagcagaagaattgaaaaagatattccatgaaatagtaaccaaaagaaagctgaggtggtatactaatgttagacaaaatagattttaagtcaaaaattgttaaaagagacaaagaatgacattatatatggagagagatctctaaagatgttctatttattattaaaaatggtatgttgaagtctccaactattactgtagaaatgtttatttctctcatcattttggtcaatatctgctttatatattttggagctctgtttggtgcatatgtgtttagaattattatatcttaatgagttgaccattttatcaatatataatataattgttttcaggccactaaacaagcctcagtaagttttaaagtattaaaataataaaatgtatcttttcccactatagtggaatgaagctaaaatcaataacagaagaaaaactggaaaattcagaaatatttggaaataataccgtcttaataaatcaaagaagaaatcacaagggacataagaggtgaatgaaaacaaaaacacaacgtaccaaaacttatgggatacagtgaaggcagtgcttagaggaaaatgtataatataaatgcctacacttaaaagaagaacaatctcaaatcaacataaatttacaccttgaagaactagaataagaagagcaaactaaacccaaagttatcagagaaagtaaataataaagattagaggggaggaagacagagaatagaaaaagagttgcagaataaacgaaaccagaagtttgttctttcaaatatcagccaaattgataaacatttacctagactgacgaagaaaaaaagaggactcaaccaaaatcagaaatgaaaatggagtcattgctattgaccttacagaaataaaaagaactttaagagaagattacgaataatttagataacctagatgaaatgaacaaataagtaaaaacacacaatttacctacactgattgaagatgaaattaaaaatctcaacaaacatataacaagtaaagagattgaatcagcaatcagaaacctcacaacaaagaaaagttcaagaccagatggcttcactggtgaattctagcacacattttaaagaaaaattaacatgaatcttcaaactcttctaagaagtaggcaaggaggaaacacttgttaactcattctatgagtccagcattactctaataccaaagtcagataaaatcgccacaagaaaagaaaatcacagaccaatatccctttgtagtgagtgcttgtaattgtatgttgtcttggcatccattttatatgtaagtttaactctctcatgccagaaacagggctcagtcacccttgacatagtctcatattcttcttcccacctgaatggtagccagaggtaaaacttagaggcatctctcctgcctagcagggaggactccctgctttcctgctacgtcctttaaagagaccattcagacatttgcctgcaaacttaaagtgatcacctctcagttacaaaatgaccacttgaaacgattgcctgctcactttaaaaccaccaattaaagccccccagtgggaagcctgtttagataacaccctagactgaataaaagcattggcccatgggtcccttctctctctctctgcctgtgcaccctgacctctacatgtgtgcagtctctgggcatgctgtgtaccctccagggtacataagtagtaaaaactcttaaactttcacgttgtggttgcgtcattaaagctgttcttgcaatctgacccctgacagtgaggcagccccaaagcgtacagatgtggattgcctctgctggtgctcttttgtccaagtctcttagctgctgggggacagtagttaacagctaggttgatagagtttcattcaaaacacccttatgaagatgtatttaaaaatccttgacaaaatattagcaaaccatatccaacagcacagtaaaaggattacacatcatgaccaattgagatttattccagaaatgcaaagatggttcaatataaggaaacaaattaaagtaatataccacattaatagaatgaaggagaaaaacacacgatcacctcaactgatgcagaaaaggcatttggcaaaattccaacatcctttaatgatttttaaaaacactcagaaaactagaaatagaagaacacttcctcaatatgataaagggaatttattaaaactcacaattaacaacatgatccaactataggccatctacaacaggcatactgaagggtgaaagattgaaagcttttccttctaagaagatcagaaataagacaatacctgccttcaccactgctatttggcattgtattggaagttttatccagagcaattagacaagaaaaataaatgaaaggcatccaaacttgaaaggaggaagtatatctttactcacaaatgacacagtcctacgtatagaaaaccccaaagaatccaaaagaaaattactagagctaataaattcagtgaagttgtagcatacaaaatgaacacacaaaaatcagttgtttctgtacacctgcaataaacaatttgacaagaaagttagaaaaaaagcacctccatttataatagtatgtaaaagaataaaatacctaaaaataagttaaccaaacatgtgaaagttttgtacactgaaaactacaaaacattgctgaaaaaatcaaagaagacctaaataaatggaaaaacatcccttattaagtcatgagtaggaagacaatatatttaaggtgtcaatactacccaaagttatctacagattcaatgcaatccctatcaaaattccaacagccttttttggcagaagtggaaaactcaatcctcaacttcatattaaattgcaaggggccctgaatagtcaaaataaccttgaaaatgaagaacaaagcggaaggactcacaattcctaacttcaaaacttaatacaaaaccacattatcaaaacagtgtcatactggcataaggataaatatgttgaccaatagaataaaattgatagttcagaaataaacccacacacctatggccagttgattttgacagggttggcaagtccatttaatgaggaaaaaccagtctcctcaagaaatagtgctgggactcagccgggcatggtggctcatgcctgtaatcccagcactttgggaggccgagttgggcagattacctgaagtcaggagttcgagaccaacctgaccaacatggtgaaaccccatctttactaaaaatacaaaaattagccgggcgtggtggcacatgcctgtaatcccagctactcggggggctgagggaagataattgcttgtgcctgggaggcggaggttgcagtgagccgagattgtgccactgcactccagcctggccaacagagcaagactctgtctcaaaaaaaaaaaaaaaaagaaaagaaaaaaaagaaatagtgctggcacaactgaatttccacatgcaaaacaatgaagttggacctctctcataccatatacaaaaattatctcaaaatgaatcaattacctaaatgtaagcgttaaaaccaaaaagctgctttttaaaatataggggtaaacgttcattaccttggatttggcaattgatccttggatatgaaaccaaagcataagaaacaaaagaaaaaataggtaaattaaactttatcaaaactaaaggccaagtgtggtggctcatgcctgtaatcccagcactttgggaggctgaggcaggcagatcccttgaggtcaggagtttcagaccagcctggccaacatggtaaaaccctgcccctactaaaaatacaaaaattagccaggcatgatggtgggtgcctgtaatcccagctactcaggaggctgaggtaggagaatcacttgaacctgggaggcagaggttgcagtgagccaagactgtgccactgcactccagcttgggtgaaagagtaagaccccatctcaaaaaagaaaaaaacaaacaaacaaaaaaagccacaaccctaaaaacttttatgcatcaaaggacattatgaagaaagtgaaaaaacaataaagaaaatatttgtaaatcatgtctgaggagggtttaatatccagaacatgtaaagaactacaattcaataaaatgacaaaatacccaattcaaaaatgggtaaagggcttgaagagatatttatccaaagaaaatatacaaatagccagtaagtacatgaaaagatgctcaatgtcattactcattaggggaatgtaaatcaaaaccacaatgatataccatttcacacctcctaagatggcaataattttaaaaatggaaaataagtgttgacacagatgtggagaaattggaactctcacacattgcttgtgacaaaatggtgcagatgctatggtaaacagtttggcagttcttcaaaatgctaaacgtgaaattatcttatgacccagcaattccacttcttagtatatatccaaaagaattaaaagcagggactcaaacctacttgtgtgtaaatattcattgcagcattattcataatagtcaaaaagatgagaacaatctgaagtgttcattaacagatgaataatgttttatacatacatacaatggaatatttttccaccatgaaaaggaaagaaattctgatacatgctacaacatggatgaaccttgaaaatattatgctataaaagaaatcagtcacaaaggacaaatattatacggttccacttacattaaatatcctaaatagagaaattcatagggacataaagtagattagaggttaccagaagtggcagggaggggaaaggaaaagttatctcttaatggttacagagttgttatttggtgtgattgaaaagttttggaaacagactggtaatggttgcacaatattgtgaatgcagttaatgccactgaatatagtttaaatatatatttatataaaacaaataacatgtgttataatacataatacacacacatatgtatataaaacaccacgatttaaaaacaataaaatgctttgggaaaatctacattaaagaaactacataactattcaacagtgctttccaaacttgtttgaccttggaagttttaaaaatggactacagttaacatttccaaggacatttatgaaagatagaaacaaagtacaagtgatcataattttgaaagggagaaagatggtctgcagtaacaagtcccccttgttaaagtgcagactgcttcagcagggctcagatggggcctgagatttggcatttccaacaaactcctaggtgatgctgatgctgctggtcctcagcccacagtttgagtagcaggggatataatagtactatatatgaagaatagcactattcttcatgatcctgttccctaccatagccaatttgatcaactgatctgaaagcaaagatgttaatggataataatcaataatttattatgtctccaatgtagcatagttataattttacatgggtttctaagacaaataccttattccaaagaagatactctgagaaagtgatatatagcaacaaagaagatcaatatgggatggggattgtcatacttggtgctgggggcagatgaggtggaattattttttcaaatacatttaaagtatgccagatctatatcttacttccatttatatttggattgcatacttgaattatggccaggccactctttctcataagaataagagaaaaaggaaaaatgagagcaagagagaaagggaaggggggagcaggaagaagagggaagaagggaaataggagacaaggaaggaacgaaggataggaatgatagtgccatgaaaaactagatgtttacataattcttttcaacagtcagattctcattcaactcatttttgaatatcatcactttgctgataaatcaattagatggggttaactagtgtaaaatatttccttctgtagtttacagagcacattcattcactggtgatcacatctaagaacatgtccctgtcaatcagaacacctgagcagactattgtgctaaatgcagatgaaaggttgtgctgacacatgctaggataactcctaaaagtggggaaaaaaacagttatctacaattcaacccaaagaacttgcaggtcaacttccatatttaggtagcttatatcactaggataattgtattggcctcaggcattttacccctgcagttaagaaaaatatccttaaagttaggcaatttctgcctcttataaactctgcgaccttgagaaaattaatgatctttatgcctcaatttttcttatctgagaaatggaggtgatgataattattgaagaatgaaataatacattcactggcacacagcaaggttcaaatatatgtcagttcttagtatatgcgtgtgctaatccctcatcaaaaaactttttttctttctaaggttttatatagaaatgcaaatgaaccttgaaccaaaaaaaagtgcccaaaattgaaaaagtcagatgtaaaggattaagaaaggtacaaaccaatgtaaaataccatggttagcaggccaggagggcaacaggatattatgaaatgagggaagtgcaacaaaaaggttgaaagtttaggtttttggaatcagaatgatgagacactgactctcagcttttctaattactgtgatgggacttcaagcaatttaacctctctaacaccatgttttctcatctgtaaacatttactagagcaataaacagattcgtcttttgtgaggattacactagataatttttacatgcacttagcacagtgcagcaatatatggtaacttaaaaattattttgacttccagcaacatactcataatgccacttatcaggaaagataaaaacgaatatataatggtatgacccagctttctaaatgcttccaagccagttgggtaggctagagaagcagaaaatgtacaagacaaccaatgtttaaattttcaaatttatgcttttaaatgacatttctctttttcctgtttatttttcccatcattcatttttctatctatcttgcatataagaattcaggaaagttttccaccttgaactggatgatctcgaaggaaatatttcattgtggagagaaagggaaaaagcaaacatatataatttcttgtgacttgcctctgccttgtctaatttatttctcattagcagaaaaatctttgttacaaaatagaattctatagccaagaaagagaaagtatctattttgctttgttttgagtaatcaaaaaagaaaaacaaaatccagcagagtagaaagtgaccatggagaagaattcatcatggcagatgctgacataagaggggccgggacaaattaaaaatagttggagcatttcaaagatgtctactgaaaattgttttggtaatatggtggtgcctgttattctgtgcctacaaatatattttttaaaatcacaatcacatttcaaaaggtagacttaaggagggctacaaggggccctctcaaatgaatgagttaaagaggtgaaagaagagaaaaacacattgatagtcctggtttgcatctatcaaaattcattagtaataagtatccaaactattttaaatataaatcctgttatacaaaagtgtgcataagaacacacttgtactttcattaggaaaagagagttctgaggggtataaggtgtttttcaagggtcacagaactcagtacatttcttttcacatccccactgcagaagattacacagatatgagcaaacacatgaaaaacaatcacaattactgtttcattaaaaatagaaaaattagttatgtttcaaagaataacaacacatctcttttaccacaactccttgctccttcttttaccaaaagattttgcctggggagttaaattagccattgtgccccaaatttcctcatttctagaaccccacacggacttctgaagaggtttaaaaatgcagtgtttaagtgctgccataacttgtgttttcactgccttcgagggaggcctcaagccaaattcctcttctttcagatcctacagatttgttgggtactgagccaactagggtgtttcttgcactgggctgctgatcctttgttgcatgaagacatacacatttctacaggagaaggcagcaagtaaatagatagttcatggcaatattagctcagaaagcattaggagaaaattccacaaaggcaataaatatcttccccagcaaaatgtgaagcagagaatcatcagacagtgatttacctactgacaaaaggtaagagaaaaagagaactgcagtcaggctagtcactggatctctggagataacaatggactcttattgtgtccaaagcacatctaggatgcaataatccttgctttacaccatatttactaaggtaacaatatggacgtaaattgacattactgtatgtgtttatgtcttaagttaattttgtttgttatatttctgtacatcatttctcattggtggtcagaggatataaagaaggagtggggtaaattcagaggtgtcaagaaaatcaaagtaacctgctgatttaaagaatgtcatacaaaaggaggtgggtgtttctgactcatccataactcaaaatgcagctccattttgacctcatgaccaggctatttcatcactacgagggaaccgctgttgatgtctacaatgttgatgatcctaaggtcaaaaataaaaaagccaccacccaaaaggctattttaatagaaacttatgacagtgaatccagttcaatagttttcagcttatattttccaaatccaaaactcttcagggtaagttgccattgcttaacagccattatccaaaatacaagtgggaatgttatcattatgcacctcagggtaaaactttttttttggcaatctcaccatcattttaattgtattcaaatctctagccaattgcacagatgttaatggagctgtatttttgcttcaatgtctattgcaatattctcattgcattctgcaggtcctccagtaaacgttacttgcaatatttttatcaacagttttggatcagtcacagaaacgaccatggtaagtgctgcaatgccactggcaagagaaagacacaactcaattatgctgtgaacacaaactgtcaaattttctattgttcaacttgcagggcctcctgtaaatgttacctgcaacatatttatcaacagctttgggtcaatagcagaaactacaatggtgagtgggactgagcattgaagccatcgtgtgaaggaatgggatgtgggattgaagtgcactgtggcatatttgtgagacatttactgagtgccaatttccaactttgctcgcctctgaaaagcaataatttatactactttattttgtaaagtcatttgtcaagtgttcattacttaatattcagtgatcttatatctatcgtgccagagaaatttttaaaacatttgatgttttaatggttttctgtagaattatccacaataaacatgatgcatagttatggatatttaaataggtgcatctccaatgcttcagaagtacaaatttcaaagtttgagagatgtaacagtatagccagttttttacatgtaatggaatttttaagatagttgagcctcccttcgatgccacattcaagatatattccaaagggctgaaattagaaaaatacacacacacacacaattttgttgacaagagaaagtagtcccaagtccataacaattataccatatgaatgccttttccaaaaaaaaaaacccctaaacttaaagctaattagaagctcattatacagtatgagtaaacatgtttcatatatctgaaaaagatttcagatactataaaatctaccagtgcattttttttttttttttgagatggagtctctctctgtcacccgggctggagtgcagtggcacgatctcggcttactgcaacctctggctcccaggttcaagcgattcttccacctcagcctcctgagtagctgggattacaggtgcacgccaccatgcccagctaacttttgtatttttgtagagacagggtttcactatcttggccaggctggtcttgaactcttgacctcaggtgatccacctgcctcggcctaccaaagtgctgggattacaggcgtgagccaccacaggatctcactcttctgcccaggttggagtgcagatcatggcacactgaaacttcaaactcctgggctcaaacgatattcctgcctcagcctcccaagtagctaggactacaggtgcacaccaccacatctggttaattaaaaaaaaattgtggagacaggatctcactatattgcccaggctggtctcaaattcctggcctcgagcaatcctcctgcctcagcctcccaaagcaccagcattaaaggcattaactactacacccaggcttctaccaacactcttcataaatgtcatggtcatgttacctgtgacatagcctattggatcattagtcttacccccacagggttctcggctacagcatggaggttgcattttgggtgagatattttcttggtccccatattatttactttaagtcctaaatcaattggctgggtctaatttgcattactatgtaaagtttacaaccattcatttgataaaaccaaaatcaagtgtaattgagtttgactaagtattatggtgcctgatgtcctaaaaataataagcataatgccattgagaagtaaaaaaaaaaaaaaaaggtttccttgtttatatgaattttctctttttggcaactaacatcatgtttaataaattactgttctttgtggtgtccttcatgttaggaagaattaatttacctttaccactttttttccactggcaaaattagacataattcaactccattacccattttgatattattctgaaacattattacccagaaatgagacttgtgaggctttgacaggatgtggtgcatttaaaaatttacctaaataggatagttttgatagggctattaaatgactcataataaaagctaaacacagaaagagtatatcaactcccaggttgacattcagtttctgtctctcccctcttggctttatcgtaataagagagggggcaaagcttccagtagcccaaatcactgtcaccagctttacacgatggcattcaatgacaatatttgcacgacctaatgctgattgcattaattagattcccatgttgctttgattaaatctcctcattgcatcgtattctcaatcaaaaatgtaaatgtgcaccttttcgatgttcattaatgcaaaaaaaagctaaacatttaaagagattaaaatggaagctatggatatccttgttttctgctatctttaacagctactgaaagtttaataaatgggctgctcaggtacttcctggccacttatttagtgacctttgtcatgcttcctgccagaaaatttggaaactgttgctcaagggtaacatacacagcctgtctattctgctgtataacacagattgaattgcatggttagaagactgatgtatattgtgcttcttttgttttacttcttagctttgatataatgacaaactccatttgctttaaaaatatattttgttttattcaattttggctttggtgcaaaactacagaaaatattttttggaactctatcatgcttgtcaaagaagaaatcctcaggccaccgagggtagggattggcaaactttttctgtaaaaggccagacagtatacctaagactttgagagccagatagtctctgtcacaactatgtgattctgcccttttggcatgaaagcagccataaacaatagtaagcaaataattgtggtggtgcaccaataaagctttacttacaaaaacaggccaaggcccaagttagcaaataggtgtggttgtgtaccaataaagttttatttacaaaaacaggctgaggccaaatttgggccacaggccataggttgccagccccagatttagggcatcaatatttaagtggatgcataataagaatgtgagaattgctccaacaagaaagggcctcatcttccaagataattgaggccctgcctgggactccacctggtacaccagtcttaattagctcaggctgtgataacaaaggattgattggttggcttataaacaacacaaatttatttctaacagttctggaggctggaagtgtgagatcagggtactagcatggtcaggttctgatgagaactctatttgggttacagactgctgacttcctctggtattctcgcatggtagaaagaaaattatctggggcagtaatccccttcatgagtgctctacccttacgacctcatcaccacccaaaggccccgcttctaccctccaatactatcacattggaggttagaatttcaacatatgaattttgagaggacacaaacattcagtccattgcacacccaaagtgtcatcacagcccaagctttctttaccataccgctaagattttaccatccatgaatttactgatagtttcacaaaatttgactcagaaaaattggtcaaaaaaattaaacagaaacagattcttccctgaactgtctttagttgtagtcagaatccttagctttatgcacagtgatgaggtcattgaggacattgattggtgctattttctggggtaatagttttgatttctctacattttctggaataaattatgtcaaagaatgcctcagaattttgagtttctaaacctgttgactttcctctcttcccttacacttcactctcaccccattatccaaatagcattattaaaagttttagtttggggtatttgttcccagatcaaaggcaatgattatatatttcaagaagtcaagatggctttctttgttgctatccagtctgcccttcctatggttaatgaagtcccactaatttattgtaggtgttgcctgcccacaaagtagaggcctgcttacagacccaataccaattctcactctgatatgttagtgtcagagatgtgtactcacaggacaacacatttgtgttactctaaggagtatttttatgtatcattatttttatggatatattattcaaaaatgcatttttgttcattaagacacacagaaatctgttagtgttcattgctagttgccccagcattaagagtattcagtggaacaaattttgtgtggtcccaaagacttagatgactaataaggagaaaatgataagataggttatattctgtttttgaaatgtgagtttaccgttttcttttatttttctcttttctttagtttctgacggcaagtgaatttacaggatggggagtatatttgcaacccctatttcctgatataaaggcatggtttgagaattttagtaatgtcagtaagggtcaagggtgctttcataccatctgtatatagctttcccataagtttgggccatcagaaaatagagaaaagatgctctcttcccagcttccaaatgactgcctggaaggatgtaggtagatagtgtgtgatttggacatatggatgctggaacactatccatgctacagcagtggatcctagtctgctccttatttaacagataggagggtgaactcaaagtgtacaaaatgtgtctgctcagagaacatctccagaatataattctagctccctcaaatccttccccacaacagacatttcacatgctttgctggttacttctgcagaatgaagagttgttttatctccaatctgaaatcacattcctgaagaactcagattaagaagatagacagccccttattagaatgcatgttgtgctgtaactgctgaaatgagactgtgggtcccctttcattctatagctgcgtaaacaagttataagaagatgctgacttatcagggatagcaggtagctacatttcttatttttgacttcttaaggaagaatcaagaatctattacaagcctgacttttttttttttttaatggagtctccctctgttgcccaggctggagtgcagtggtgcaatctccactcaccgcaacctgcgcctcctgggttcaagcaattctcccacttcagcctcctgagtagctgggtctacaggcatgcaccagcacacctggctaatttttgtatttttagtagagacggtgtttcaccatgctggccaggctggtctcgaacacctgacctcaggtgatgcacccacttcagcctcccaaagtgctgggattacaggcatgagccacagcacctgggccaagtctgacattttttaaacaaacatataaggtgaccttggtctctaaattagcagtgcaatggtaaagcctcaatttatcataaagtaactgccccctataacttcaaactcaaggttagctttcccatattaaagctcgcacagacttgagattaggcctactttgggcactcttcccaagagctactgcctccaaaatgctctatgaacttgatcatcaggatgaatgtatttgaaaataagtcatgggaatttgtatagtttagtaaataggtaaaaaagaaaaacaaaaacaaaaaccgtattgaagcttttttccatacaccctaatctttacaacttaattatttttttcccttttgatcctgggggaattcacccaaacttgccatcctgaaatggtctccagagtagagtgactcccagtagagtgaccaactatcccaatttgcctaaactgaggaagttccctggatgtgagagttttggggccaaaattgggaagttctcaggcaaaccaggacaagttagtcaccattagagtaacgtaaacaatgaccaaaaatccagttgccaaatatgtggagatggagcaagtaagggtaaaaaatgtaaaggaaagagagtaataatgaattagtatatatcacacttgtggtcacacgtagcaatagtggataactactagctctgaaaccacagactggcttggttagggaatactgttgaagcctcaatcggagtccagattatcaagtgaagtagtactttcaatgaacctaaggtctttgagtagaagtccccagaagagcagtcactgcccccaagctattcattaacagaagaaaattcccagaccaaatgggaatgccaggggtgtacctaagtctcccacagtgttctgattgagaacgtgaaacatctctggataaagcatcaagttggctagtgtagatacaacacattcagacaaaatgataagaatttcaaaagtaagtagctgcaaggaaaatattttgtcaacatgaaagatcttaatgtttacgttgataaattttaaaatattgccccatcatgtcatagttttataagattttcactactcaaattacgcagtgggtttccttctgcccagagcatctcagcagaaagggatcagagatcatgtgatttctgatttggaaaataaatcagttttatttgacaatctgccatgacagactgatttctgtgttcattgtttacctttttctgtagcaaaatcagctttagtattatttcatcccaaaatgaataatttaaacactaaaaaattcaaccaagtcaacccgttttattggtgttctggtttggttgaatcttcctttttctttctcccttttgtcccctctcctaatagaactaaatggtttattttgaccaaggtatacacagtttggtttactcggacaccaaagctgtatcaaatcagggagaagaatgagagagaaatgcaaatagaactcctgtgccagggtaatcagtaacacttgtccacggcatttctgtaggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcaggtaagcctccattggctgcacatgttcgcatctccatttctccactaatgtagagctgcctgattctgcagggtaggatgtatatgaatatttgacttttgtggtttcttgtttatcatttgaatcttaaagttggtggagagtgtcagaagtccctttggtctcataaatgtgattctccataacaagaatgtatttggtaggatggtacatggttaatggtattgtgtaatcacctgcacaaatgtgttcctgattgcttcagtaaaggaagtacaggctattccgttcaattgccattaagcataatatacaaaatctcatttcaataattctgccattctgtaacattcaagcatgcacacacacacacacacacacacacacacacacacacacaaattcaatagctcagcatagtcattaacaacatacttatagctggatacatggaaacctggttccaatgtcagctttgcttctaagtaaacacgtgaccttgatctcttaacttttcttggacttgggcctgggacagacaattgctgagatccatttttgcttttatattcaaatatgatcttctccagaagtgttatcactctaggctcaaaataatctcccccttttctgaactcatatagcagtttctttttttttttccatatttttttattatactttaagttttagggtacatgtgcacaacgtgcaggttagttacatatgtatacatgtgccatgctggtgcactgcacccactaactcgtcatctagtattaggtatatctcccaatgctatccctccccctccccacccccacaacagtccccagagtgtgatgttccccttcctgtgtccatgtgttctcgttgtttaattcccacctatgagtgagaatatgcggtgtttggttttttcttcttgcgatagtttactgagaatgatgatttccaatttcatccatgtccctacagaggacgtgaactcatcattttttatggctgcatagtattccatggtgtatatgtgccacattttcttaatccagtctatcattgttggacatttgggttggttccaagtctttgctatctaatagcagtttatctgtgactctgtaaggctcttattttttcctgccttattattttggttattgctgttcatgagtatagcataaaaacatggatttctggaattagacaaatctagaatcaaatcgaagctttgccacttactaagttatgtaatctatgaccctcagttaccttaattttaaaacgggaaactccatgtttatctctgtatattcttgtgtgaatgagtaatgtagtggtcagcaaatattttctgtaaagggccagatattatcttaaatgttgcagaccagattgcctctgttgcaactactcaactctatcattatagctcaaaagcagccataggtaatatgcaaacaattggacacggctgtgtctcaataaaatattatttacaaaaatagatggtggactggatttggccctttggctgtagtttgccaacccttgatataagatatattaaaaatacttgctgcagtgcctgacacagagtaaatgtttgataaataaaataatggctatctgtattttaaaatcagttctttttttttaatgctcaacatctctaatcattagaaaaatgcaaataaaaaccacaatgagacaccatctcacaccagtcagaatggctattattaaaaagtcaaaaaataacacatgctggtgaggtcacagagaaaacggaacacttatacactgctggtgggaatgtaaattagttcagccattgtggaaagcagtttggcaatttctcaaacaaagcagaattaccatttgaacaggcaatcccattattggatatatacccaaaggaatataaatcattctaccataaagacacatgcacgtgtatgtatgctcattgcagcactattcacaatagcaaagacacagaatcaacctaaatgtccatcagtggtagactagataaagaaaatgtggcggctgggcgccgtgggtcacgcctgtaatcccagcactttgggaggccgaaatgggtggatcacgaggtcaggagttcaagaccagcctggccaatatggtgaaaccccgtctctactaaaaaatataaaaaattagccgggcatggtggtacgtgcctgtagtcccaactactcaggaggctaaggcaggagaatcgcttgaacctgggaggcggaggttgcagtgagccgagatagtgccactgcactccagcctgggtgacagagtgagactctgtgtcaacaaacaaaaacaaaaacaaaaaaccaaacaaaacaaaaactggcactgtacaccatggaatactacacagacataaaaaagaatgagatcatatcctttgcagcaacatggttggaactggagggcattatcctaagtgaactaacacaggaacagaagaatactgttcagtgaatagtatagaatagtacagtactgttcaactgaacatgcagtacaaacgctgcatgttcttacttataagtgggaactaagcattgaatatatatggacacaaagaagggaacaacagacactgggacctacttgagggtggagggaaagaggaggacgagaatcaaaaaactgccttatagggtactacgcttattgcctgggtggtgaaataatctgtacaccaaaccccgatgacatgcaatttacctatacaagaaacctgcacatgtatccctgaacctaaaatcagcgtttagaaaaattaatgttccttttcagtagtaagctcttagctctttcaattcaagatatttggtttttgtcttttttgtaacatctaccaaatgtctaggacaatgtactgtatatgagagacagtacattgaataaagtattggcatttaaaggtccttaacagaatgccccctttcgctatataaatttattaccaaaaaagtaaacagctagtctccttgcaaataatttttccaagtctgcagactcaccatcatcacctcatttgacaactctgtatatgatttggttctgtattgtaaattccattcttatacctagtaatttcacagcatgctgatggctgacagccccaatgtcttgtggaataaaagaagctgctcatttgtaaaaagcggcaaagtcactgcttgcacagaaaaccaggaaacttcccccagtgaccattcatttttaaggaaacacaaaacattctccatggtgatgtgtttggttggtgtaaaatgcagtactgagcacaacataaattgatcggacctgagaaaatgggacatatgtggagtgtggtgctaggaaggagagttataaaaagcagcacagagcatcagctgccccagctaatcctccaggccttgggtggcatttgctctaatgaataccaggcatcacacactgctgaaataaaatcagattgtagttgctgttgttgctttcttgctgttttgtgaaggtctttacattctagaatcatgaagagtatgatgctcccaagcctagacccagaggcaattcttgtgtctctggttcccaagcatagcacattacaggccctgaaatgccctgacaactgttttggattaggtggggattgtcctgtgcaggctattttatacttttctttcattgtgagtattttctgaaatcaaaataaaaaaccttggtaaaggagaattggggatatcattttaagaaaatacaagctgttcggagatttgaactgcaagaatctaattatttgcctagaagggcttttgatgaaccagatactgtactgggtctagagatccagaactaagtaagatgtggtctttcccctggaatgacttcagtctaacaaggcaggtggatgcatgataaattaagtaataggaataaataggaaacaaggaaaacaaaagtggctctaattttgcaaatgaagtatgtgatcaaaatattgtcagaatttggcagttggcatccacagtcctgtttgtcagtgggctcaatttaactagaggtcaaggagtaactaatgctaatatatgcccagctgcaggtttgactcaaatttaaggccaaggggggtacagttgtgtccatgtcttaaaggtgctgaaaagttcctgctgacgttccattagaaagtaatttccctgcatactcaggtttacaacacaaatactcccaggagaggaaatccactggcttaaatccatactaaactctaaagagctgatataaaatttatttctgaggatgaacatactggattcctaagaggagaaatgggatagaatgaagaaaggttgggaaagatacaaggaaggggctagaagtaccaaataaaaaccctaaaactgtctccacatacacagtaaatacttaagcaattatttaattatgtaagcatgtggtccacattttaaaaagtaatgttctgtcttgatactctgtatttgcattttcctgaaacctaaagcaaatatcaattgcatttaatctgggaaaaattccatgcttttcttggctttgtaggtgtaggggtagaattaactctatatgggcaccaaagcccaaggttttgattgtcaaacaaaacaaatatagaaatatacagtccactgatttcataacaagcacgatcacctttcctaatacttcatatatctgtattccaaaaggtaggggtctaaaaaaaaagagaaggcagtagaccagaactccgtaagtgtcatccttatgaacacttggggtaccttgactaaaattcaaacaaatcttttaaataggaaggaaaggccttatctcagtgttaataaaccttttatccagtgatgtaggacacaatctttgttgatgaaaaagtaccaaatccatttctgtccatttttctttaatattcattctctaatgttttatcttactctctgttttttcctaagttgtttgttgacctgccccattaattattgatcatctctgacaagagtatacattttgatttgtaaaccttcttcagagaaagtcaataatccagagaatagagatcaagtactgagtaacatgtggtccttcatctgggatggggaaagagtcaaattctaaattcagagagagtcaaattctaaattcacattacttacaatgaatccatacttgaatccatactgaaatagtgaggtgagtcttgaaggttgtacatattattgtttaaacaatatttgttgaatttaatattgtgagttggaataaaggtcaggacatcatgggatatggtggacaacatgaaagaaaaaaggagaaggtgagcatttttgaagaacagctcatctcacatgcccacagtatctttgctgatattgtcttctttttaaaaatcccattgcttctgagaatttagtcagaaatatgacttttatagaaggattttttttaaatttgaagttaccttgtaaaatatctaatccaacacccttgttttgttgataaggacgtcacaatggagctagtaagtaggaaagctaggacaagaatcagggctcttaacttctgtttcagtgctgtcatttcctacccccacattaattcctcatttacttcaacccaagtccaaagacacaaacacacacaattcatgttgcagcaaagggcatcatttcatgcttttttatggctgcgtagtattctatggtatatatgtatcacattttctttaatctaccattgatgggcagctaggctggttccatgtctgctattgtggatagtgctgtgatgaacatacaatttcatgtgtcttttgtagaacaatttattttctttggggtacacacccaggaatgggattgctggttcgaatagtatctctgttgtaagttatttgagacgtctccaaactactttccacagtgcctgaactgatttacattcccaccaacagtttgtgtttgcttttctctgcagccttgcagtatctgttgctttttgactttttgataatagccattctgactggtgtgagatggtatctcattgtggttttgatttgcatttctctaatgaccagtgatgatgaacattttctcctatgtttgttgaccatgtgtatgtcttcttttgagaagtgtctgttcatgtcctttgcccatttttaatggggctatttgttttttgcttattgattggcttaagttccctatagattctggatattaggcttttatcagatgcatagtttgtgaacattttcttctattctgtaacttgtctgtttactctattgataatttcttttgctgtgaagaagctctttggtttaattaagtcccatttggcaacttttgtttttgttataattgcttttggggacttgtctaaaaataattttccaaggccagtgtcaagaatggtgtttcctagcttctgtctaggatttttttttttttttcttttgagacaacatctcactctgtcacccaggctggagtgcagtggtgtgatcttggctcactgacaactccattcctgggttcaagtgattttcttgcctcagcctgccaagtagcttggattatatgtgcatgccaccatgcccaactaatttttgtagttttagtagagacagggtttctccatgttggccaggctggtctcgaactcccgacaagtgatctgcccacctcagcctcccaaagtgttgggattacaggcatgagccactatgctcagccctgtctaggatttttatagtttgaggccatacacttaaatctttaatccatctagatttaatttttgtatatagtaaaaggtggtagtccagtttcattcttctgcatatggctagctagtcattccagcaccattttttgggaaaaggagtcctttccccagcttgttttgtcaaagatcagctggttgtgtgtggctttatttctgggttctctattctgttccattggtctatgtgtctgtttttgtaccagtaccatgttgtttttattactgtagccttatagtacagtttgaacttgggtagtgtgatgcctccagctttcttctttttgcttaggattgctttggttatctgggctgttttttggttctgtatgaattttagaatagtttttttttctaattgtgtgaaaaatgacattgttagtttgataggaatagcattgaatctgtaaattgctttgggcagtatgactattttaatgatattcttcaaatgtatgagcatgggttgtttttccatttagttgtgtcgtctctgatttccttcagcagtgttttgtagttcttgtagagatctttctcctccttggttagctgtattcctaagtatttcattttttttgtagttattgcaaatggtattgtgttcttaattttactctcagctggaatgttattggtgtatagaaatgctactgatttttgtacattgattttgtgtcctaaaattgtactaaagtcatttatcaatttaggagccttttggctgagtctttagggttttctaggtatagaatcatatcattagctaagagaaatagtttcagttcctctcttcctatttagatgccttttatttctttctcttgcctgattgctctggctaggacttccagtattatgtttaataggagtggtgacagaggacatccttgtcttgttccagttctcaaggggaatgcttccagcttttgccatccagtataacgttgactgtgggtttgtcatagattgctcttattattttgagcgatgttcctttgattcctagtctgttgatggttgttaccatgaaaggattttgaattttatcaaaagatttttctgtgtctattgggatgatcatatggttttgcttgaaccttcctcaaaatatatgcatattttggcagggcgcggtggctcatgcctgtaatcccagcactttgggaggccgagatgggtggatcatgaggtcaggagatcgagaccatcctggccaaaatggtgaaaccccatctgtactaaaaaaaaaaaaaaaaagtacaaaaattagccgggcatggtgtcgggtgcctgtagtcccagctactcaggaggctgagacaggagaatcactggaactcaggaggcggaggctgcagtgagcagagattgtgccactgcactccagcctgggcaacagagcgagactctatctcaaaaaaatatatatatatatatgtatagtgtatatatatacacacatatatgtgtgtgtatatatatgtgtatatatatgtgtgtatatatgtatatatatgtatatatatatgcatattttgtgcattaggttatttaagctattttttgtttgtttgtttagaggaaaaggtccttatctttattaaagaagctatgaccctccaactgttaagagcttgagctttgtttccagatttactgcatgcctccagaatgggtatgcctaaaggtgaagtgattaaggaaatattgtttgctttcagtgtgttattaaactgaccagttatctgggggcctcatactaccatctaataacccataaataattataaaattgcccctcaacaatagcaccccatatcaccaaagcatctgtttacctcatcatcaacctttatctgacctaaaacttattggcacctaaaactttatggcattggaggtgatttgcttgttaatcccttttgattctatttgcaattctgggtgttgataattcagtattctgccttcccagtagtacttgagttgtaatagagaactcttggggattgacacgcttttccctctgatgatagattacaggcaccactgagagtaggtatagtgcagatttctagacagacatccaacgatgttcctccaaacaatcttgtctaatgaccaactctacccacatacataaaaggctagcttttctcacatggcctcccatccttgactcatcctatagtctgatgcaagaacttcaaaagattctaactttagttatatatttttttatggcatagggaataaggacattctctatttagatgtcagagccaaaaataaaatgtacaatgaactgagacctgccttaaatgttgccagtggtgttgctttgattaccttactctcaattttgatgagacacataagcccgtattttctattagaaggcagctatgaaaaactatgatttcttttcgctgtgcatatttggaccattatttatctttatgttctataatccaggcaaaattacattctcattttctaactctgtgtccaaatcctcattagtattgtgacttaagtaattaatgtctgtaacataagcgtccacatcagaattaagcagtcttcagagaagtgctgggaaatgccatggaaaccacaatgattccattcttcctagaggcgagcaaggtcgggagggtgggaagcactggcatgcacatatgctagtggattcagcaggagctgtggtgtggaggggctgtttttggagaggggctctttaaaaaggtacagctgagggtagaaatatgaaggtccagaaagtgcgttgtatgtatgacagactctcataaagtatggaaagctttgttgagctcctgctcaggttagaaatacgcaaacactatgggacctaatattggttcagacacaacagagtaaggatcttgtattagtcagggttccctagagggacagaactacaagttacatattacatatatttatgaaagggagtttattaaggagaactgactgactcacaccatcacaagatagagtcccatgataggctgtctgcaagttgaggaacaaggaagccagtggtggatcagtctgagtcccaaaacctcaaaagtacggaagccgacagtgcagcctttagcctgtggccaaaggcccaagagcccctggcaaaccactggtgtgagcccaagagtccagaagctgaagacttggagtctgatgttcgaaggcaggaaacatctagcacaggagaaagatgaagaccggaagactcagcaagttggctcttccatcttctcctgcctgctttattctagccgtgctggcagctgattagatgatgtgcctagccagattgagggtgggtctgcctctcccagtccactgactcaaatgttaatctcttttggcaacaccctcatagacatacccaggaacaatactttgcatccttcaatccaatcaagttgacactcaatattaaccattacagatcttatgcttgtttggaggaaaggagagacttgatcaatgaaatacatggcagctagcatgaccacttgtccttaactgtttacgtgactggactagcaatagcaaccagtaggttttcttccatttagaggtaaccttacatttcattaacattcatcagtttgctcttcaggcaatggtacaaagaacagaatattgagaagatggctcagggcattgtgatctccacacttcctttcatcatttactgtatctcccaggatcatagaacagcctttccagctccataagtttatcattctgggtctcagtttcctctataaaatgagactgaaccagacacttagaccaagtatgaggctccttctagcactattataagtctgtaactcaaaataacgtccctctccttcccaaaccacaaaacactttcctgatgagtaaataagagtgcattcttcatgtcccttagggcttgagtcagcagaggagattcagaatttcaaggtgcctgtcttaaactacttggatctttgaacccttttctcctgaattaaatatacaactcctgagaagaggaacctgattttggagtaggttagggaggtttggactacctgtaatttaagaggcagcgttaaaacattcaacatggccgggcagagtggctcacacctgcaatcttagcacttgggaggctgaggagggtgtatcactttagctcaggagttcaagacaagcctgagcaacatggcaaaaccccatccctacaaaaaatacaaaaaaactagctgggcttggtggcgtgtgtttgtagtcccagctacttagggggctgaggcaggaggatagcttgagcccaggaagtcgaggctgtagtgagccaagatcatgccactgcactccggccttgatgacaaagtgagactctgtctcaaaaaaagaaaaattcaacatatagtttacacaatgacaaatactcagtatcaagtgccctgagaaacttcccagtcgtaaactagatcatttgtaccctctgattcaatcaccaggaatatctgtgaactattattttagaatatgttcatgaaacataggtttatatacttttagacaattacacaaagatggttggctgggaaaataattgactgaatatgtagactaaaggaatcatgtggtagatttgagccagcagagttgaagagctagtctgctattattactcatcacctgaactttctcatggcagaaagccaaaggaaaaccagaggttctggtgagggtgctcaacttacattaatgtgggcttctacctggtccacactgctgctttgaaaggctccctggatgacattaataccaaaataaacatgcataatgtcaccatggctcttatgaaacatatgaattactttagttcattctcacagcacataatccaaaggaaaaggtactttattttaaaatggaaaaaaaaatgtgtccatctgcgtatctcagcagtctctccaacaagtttcttctcgcttgtggtgtttaaaattacaaaccaacatctgtatcaaagaggatacgatatttatcattggacagtcattaaaagattattaagtacgtatattaatacaattatgtgaagttccacatgagatatactctcagagcaaagccatctcatttctgattgattggttatttcaaatgacaataaaataaaggttttatttgatgtttcattttagtatggatattttgctaaacttgagcagtcagatgaaggatagaaagcaaaaagtatgctaggggattaaagacagaattctattggggtgggacaaatgtcagttctgagggtcaggaatacttggattcaaatccaattttactaaatgaccataaaaagtcatttaacctttctttgacctgcagtttttctcagttccagattcacaataaatgttcaatgaatgtcttaattatccctgagttggctgtaggataaaagggaggaagtaagggcgacaacgccccttaccttccttaacacatacgtatggacatacttgtaccattcaggctccactcactttccacacttagtccaaagcagatggatactctccttgccttgagtttcctctttttgggagacatgtagctcataacagaggtgacagttgcatctactttcagataatagtttagctgatgctgttcctcccctttagctgcttgttaaaagtaaactgaggaattatgcttggtttcaaagtgttatccagtcaaggatggaccatcctatcaactgaccagaactccattctctctccaaactttgccaccagaaacagtggtcagtaagtctccatcagttaccacagtggaagtctttttaacgcagcaaaatatcagccaggtaacacaattttgccctcagttgtcaacaggtacaaggttactttggttttctcaaaacggtatctgcagttcataagcatgcttacacgtgttctcttcccccttttttttaaagtaaaatgaactcaaaacattttaaaaattgctacactgtacagtaactttctccctttcttcacctcagtgccacgattaaatagctgtaatactagacgcatagtaacaatgaaaaaggcagttctcattatttcaatgtgcaggctacattttaccttcaccaatgttttgatatataaatactagatgtgaaatgactttgaaatgtaaaatgtaactaagatgtgggggagtattgattatttaaatctttggtaatttgagttccttcctctgatggtgttcaatttatccctcttctattcaacaccttcaaaacattttcatccaggaaatatcaaagcatttgggaaaattttagctgcagatttatcagttgctctccaagttgaatccaatccacatttggacttaattaacatgggccaaccatatgtgtgcacactttctgaaaggaccacacacagatgggaacagatattgtatttttgtccttcccagctactattgctcagtgcatatgggtattttttatgatgcctttataatatttggtaaacatggaccttcctactcagccactgggattttagtcaggggagaggagaatagctaatgagccaagcagtgttgccatttatctcctctacatcccaaggtcaacaggaaaaaaaaaaaaaaaaaaaacagcaaaagtgcttatttggaattaatagagaggaaagagtctaaccatacagcttagaaacaacctgggatttaggtccagccttagacaatattgaaaaaatgatgtgtctctggtgcccagccacactgttctgagccctgtttttcatctagtttcatctttccctttgattttcttagtatgacagtctgcccttggagatatcaatagggaatctgggaatctatcaatttatttacacaaagaaggaaatgagtaacagtacttgaaacacatttctcttcctagctttgcatcttaatagtcaaagaagcctttagctaaatgtgtatttatttattatatatagcagctaagagttggaaggtgtttgagcaaggatatattgggacctttgtggaactcccaacaatttatacaccattaatttttcaaactttgattaggtggaaagtcttcccaggtgccaagctcagggctggagtaggcaggactctctctatgcattacatgatgtaagttcaaagtagccatttaatcacagagctttcagaaatggtaagttaaaaaatttcattccttgcctgcctaaccagacttggaccaattccttttgttttctgtgaataaagatcctcatgtgggtacctcaggttcaattcaggagcatcaagtcatgcttctctgatagaccaaaagggccctctaaggatccaggtatgtaagaatagataacctgctctacccgatcactgtgagtgcttatctgggccccaagggagtaattaaaggtcctttacttgattctgttcacgtgtgtctgattcacatcatcaaaagtattgtctaagtgggagagttggaaacaacttcgaaaagttcaataataaattgaaactattaggatacatatctgcaattctgatattaagttgtgatctccttcaagagacacactgtcttattttaagtgtctggtgcctggtgcccaataaatatttgccaaaatattgctgaatggatgtataatactaagttacagcccagatgcagtcctgcttaacaccaatccctccacaataggacctagagctagtcttcccatgtactctgttctttatgaccagtaccatgagatttcctaaaatttttgttgtggttcattcaatgcaggttgcagccacctccctaacttcttttgaaatttcttggtggcctattttccagacatcagagacagtaatctgatatgctgccatcgccctgagtagagttcactgcctacttttggcctttgcacactggcatgtgttaaaaggcatgatggtcttggcttcttctctatcttacctagaaactgtcctcctaaccctcttagcagctctcccagtttcctagccacatctaccatattcttggttgccagtggactgattttggcttcactgccctgacttaaccagtatacctctccaatgtgactgaagcccatgattaacacccccaacttgtatcattacccctagtccaatcacttagcagcctacttgaggctaactgtcctaccctaatgtcgagaggctgagggaggagaatcgcttgaactcgggaggtggaggttgctgtgagccgagatcatgccactgcactccagcctgggtgacagagcgagactctgtctcaaaaagaaaataataataatatttcccaaaggagtgctactgttactgaaaaattatagacctctttcttaaaaccttctcctttttgtctatcacattgacagaaatcaaagtcatccctcgggatatgctgaagtagtactccttaaagtgtgctccaggaaaccagcattggtgtaacctgggctgctttatcaagagggcctgataatctgcattctaaccaagcccataagacaatgcttatgcccaccagagactgaaacccactatactaaaagatggttgatcagacaaccagcctagcggtgttttttatcccagtgatttcctaatcttccctccctctctccatgtgtgggctgtattaatgatgcacttttaacttgacttctaacttgcccccaggctaatttcacttaaggtctaggtgggttaagatgacactcttgtttgatacttgatgcatcctgtcaaatctccctgacactagaatgtcacatggttcagaaatttcaaggtacaactgggaggaaagattcaacggatcaacatggtacaggaaggccttccttatgttctcagtgaaagagtgaatagtgttctaggatgttggatgacaaagccctatggaagcaataaatgtctcacctatctgcccagattgccaagaagttcctattttaagaagtgttacttgcacttaaagttttcatcatattcaagagggtaaatttacctataagaggaaatccttcaagctggttgccttcacttatagtttataatcacagagatgttgagcaggatggggatgtttgctgggggaggcccagagatttagtcaagatcaaatagctctttatgggtaagccaggtctatcacccaggtttctgggttgccgggagaggctggaggagtttttaaaacaacaagccatgaggattctgggtgtctgaggaaaaatgaaaggggtatccctgagcaggtacaaggcaactaaggtgtctatgaccaactctgctggcttcatagacaaaagaggataataaattggtaacagattattttcctaaggaggaaatgtgaaatgtgatagagtgggaaataataaagggaatttgatgtcggttaaagctgtattcaaatctaacttcggttgcttagtggttttatgactttgggaacaaagcttaaactctgtgagtttcaatttgcttatctcacaaatggaggtaacactgtctgccttgtgtgataatactcagtgattataaaataataagaatgcttgacccacagcaggtgttctgagaattatgattattaatactattatcaccatcactttaatttttagtttgcctaagtattttcatcctaaaggagcaccataggttccagcccccagatgtgtccatgtgccactgaaagtttgtggtgtgctgcataaagagagataaatgtggtcccaacagaggaacagcaatacccccaagactctcttgttcgtcctgaaagacacagaaacatcctcttgtccttcctctctgaacaagagaaactattgtaatcattagaattaactctccaaaaatagcatgttgtcaatccttgctttagggaagcagatcactcattaaaatttgtatttgtacctgaaaattcatcttctcttcaaatggtatttttccctcaagagtttcattgggaatgaactccgagttctaattctaagttccttatgaaccagtagttgctttatgagtcaagcagccttctgtctgccataacattgtaatgttaaatgattaatttacattcttctagcaatgtgaaaatagccccagccatggccctaactagttgaccaaggttccaggacaagtcagccaggcttcctggcattcctttaacttgatttgttttatttctagtgagaatctgccagcaacttagcggaggcaccaggcaagctttgacagtcctgtaatttagcagcatcctgtggactctgatgactggcctcgtcccttctaaatcctttaacctttcccatttccacagaataaaagcctgaaattctcacacaaattttaggatactgattcattaatttgttcaataaatatttcttggatacctactctggtctaagcagagacaggggttcagccttcataaatcttgcattgtagtagggaagaaaaataaataaaaaatataaaaattacaatatttgatttaacaactgtaaaggtaactgaaatagtttacagtgtctgcatctatcagtcatttaaattttaagtgaggtataaacccaagagatggttttatgagcaaggtgaactcaataggaaagtagtaagaaagggaaagggcaggaaaggtgagattttgggagacggactttctttgctttgttctattctttgcctttaaaataggaatgcttgctcagccttcttactttcagtaaagaagcagggcctctgtgaaggaactttacttcttcccttgtgcaaacaggagcaggggtgccctgaatgcacagtggaggaacggacaataatgcttcaggaaatgagttatttaacaaaaatcaaaaggaagaggggcagcctcagctcaatgccttcatgtgcaatggccttaatatttcagattatcggggaagaggacaaatctgacatgctggtcaatgtctgccagtgagaagtctgagtgtccaggcaagttcggaagactactggcttcccgactaaaatagttaattctgtgagacccacccaaagtgggtgaaaagccagagcaaaggagataaaaattgttcacattttagtatattggtgtatagacatatcagccttatttggtgcaatttctgcatgtctgtacaaaataatatcaagttctttttttcccccaaactcatatttaaaaaatcataaaatagcctttttaaatagcaaatggggtggcacttttgtagattcttgtctgggagcataatgaaatattctagggtgatgggaatgctctaaatctggatctgaaagcttgttaaataggtgaatacagatgtaaaaagtaattgcactgtatcttaagatttgtgtttttttactgtatttaatgtacacttcagtagaaaaaatgaaaaaggaaaaaataagtagcgggaaaaacctagatcttaggcctttagatgcacggtagactggatgtcataaatgatgagctctgaggctcaggcagggacttattagatctttacaatatctttctatttgctcatgatttaacaaactgcggaactgttaactctcctccttattattggcacccactgggttccagtacaaaacctatctagaaaggaaattagaaaaacaaagaagaaaaaaaaacccactgagttctcagctgagacaagattcagggatagggtcatgcttgttaggtatttctctcagtggggtctcccatgctgttaatagttttggctcccaaaatgctgagcccctctaggatagttagatctgccacaaaggcagcaataattgtgtgtgagatctctgcttcctgaagaaatgtgaaaaggtcattttgcaaaacagtcaaattcagcaagcctatgattaggaatattaaagttgggttgtttccagtaacaaaccaatatatagttgaattctgtgacattcttaaaagaacatgttcttttaagctgtgttcatcttcattattattatttttaatttctttaaacttttcaaaactataatgaaatttccagattttttggttttgattcactgaaaccaattatccatatgccatctaattattttcatataatgaacatttttttaatttaaattttaattttttgaattgtaaatggacaaattatagttgtttatgtttatggggcacaaagtgatgttatgatttaagaatagaatgtggagttattaaatcaagcaaattagcatatccattccctcaaatacttattatttttttatggtaagaacacttgaaatttactctcttagcaattctgaaatatacaatgcattattatttactattttcaccaagctatgcaatatatctccatgaaagaaaaatttattccttctgtctaattgaggctttgtttccttttgcagcactattcataatagacaagttatgaatgaacatatttttgtatgatgaaaatatttatttcttctttgaaaaatagaaaaaaaatagattctcattatggtaataataattttaagctcatggatccttttgaatttttttcacctttaataaggtgtcagctttgttgttgtttttttttttgtttgtttgtttacttttttttggttcttatattctgtccttatttcaaagagttcatggcattaatctacacaaaattgtgttttcaaaaaaacaaagtctttatgctgggaaccaaaaactaaatatctgtatatctatagctatatctgtaaatgaactccataattgacaacaatttttcctgcctaaaatgttatttttaagtcagttgtttagaactataagccacattttttcctttagagacatgtttgggttctcagaatagcccacggaaggtagctaatttatttagcaatgaatgtgaaatgctgtaggtttgtggcaaatttttaataatcatgatatgattgtaatagcaaaaaattactgaacgaaatggaattttgtaattttacctttcagttattgtttgaagaaaggcacagctaattacacaaagatgggaaagctgttatatgaatagtttttatggacattttcaaataatttatactgctcaattcagataatgcaagataaagaataaaaacaaaatatgaatcatcccactaaccaaaaatataatggtgtgcttatttccaagatttaaaacatgtttttacattgcactgttttatatctttctttttccagtcattatattttaataattttgatgattgtcagcgtggattctttgtctaatctgacttcaaatcgcaaccctttcctttctttaaaatacatgtgctaaattttgttttgtttgcttttacttgaatagattgtaaaaatgaagcagagaaaggaaaaataaaggaagcaggaaggcagagcaagaatgagcatgacagcaagggagagtttaggcaacagtgtgagaattcgaggggtctttggatataaaaggtgtttgagatacgatgaacagaatttgaagcagtcaactttagaaaaatacggattgtagtattaggatcaaatgagaataagcatcatcttacctacctcatcatttggttgatgacaaaacaaatgtttagcaagtttaaggtcttgtttgggggaagagatagtttgaggcagtactaggaagggaaccaagacttactaattctcaatcctaatttccttccttgaatcttggagatacagaaaaatgggagagcaagaggtgtgcatcattcccttaaggattaaaaagggaaatggtggaaatgagatggtagctcaacgaatatcctgatataaggatcagccagagctgactggagttcaaaaaagttaaggaaagaggaaagtggagcagagtaaccccttctgggtgcagagagctgaagactatgtacaaaccgttgtttgtttgtttgtttgtttgtttgtttgtttgttttgtaagataatgagtagtttgtttttcctttttttttcaatttttttatttccataggtttttgggaaaaaggtcccatttggttacatgacttaagttctttagtggtgatttgtgagattttggtgcacccagcacctgagcagtatacactgaacccaatttgtaatcttttatccctcacctccttcccaccctttccccttgagtccccgaagtccactgtgtcattcttatgcctttgcatcctcatagcttagctcccacttatgagtgagaacatgtgatatttggttttccattcctgagttacctcacttagaataatggtctccagtcccatccaggttgctgtgaatgccattaattcattcctttttatggctgagtagtattctatcacatatatgtaccacagtttcgttatccacttgttgattaatgggcatttgggttggttccacatttttgcaactgtgaattgtactgctataaacgtgtgtgcaagtatctttttcatataataacttctttttctctgggtagatacccagtagtgggatcgctggaacaaataatagttctacttttctttctttaagggatctccacattgttttccatagtggttgtactagtttacattccctgtagaaaggttcccttttcaccacatccatgccaacatctattttttttttttttgacttttttgattacggtcattattgcaggagtaaggtggtatcgcattgtggttttgatttgcattaccctgatcattagtgatgttgagcattttttcacatcttttttggccatttgtatatcttcttttgagaattgtctattcatgtccatagcccactttttgatgggattgtttggttttttcttgctaatttgtttgagtttattgtagattctggacattagtcctttgtcagatgtgtagattgtgaagattttctcccactctgtgggttgtctgtttactctgctgactgttccttttgccatgcaaaataaacaaaaacataaagtaggggaaggacaccctattcaacaaatggtgctgggataattggcaagccacatgtaggagaatgaaactggatcctcatctctcgccttatacaaaaatcaattcaagatggatcaaggacttaaatctaagacctaaaactataaaaattctagaagataacattggaaaaaacccttctagacactggcttaggcaaggatttcatgaccaagaacccaaaaacaaatgcaataaaaacaaagataatatgtgggacttaatgaaataaaccatgatctttaaatgggtttttctagctcaagaactacatgctccagaattatcaaaattctagaataaatgctacaatatattgttaacccatacatgcagtaaatgagaagactgtggagttaagcatttgcccatttgatgtaagaagaactagcacttaccatgatcagttatacttattacatcatttctgtccttgaagcaaagtccaaggtgtaattctaaaatagtataaactttatatcttttggacattggcgtgggtaagagcctattgtttttgttatgttatatctcagtggtcttgtttattctagtacaaagctgagaacagcaccattttgggggaaggagggagaatcagaggctggaagatgaaaaatagagagtaagaggttatggtgaaatactacaatatttaaaaaatttatcagtgactgttcttcattttaaaaacaaaaagcactgccctgagttggagcttagatttcattatttgaatcaatgtcactttgcttaatgccaagtgtattttgtttgtttctcaacaactggacttcatagatttaaaaatggtttttaattttttttttgtttgctaagactcaccttgaccttatcctgtcccatggacttgaagaactttccgatggatgtccagacctgtacaatgcagctggagagttgtaagtcaccactgttgaaatgactccctgcttgttttaaccaatgacctggttcttttagtatgtcattaaagagaaaggacccttacaactcattccctatatactgaccaacccccaacatcctaatggaaagacaaaccaaagtgtgtgtgtgtgtgtgtgtgtgtgtgtgtgtgtgtgtgtgtgtgtgtgtcatacaaaatctcattatcaatacagcataggcaacctttcaaagtaaaatgccaaataacttgcctttctccccccgcccaaaaaatagcctgatttggtaagcttttcattgaaatgaaaatgtctcctgagaaaattaaaattattagtcattaaatctttatagtgaatcactctttaatcagaaaattgaatttctttccatcttatgcccatgtagaccatcaccccaaaaggaattctggcaggaagggataattgctttgagaacaagacataaggaccttggccagaggaggatgtaagaatgaggggcatgagatgagatggaataagacagaataagaggcatttctcttagataagcagtggatacacaaaagcatggtgaagcaagtagaaaaaggccatctactttgtcccctttatgacctaaccctgatgccactaaagtctttgatatgtgtcaccataagttgctgatgcctccaaagtaacaggattttcagttaagagatatgaatttctttctggcttggtctatcagtttctctgtttgtaaaatgcagagaataataagtgccactgacctacatggacgttaggagatttaatgaggcatgggcaaggaaatacttttaacttcttggtttagaaaaagaatatatgtaaaaagacttatctattatttaaaaagaggtagtgacagggttgatttcattctgatcatctaaaatcactatggatttcccttgaaacatcccagagaaataaacaaaatgatgaaacctctttatcttaagaagttgtcatagataaaatgaaaatttctgatttaaaataggccttatgtattcatttttttccttattgctccttctcttgagaaaaaagctgagaaaaacattttcttacatgattccttctttctgttttctctactgctccaaaatctcccctgactcaacccaacacttttattttttctgtaaaacagtagccgtagctgtcaactgatgttcatccaaggcttagaaaatttgaattagtaaataagctcagtcctggcatgaataatgaaatcaaagaaacatcatgtttaccactaactttggatgtgaagggtgggaattattatttttttccttttctatcccaatattactttcttcatccccacctctttacctctgctgtcttccccatgctggggcttcagggtgactgacaagaacttttattgtggtggccaacgagaagctcaccagacaagaacgtggggtattttgtgagcttagagtagtatttgctggaggtttccaaggtgtactcacacagatagggtttgccattctccttgtggaccaccaatgcttgtatagggcctctttgtatctccttgctttccatgttcttattatttttttttttttggctttatgttgaaaaggtagtccaaagaaacaggaaagtagattacaattaaacttgccattgatttctgggtagctctggcgagtcactatcttgcagtaaataagaataagaatccataaacttaaaaaaaaaaaaaaaaaacatgctgaggattttggccagccaagacctcacataatatcctctgtcctcatcactcttatctgaaaagttcaaatattacaaacaaagggaaaaggtagagaaatggtgcatgaaagaagagtaggcttcatttctagggtagagaaagatccagaaaaaattgacagatgatgacctagcttggagactaagagctaactttggattaccaaactgataacaattttactttggatggttcaagtcatataaaaatatgatctttcataataggtaatctgttttactttgtattaataattgtgatgagtgggcccatttagcaagacactagcacaaatgaatattcttaatttgcatattccataatttcctcttagattacctgccaatagtcttccccatttgctaaagtagaaggactttaacataagctttctgaatgcaaagctaatagaccctaggaggagggccaagtctgtaatgggaatgttttaggcaggcccgtgattaattcattctcatttaaaaaaagaatggttttcatttaaagtactgactggcactgtggattggattgtcttattggattgctaaagcctcagctcttgcaagtaaagacaatcttcaaaggatttttatgtttgttcacttgtttgttcttcagaaagagttagtgaataaaaaggcagaaatcaatagactttttagattccattctttcattacacagaaaaaaaatccatccataagtagctttctgtcttaaatttctttggctccaatgacacagagttgtagtgatgattgcagctcttttattaagaatgctcttgaattgactgagcgtatgtctgctttagacagtttctttgtttgtttctttacatgggtagactttcaagctttcttggaaagccatattcaattttcactatgatttctttacctcagttgggtacacgatgaatgacctgatatttgagtggttaagtgatggtccagtgcaagttgctgaaggattgaccctgccccagtttattttgaaagaagagaaggaacttggctactgtacaaagcactacaacactggtaagtttctttttttttttttttcagctgttaaacacaagtgagcgccatttgcagtttggagtatacatctcattactctaattgctgcatatttaccaggcaaatagacctatgtcgcacggacctgatttggctcaaaactccctcaacagataagattcctatactctctggaataggtcagcaaacacaagaggtaatttctccagaacatagagagaaggagagaggatttaggatcttttgctgttcctagctgaccatctgttgtcgaatgagtctgaggaaagatgtagaaaacctcattagtggtgcagaaaacataaattctggctcctttctggcatccgctcttgccattggatgcttaggtcaatttgcacccactgtcttactgccttagtgccttagtggaaaagagggacaataacacaggtctttgtaaacccagaaatagagctgttgtgttcttcagtcctggatagcaatagaagtttggatgaaagtcagctggcaggaattcagctggctctaaagtcatgtgttatcagtagtgctgacagacacatggggttggggggcaggtggtgaaggaagaacttgaggtggtagcaacaaataggcatccgttgttttctggaagattttacctgtccagaaaagttgatggtttttcttaagaaaaaccatggtgttcattcaatactatgcaagctgatcatggagagacaatcaagacatgatggtttgtccagtaactggtctaggtcccttgctgaggaaaacagtttatgcacacttgttccaacagccaacagtgatacttatgaagtaaccaaaacctgattccaaggatgttttttttctgaccaagaagaattcaaccctatatcttgtaatctgtatggactaagcaaaattaccttctggagttctaactccaagtcaattaaggagaaaaaaagtgggaaggggtaggaatatctgtctcttaaatgttagaagttttaatacctttatatgaactcctttttacaggtaaagaaacactgtacgtagttcctaggcatatgctaaatgtcctgaagcaattacccagaaggctaggaaatttttacaatgactagactatacactggcttatacaaatgtacatttttctcttgccattaataacacaatgataaatacacagttctttaaatactttgtagttttatgtaaactgtactactttggaggaaatggcttcaactattacacagtgtatgtcatgtgttacatattatatgctatatagtatatgctattaatatataatatactatatataacatattataaccccccaaaatttgaatattttatttccactggttattttctgtcagtcttgtaaattctgaagctctgtctaaaacaatcaagctgcagcaagcacagattttaaaaattaaatatgctttatggttttggtccagtgactctttagatcacacattctcacactattattatcactattattccacagtaattatttctattactggttcagttggagaagagttgaattggttacgtagggtgaacattttgtgcaatcttccaaatccatctgcagtagtcttttttttttttttttttaaacaacgtgggataatggaattggaaatataaattcaggctggactttaaatgatcatttcctccttctaggaaagtttacctgcattgaggtcaagtttcatctggaacgccaaatgggatattatttgatccagatgtacatcccaagcctgcttatagtaattttgtcctgggtttccttttggataaatatggatgcagcccctgccagggtcgcactgggcatcaccacagtcttaacgatgaccacccagagttcaggctccagggcatctctgccaaaggtaagaaatcttgcttgataacagatgacatgaaagcttcccaaaggtcttgtgggctggagagttctgtgaggacagaaatgttggccaccctatgacactgtcatagatatgaatgcaataagaggacaagaagctgagtttgagagaatcagggatctgggaacatggggaaccctcaaaatcatatcatttagaggaaagggaaattagtattgagagggaagagaaatgagtagaggcagaaacatggcttagagactctaggaagcccttgagtgcttttgatctcggttgtttataagacatgaagcttgcaagaattggagtaagactgatgcaatttatgccatattttcaagtatttattggtgaaactattgcaattcatatgtttagtgaagtcatttatagtaataaaaatttgaattaggctcctggaaatcacagaagagccatatcaataaatatatgtaagaaattaatgtacaatattagggtacagcaatctgatatatgaaacattgctatgccttaatttcctttaatggctgatatgctactatttttgagtgacacagttacccagagaaggaacagtagagtcatctaaaatggtgaaaattcctagaaatgtggcatggtgacagaggagtgtgggatcgatatcagggacatatagacagtttatagcacctcaaataataatccataagtggctgtgtaatctatttttataaaaagaaggccatctgcatttgtaaatattgcttaagcaagtaatgatgaatgtcccacttttgaaatgctctagcaccccagaagtgtgcctttgtgtgcttccccatttcactgagcacactgagccattggcttcaattttccagaatatgagtttaatttaggattcagtgtacattgtctcatactggttgagcagtctctccaaaatgcatttccggaaaataatgaagatgtaattccatatttttgctggcttgagtttatgtttggttgtgctgaatttgacataatgagaaatgttagatcatgttccacattatctcccatgtccagaagataagatgacatatggaggaggtctgtggttataatagaggtgggctgaatactggagaaatatttacacaacttattaagtcccatgcctccaaagataaacattaggttttatatggtcatagagaaaggaatagaggtatctctaatacttttttatcttctagaataacaaatagtataatgtacctgtattatttttctactggaatacagatgtcagaaatactaacagcttttttaacctgtataatcaaaaatcaattttacctaatagcacttttaatccactctgtgcccctcccaaacaggttcatttgcttatttattattagtcattagctattgccatcactgcatgccatggcattaaacctcaggatgtacaaacatatattttacaatttaatagacagctaaagtactggtgacaaactgtaagcatataatgtcaaaatataagacatttagcctccaactgctcattgctgtgaaaagagtagtcatttatcttcaaaatgggagtttgagtttttataaatttgttattcattttataaagctgttatgattctgcatcaatggtcaaaactattgctaaataaatgttcactgatcagggatctttgtatgtaaaggcaatgaggaactcagataaaccaaaagagagtaaaatcaaaaatcattttacacttggctctgaactcatggtggttatccttttgccaccattaggtttatcttcctctgtgtacttttcttatgctgttattaaacatggttggctttcaactgaccatgaggaaatgtaacttatgtggatgatggtgtgaaacacatgggataaaaagtgagtcatggaaaatgaagaattggtcatacagttacttatacatgcacatgcatgtaaatactcattttaatttataaacactgcaatccctgaccagatgctccactgtggtgattgtacatttacttcagggcctcctacaatgccccgtacagagtacacatgcacattacactttaaaagtaagatgtttgttatagaaaagacagaaaacacagaaaacatgattaatgttaaccaaccattaaataactgttgttaagactttggtgtattttctttcagtcttttttccatgtgcatttatgggcaagcccatgcacatgcacacacagaaaattgaggtcaaacttttacaccatcttagatatttagagttttcttttttgcttttgtaagtatgataattataaatacatttgcataggagtgtttgtagcccactgtgttctagataacatatatatagtttttaatttttaaaaactttcaatgagaaaaaagaaggtactgagcatgtttagagtgaatgagggaagatctatgagaagatatttgatgggatatatgttctatgcaggcaacaactttgtcttgttcattctgttaacttcaacacctagaacagtatgtggcttagactagatgaccaataaattctcatcgaatggataaattaatgatcagccatgttctcccatgtgaggccatgttgaagatattaggttggtgcaaaagtaattctggcttttgtcattaacagtaatggcaaatatcgcaattacttttgtaccaacctagtagatcagacttgaagcagaatccatgggtgaaagttacacagaaaagtatttgagttttaatgtacagaagaatctcataataatattacatgtactataaaggactggaatttctctagagtatgtctccctttccaaaaattctcaagcagactttgcaaagttaagaatatatgaacaaatttacaagaaaacaaacaaccccatcaaaaaatgggcaaaggacagaacagacacttctcaaaagaagagatttatgcaaccaacagacatatgaaaaaatgcccatcatcactggtcattagagaaatgcaaatcaaaaccacaatgagataccatctcatgccagttagaatggcgatcattaaaaagtcaggaaacaacagatgctagagaggttgtggaaaaataggaatgcttttacactgttggtgggagagtaaattagttcaaccattgtggaagacagtgtgacaattcctcaaggatctagaactggaaatatcatttgacccagcgaactcattactgggcatataaccaaaggattataaatcattctatgataaagacacatgcacaggtatgtttattgcggcactattcacaataccaaagacttggaaccaacccaaatgtccgtcaatgatagactggattaagaaaatgtggtacatatacaccatggaatactatgcagccatgaaaaaggatgagttcatatcctttgcagggacatggatgaagctggaaaccatcattctcagcaaactaacacaagaatggaaaaccaaacactgcatgttctcactcacaagtgggggttgaacaatgagaatacatggacacggggaggggaacatcacacactggggcctgtcggagggtgggggggctaggggagtgatagcattaggagaaatacctagtgtagatgatgggttgatgggtgcagcaaaccaccatggcatgtgtatatctatgtaacacaactgcatgttctgcacaggtaacccagaacttaaagtataataataataaaaatatgaacaaagacatattttgaaacataggccttgatctaaatcttagagcctttacttcactcaacctctctaagtttgtttcatcatttataaaatgagaacattattatctaccccttaaaaaaattaaatgaggatgagatgaagcagtacttatataaattgtttagcccagtttttctacatcgtcggtattcatctcatcctggttatttttattcttactgttccctgtccataatgtagtagaaaagactgctccatggcatgagaggttatattagaaaatgcataaagggccttatgaatagaagatgtcctgttctttggatggctcactattcacttatagttgtactgtcaatgagattaaccaaagtttgtcatatgtatgtgtgtacaagatacaattagtcctccatatctgcaggctctgcatctgcagattcaacaaaccatggatcaaaaatatttttaaaaaacaaagaaagcaaaacaacaataaaaaaaataaccaatacagcataacaactatacaatatttgcattgtattgggtattataagtaatctagagatgatttaaagtatatgggaggatgtgcataggttatatgcaaatattactccatttcatataagggacttgagcatccacagattttcgtatttgcaaagatcctggaaccaatcccctgtggataccaagggggcaactatgtacatatgcacaaatacacgtgtgtgttttttttacagatagttgattaaatgggttcagttccagagggtctgaataagatatgagtcaatttttccccactcactaccattaaataccctcacttggctatgtcttctctgcccctggaggattctatagattctcagtactatatgctatgctattagacctggaatgtacaaacgtgtatttttcaatttaatagacagctaaagtatcagtgacaaacagatattttaggatagtctattatcagacttttaaaaaattatctagtctgaaacaaaacttcagtctcatgtacaattcaatgctcttttcttcccttgccgcatgctcaggcctgacttgtgccttgaaaatgtacagcgatgtggagcactttgtctgttccttcacagttcctcccctgtatttccaacttttttcctcactcatgttgctgacttcaccattgttgagggctgagagtaatgggaaagatggaggaaagtctcatgtgaccgaagctgtggtatactattagtgccttctctaatggcaagcccccaaatgctggatttcttgtgaggtgaacttgagttctttggagttcccagggcatccaacatactacaccatttccagatgaataatgtattctctgggtgatgtcttaccatctcctcttagctatcacctcctagcagtatatcccatacaacttcttactcctcaggtccccttccttaataagatagcccttctggttgatgtattttccagatgactcacctttggctatcttccacaccatttattaggctcactaagaacttgtgcattattgccttgctaaatgatagaaatgcaacttaaccaactgctaatctttctgctttcaccctactatcatgggtattccagctaacctactgccttcaaaattcactcaggtaagaaagatattggtgttcacattttcatataaaacccaaatactaaagacaaatgagagattctcttaagaactctgatccaggggcaacttgttggaatttcagcagcttaccaaatatatggcatatggaagagataccagtctcttttcttacaggggtgggtataaaccaccttctatccatctttaggagaacagggagaatgccacagcactgtcaacgtccacaaattccattacttcaattaatgttttcgaatgtctggttttctgtaataatacagggtgttgggtataagagtctctagacagcattttctgtcttctagaaagtactgtatctggcatgtatatgtgcagcgtctccctttagtgtaaggctttagtaaaaatgctgaggcaataagaatatcctgttcccatactgttacacatataaatatacactcttaattttagacttttatccctatgagggcaaggacttcattgctcttggaaatgttcgtgtacccacccctcagcacaacacctggttcacagtaggtgctcagtaaagagtaaatcagtgaataaatgaacagtgttgaaaatacttgtaatcaaggggtattcccagtataattcaattgatgattcatccatccatttatttattcaactaacacttattgaatgttttatctgtgccatgcattcttctaggggtcaaagataaaacacagcccctaccctcaggggcttgtaatctgctaggccagagataggcatttggaatggtgattatttaacaatgtaggataaaaagatatatgaagtaagatgcctaacctattaagtggaggagggaagaatgggtgggtgaagaagggagagaagagagggggaaggagcaaaggaagtagagagagcaggagcagatctaggaaaatgtcctgaaggaggaagcctgagctgaatctacgaggcatattaagtaggtgaagtaggaggaggtaaagggcattccaggcaatgaggaccttctactcataatatttgggctacacttttaaaataaggctttctagaaaaaaatctgggtacatttcaaacatgcttcacacattttaaacacgtttcaagtaagaaacttgtgtttattgattccaagttaatttcctatcttcctgccaaccaatactttttgtgtttttgttcttgattttttgtttttcagaagttcaatcccttctctaaatacaggaaaatcaaataccagcatgatatgtgtttcatcggtatctttccctttgaagctataaaattggtttttaaacatacatctctgccaacccccaagaagctattgtgctggcaatacttcttttaaccgtttagagcataaagcctctagtggcagactaaaggctgcatgttgtctttcccaccctcagaaaagtatgaggatgaattgaatggaagatggaagactgagacatcaggcaggctttgcacatggcaaaataagattaaacgattattttcctttactccatgtttgttatcacagctagatgatttatagccactcctaagtgtgtcttgagtcctcatttgtggctgaagcccagagactatagaagtgaaagcaaacactgggatagctagaatgacctaggtgtgcagacgactctgacaggtccagaactgtctctttgaagcaaggatccagaggcattgtctttcgccattattaactgggatggcctatttcctatataaggaaatttctccttacttttcagccatctggtcaactaagaccagctggaccatttcaagcagctgacaaacccaggacatgcttggaatttaaaacgaaagaggccatacatagttttgccacatttggtcttgctttattccccctaccagaatgcttctaactagagattgcagtaagagaactacgaaaacagtaagactgatacctgtaggagtttttaaagatttgtttggatatctgttttagctctaaaaaataaagatgattgctccttgaatcaggtatatccccagctaatttaaacgactttcccagtatttctgaaagaagttggaaacaattattttttgtacataatcaggatcttatgaagttcttggataaagattaaaaagtaagaaagccaagcaaattgatctgcaggcctgcttgctttagccagatgtctgcatatgtaggagacttcataaactttccctcccgacatttcccaagccacagcaaattgaagagtcgttgatgtagtgagtgtgtgaaaaaaatatgcaaagagatgacacgtgagaattctctggggagagagctgaagcaccattggtactttagtttaagaatgttgttggcagcctttgcagggaagctgacagtgagagaagctatccaagctaggcttttgctcaagtcctggtgaggctcgtaagcctttggggatggcatatggaaattcaggattattttgaactctttctctttccatttcactaaaatgggtaactatgggtccaaatggcttgggttcttataaacaccacacagtgaggaaaaaaatgaactattgtggagcatgcaacacagtgtcaggcactatgttataatacatgatcacattacagacaagaagaaacagaacttctgtccttaagaagacataaacataaaatagaagattataattcagtgcagtaaaggcagatttttttacaaaatggctataataatttccctccctgtgtctacacccttgggtaatagcttcctcttacattgactgtaaacttgaccatgtgacttgtcctggtcaatgggacaatggcaaatgcagcaaaactagaggcttaaaaactgcttgcatattgaagctagctctctcctgctactcttgggatgctgtgaccactactatgtgactaagaccaggctaacctattgagtgataagagacacatggcccagttatctcaaccaccaggtgaggccatgcaaacacatgagggtgtccagccactgccatgtggaacagagacgatccatcccagatgagcccagaccaaatagttgaaccaaagaatcgtgaacaaataaatagctgtcattttaagctactacatcttggggtagtttgttacacagcaaaagttatggctgctaagaaggatccttgatctagtctggaacttcctggaagaagggacatgaggaagcagcacctgaactaaatttttttgaaaatagatgaagtttttatttggacacaaattcttaccaccaccatgttttaaataaaatgactgatattaactttagtgtccttggaacaagtctataataagaatataggataagaatataagaatatcgccatttagtctggtgatgttctttctaattttgaaaccactcttaaaatttaccatttcttccaggaagctttctcaaattctttggaaaagtttcctcatagctttccataagaagaagcctcaattaggcaattgttatgtgcctacctctctttataaaatatctctcatggcccaggaaggagcaggatgctgatgataaacacaccaatttgagcactcactaacaattgggcaagtttccatttttgtacatatccttatactaaatatgctcatttcatgagacagaattatgtgtttgtatacatgcatgataatgtagtcatttatgtaaagggtattatgtttatgaattaaacagagatatagtatggtaatgtttatgtaaacggcattatgtttatgaattaaaataaacatatatatagcataataaggaatattagaaagctttcagctgatgcagtaattttctgttgctgtataataaactttgctacttaaaatacccatttattagcttgtaattctgtaagtcaaaagcctggcttagcatgactgggttctctgcccagggtcttataaggctgaaatcaaagtgtcagctgggatgaggttttctttggaggttctgaagaaaaatatgtttccaagttcatttttgttgctggcagaattcagctccttgcagcagtagagatgaggcccccgttccttgctgctggctgttagccaggggctgctcttagtttctagaggctgtacacatttctttacacgactgtacacatttcattacacgtggtgccttccattttcaagtcagaaacagcacattagttccttcgtatatttcaaatctttgacttcctctatacccagatttaaagggcttgttaattagatcggacacacctaataatctctgtgttttaaggtcaactaatttgggatcttaattatatctgtaaaacccctccataacagtctctagatcagtgtttgatggaataactagcaggattatgcacagccaggactggaactcttggggtcttgggatttagaattctccctaccacacctttgtactggaatattctttggatagtctccctgattccattttgccttctatattgtattttcaacacaacagccagaaaagtcctatttagcacctccctgttgaacatcttcccgtagctccctgttgaacatcttcccatagctccctgttgaacatcttcccatagctccccatcccactcagagcaaaagccagtgtcctcactatggtgaacaattcataatctatcccctatttcctcttgatctcatatcccactaacctaccccctagctcactgcttcaggcacactgaccttcttgctgtttcccaaatatagagggcatgtgctctgggcccctgcaatgattgttttctgtgactggaatgttctgccctcagatagccacttgactaccttctctaccttctctaaatccttattcaaatcttatcttctcagcaaagcctggtcattaccactctgacctaggctctcatcaataccctgacctgattcaactttctaattttttttttgtttccccgcagtactttattaccttatagcaacactatcatttatatcaaactctattatggattatgtttattgtatattatctgtttcccttagcttgattataagctccatgaaggcagggttctttatctggcttgctcccttcaatagcatctagctcacagtatattctcaataaatatttgttgattgaataatgaatgaacatctacatctctagagttgggtcactgagaactatccatctaacctttatctaagatatgaaaagaataaaagggaacctacctagccaggcgcccccccgtttttttttttactggttattctttaccacagagaatccggctgcatatagtatgttattctaatataataacattttataagtttcacttctctgatagtatcaagtagtgttacatttctttttctttgatatatatttcttacagagtaatctaatcaaagatataataataaaataaaatagtggtttagataagagggcatcaagacagactatttttacctcagctttgcttcctcagcactgtcacaactaatttgggggtttctcggtgtgctgacgcaagcctccattgtcccttctcgcttctccagttttttaggatgcaggcttattctctgaattctgataaaggtgtctaaagatcttctcatctggactctatacagcagctctggaccaaaggtacagccccacactcttccacaggagcccaaatgccagaaaattagcacctttttctttatctagcaagaactgagtaaggttttattttccttgatcttaaggtgtcattaaagactatctgtgcatttgaatctaaggattgctttgaacttcatctaggacttaagaggccatgaactccaatctgaaacaaactacaaactaaagcaaaccattttccatcctttatcacaaaatggggactgggactgcagtttgctttccaaaaatgactataacttaaagaaactggaatatcaaatatattccagattacacatggattggtctcataaaatcttagagttctgcgttagtagagcatggggcctcagcaatcttgttagagatgagaaaactgatgttgatgaagattaatccacttttcaagagccacttgaagtagatgtcacttcttacatgaaccccttatggtttgccattaggtgtaaatggcctctcttccttacttccacgacgctttcttgcttccatgccactttcaatcattgcattctgacatggggcttagtgatcagggcccatgtgtacttgctctaacaaactgtactataaattccttttggagaaggccatatgtttttcaactttgcatgacccgtatgacttaaacagaagagcccgtaagtagttattgtggaagtactgtaaagagacagtgttcagtggctcctgattctctgtgatcaaggtaagaattagtgttggagtttgtcttaataaggaagggtctctaaagcagggacctcaaactttgctacacattagaatcagttgaggagatttcacaggtttcccagaccctaccacaaattaaaccaaactatctgggcatagggtccagacatcagcattttttttttaaaactaaaagtttgttctgattatttgttcttttttttttaacactttaagttctagggtgcatatgcacaatgtgcaggtttgttacacatttatacatgtgccatgttggtgtgctgcacccattaactcgtcatttacattaggtatttctccgaatgctatccctccccctgtcccccagcccccgacaggccccggtgtgtgatgttccccatcctgtgtccaagtgttctcattgttcaattcccacctatgagtgagaacatgtggtgtttggttttctttccttatgatactttgctcagaatgatggtttccagcttcatccatgtccctacaaaggaaatgaactcatccttttttatggctgcatagtattccatggtgtatatgtgccacattttcttaatccaatctatcataggtagacatttgggttggttgcaagtctttgctattgtgaatagtgctgcaataaacatgtgtgcatgtgtctttatagcagcatgatttataatcctttgggtatatacccagtaatgggatggctgggtcaaatggtatttctagttctagatccttgaggaatcgccacactgtcttccacaatggctgtactagtttacagtcccaacaacagtgtaaaagtgttcctatttctccacattctctccagcacctgttgtttcctgactttttaatggtcaccattctaactggtgtgagatgtatctcattgtgcttttgatttgcatttctctgatggccagtgatgatgagcattttttcatgtgtcttttggctgcataaatgtcttcttttgagaagtgtctgttcatatccttcgcccacttgttgatggggttgtttgatttttttcttgtaaatttgtttaagttttttgtagattctgtatattagaacttagtcagatgggtagactgcaaaaattttctcccattctgtaggtttcctgttcactctgatggtagtttcttttgctgtgcagaagctctttagtttaattagatcccatttgtcaattttggcttttgttgccattgcttttggtgttttagtcatgaagaccttgcccatgcctatgtcctgaatggtattgcctaggttttcttctggggttttaggtctaacatttaagtctttaatccatcttgaattgatttttgtataaggtgtaaggaagggatccagtttcagctttctacatatggctagcaagttttctcagcaccatttattaaatagggaatcctttccccatttcttgttctcgttaggtttgtcaaagatcagatggttatagatgtgtggtattatttctgagggctctgttctgttccattggtctatatatctgttttagtaccagtaccatgctgttttggttactgtagccttgtagtatagtttgaagtcaggtagcgtgatgcctccagctttactctttttgcttaggattgtcttagcaatgcaggctcttttttggttccatatgaactttagttgtttccaattctgtgaagaaagtcattggtagcttgaaggggatggcattgaatctataaattaccttgggcagtatggccattttcacaatatcgattcttcctatccatgagcatggaatgttcttctatttgtttgtgtcctcttttatttcgttgagcagtggtttgtagttctccttgaacaggtccctcgcatccctggtaagttggattcctaggcatttcattctctttgaagcaattgtgaattggagttcactcacgattttgctctctatttgtctgttattggtgtataggaaagcttgtgatttttgcacgttgattttgtatcctgagactttgctgaagttgcttatcagcttaaggagattttgggctgagacaatggggttttctatatatacaatcatgtcatctgcaaacagggacaatttgatttcctcttttcctaattgaataccctttatttctttctcctgcctgattgccctagccagaacttccaacactatgttgaataggagtggtgagagagggcatccctgtcttgtgccagttttcaaagggaatgcttccagtttttgcccattcagtatgatattggctgtgggtttgtcataaatagctcttattattttgaaatacgtcccatcaatacctactttattgagagtttttagcatgaagggccattgaattttgtcaaaggccttttctgcatctattgagataatcatgtgtttttgtcattggttctgtttatatgctggattacatttatcgatttgcgtatgttgaaccagccttgcatcccagggatgaagcccacttgatcatggtggataagctttttgatgtgctgctggattcagtttgccagtattttattgaggatttttgcatcgatgttcatcagggatattggtctaaaattttctttttttgttgtgtctctgccaggctttggtatcaggatgatgctcgcctcataaaatgagttagagaggattccctctttttctattgattggaagagtttcagaaggaatggtaccatctcctctttgtacctctggtagaattcggctgtgaatccatctggtcctggactttttttggttagtaggctatcattgcctcgatttcagagcctgtcattggtctattcagggattcaacttcttcctggttttgtcttgggagggtgtatgtatgtgttgagtaatttatccatttcttctagattttctagtttatttgtgtagaggtgtttatagtattctctgatggtagtttgtatttctgtgggatcagtggtgatatcccctttatcattttttattgcatctatttgattcttctttcttttcttctttattattcttgctagtggtctatctgttttgttgatcttttcaaaaaaccagctcctggattcactggttttttgaaggggtattttgtgtctctatctccttcagttctgctctgatcttaagttatttcttgccttctgctagcttttgaatgtgtttgctcttgcttctctagttcttttaatggtgatgttaggttgtcaattttagatctttcctgctttctcttggggcatttagtgctataaatttccctccacacactgctttaaatgtgtcccagagattctggtacgttgtgtctttgttctcattggtttcaaaggacatctttatttctgccttcatttcattatttacccagtagtcattcagaagcaggttgctcagtttccatgtagttgtgtggttctgagtgagtttctttatcctgagttctaatttgattgcactgtggtctgagagatagtttgtaatgatttctcttcttttacatttgctgaggagtgcttacttccaactatgtggtgaattttggaataagtgtgatgtggtgctaagaagaatgtatattctgctgatttggggtggagagttctgtagatgtctattaggtctgcttggtgcagagctgagttcaagtcctggatatccttgttaactttctttctcgttgatctgtctaatgttgacagaggggtgttaaagtctcccattattgttgtatgggagtctaagtctctttgtaggtctctaaagacttgctttatgaatctttgtgctcctgtattggctgcatgtatcattaggatagttagctcttgttgaattgatccctttaccattatgtaatggccttctttgtctcttttaatatttgttggttgaaattttgttttatcagagactaggattgcaacccctgcttttttttgttttccatttgcttggtagatcttcctctatccctttattttgagcctatgtgtgtctctgcatgtgagatgggtctcctgaatacagcacactgatgggtcttgactctttatccaatttgccagtctgtgtcttttaattggcgcatttagcctatttacatttaaggttaatattgttatgtgtgaatttgatcctgtcattatgatgctagctggttattttgctcgttagttgatgcagtttcttcctagcatcgatggtctttataatttggcgtgtttttgcagtggctggtactggttgttcctttccatgtttagtgcttccttcaggagctcttgtaaggcaggcctggtggtgacaaaatctctcagcatttgcttgtctgtaaagtagattttatttctccttcacttatgaagcttagtttggctggatatgaaattctgggttgaaaattcttttctttaagaatgttgaatattgtcccccactctcttctggcttgtagagtttctgctgagagaactgccagacatcaacattttttaaagctgctcaagtgattctaatgtgtagccagggctgtgaactgtaactctaaattttactgttatgtggggaagtgttttcactatgtttactatgtgtcatttaaagttcacatcaacccaacgaagtaggtactattattatccctactttatagatgaggatactaaggcacagaagggttaaataccttgctcaaggtcatacagagctagaccttaaactagagctagatctcgaacccaggcagtctggctccaagttggtgtgtttaatcattatgccataccacttttcatagtgaacaattattgagctccttttagatgcctttcattgtgctaaacgctttacatagattatctcatgacatccatatgaggtaagtagtattttgcatcaccaatttatatgtagggaaactaaaacataaatagcttaagcagtttgtggacagttacatttgtagcaagtgaagaacccagatttaaatcagtagtcaattcaaatcctctaaaaggaagaactaagaattttaagtcccatcacattgtccatactatgctaattataggcggtagcccttatttgtgaaataagttattttctagactgtgaaatccctgtcttttggctatgcatactgaattcactgtatattacatgcagttcacatattgtttatcattttattgaagaggcaatgcttgcctgattgccctttctctttcatattaggaatactttataatggttcctgaggcttccagtatgcaccctggatttgttgacaagcacattcctcctcagcacactttctcagtttaactcagttgctgtttattgcctctatcagctgtagccattttaaccatcattttcatcaattcacagcatgtgagattatgttaagagcccaaccaggtataagacattaactgtcattcagtggcaactaaaaggttgaaggaaagcacattggatgatcattgacaataaaatggttaaaaagattgtagcctattcattcaataaaataatagatgtaaataaaaatgaaggaactgcagtcacacataacaagagatgaatctctcaaatctaatgttggggaaaagttaccaagaacaaaagaatatttgctgcataattttatgcttattcagttgaaaaagagcagggaaagttaatctatggtactcaaaccagaattatgattggatttggaaattagggaaagtagcgattgagagggaccatgaagagctaggttttcaggagcaagtaatgttctatctcttgacctgggtagtggttacatggttatgttcgttttgtggtgattcattaaactatacacttgtgatctgggtacttctcaatatttaaaaaaataagttaaaaacggattgcaacaataatgaatccaaatagagaacactcacataatttaggaagtttcctctttttccttttccagaataaaaataatacaagctgatatttattcactctatgtgccagacctgcttctaagtgctttttattcatatattatttaatcttctcaaccctataagatagatattattggtcttagataagtaaattgagtctaaactttacaactaataagtgccaaagccagaatccaaacttcactggaccctaaaccctattcctttttcactatgctgctctccttcccattttatagtgactaatatcccttcaacctttaaaatgtatgtcctccatgccagttacagcttgtacgcttaagggttgattgatgggactggagggttttggcagcctagagattctttccatatttaagttcacaattttgagtaatcacagtaaatcctccatctagttctgaattctcactggaacagtcccaccttttatctttagcttcccattgctgtttcctactcacttcctgaacaactctttcgtatggaaagggttattaagagctttctgtcattggagagaatctgaaggtaggtacaagatattaaacagaaattggcacctaataatgtttcttgccctatgtaaccctaagtaaaagagttcttaaaaaatgaattaatattttgtaattggctcatatggaagaccgtttcgttttacaatgaactttgttagttccaaaccgtatgtgtagatttctctttttgtgggactctgtagaaagtatgctggacaaatacggaaatagcattgattataggattagtctaatataatttcaacaggcaagaattaggtaatggtcatagacacagcagtccagactttcaagtatagtgagggtatcgtggtttgacagcaccaagacgtaaattcattttggggtatactaatgtccaggcatattggggattgcttgttgggccaggcataatggggattacatgaggacaaagatgattcttttactcatttatttagtttttaaaatatttacaatatattctgaattctaagacatactttttcaccttttcacatttctgagtttgggttgcgtcttaaaattgaaggcaaaatagaatttaattagagatgtttgccttagtggcatataaaataatggtgcatcttatgattgctggcatcttagatttaatgaactactatcctaagcttctagagccagccacagtgcttggcactgggcatacagaagtgagtaagacagacatgttctcagccctcagagagctcacatcccactgtagagacaaatattaagcacaaattaatagataatgcttattaagaagtaactctgtgtgtcatgagaacatgtaagaaggaaactggtgcttttccagttttcccaaggaagtgaaggctaagtgggattttaaggcttaataataggtacctatataaaggtggcagaggacaaccccagaaagggaaactggtctgtaggatttgaagttggaatgagccagtaaacttcagagaattagaaagaaagactgtgtggctggaatgtagaggacaaaaggggaaatggcaaacagggaggcacataggtcacacaggacctcatgggccctagcaggaagtttgagtttcctcattatggggatgtaacataatccaattaatttgtttaaaagggctgcactgattactgtgtagagtaagatttgagaggggatagggtggatgtagggaaactagttggggagctacagctataacaagggagaggtagcttaggcgagatactggctgtcggaatgaagataaatgaatggattcaagataaatattgaaggtagaattaatgggacatagcaattgattatatataaggaattggtggagacagaaatggggccaaagccaactactgaagacacatcataagggatgaaaaaatgaagacccataggcttgaccgaaggacaacacatcagggttggaaggaattggggctttgagtacagcctggtgtcttgtaactcaggcatgaataatagagaaggaaggctgtgaggaacagtgaaaagccttccccataaagcactgggagcacaagaagcactgatttgtagcttacttaccaattagtgtcattaggtaccgaagcatacttccccatttagggctattgttggagcacagtgtgattcagtagtgcccatctgaaccagaaaagtagtgggagagttcattgcctgtggttttcatcaacaggaaacagtaactgcagccctacctctgtgacaccaccataggttcatgaccatcagcctttggcagaaaacaccactcaggggtttttaaattgagatgtttagaccatttcgatttcctatgactgttgatatgtttaggtttaaacctaccattttgctatttgtctttcatttgtcccatttgttctttgtaaacttttcctaccttcttttggatatcgtattttttaatgcatgtagcctttgttagcctattgtccataactctttttgtgttttttaaatgctttagggtttatagtacatatattttacttatcacagtctaccttcaactaatattatatcccttctcatatagtataagagccctacaaggcaaacttctatttcttctcctccagcttttgtacaattgttgtcatatattttatttctttatatatcataaaccccacagttcatttttattatttttgtctaaacagccaattatcttttaaattattccactaatttgaaaaaatcttctgtattcaccttggtagttaccatttccaatgtacttcatttcttgggtagatacataattccatctggtatcatttttcttttacccatgggaattattttaacattttttatagtacaagtttgctggctgtaaattatttcagcttttatacgtctgaaaagtcttttatttcatgtttgttttaaaaagatatttttattggttataaaatattagatggaccttttttccccctaataagtagcttaaagatgtttctctaattgtcttcacacttgcactgtttccaatttaaaaatctgctgtcatcttatatttcttcctgtgtacataatttgtcttttttcctctggtaattttaactattttcatttttatctggttttgagcaatttaattatgatgtggctcagtgtaattttcttaatgtttcttgtgcttggagttcatcaagcttcttagatttgcagatttatagttttcatcaaatttggaaaaaatgtatccattagtttctcaaataatttttctgtacccttttctgtatcctctccttcaaagacttaaattacatgtacatcaggctatttgacattgttatacagcttactaagcatctgttctctttttggtcctttatttttcctcttagtccatttgtgctgctataacaaaataccacagactgggtaatttacacagaacagaaatgtattgctcacagttatgaaggctgcaaagttcaagatcatggcattggcaggtttgtcgtctggtgaaggtttggtctctgcttttttttttttttttttaataccttaagttctagggtacatgtgcacaacgtgtgggcggtctctgcttttaagatagtgctttgcacactgtgtcctctggaagggaggaacactgtgccctcacatggcagaatgcagaatggcaaaagaggatgaactccttccatcaagcccctttataagggcacctaattccattcatgagggtggagtcctcattactcaatcacttcccaatactgttgcactgggaattaagtttcaacataaattttggagaggacaaaacattcaaatcatagcactctgtttcattttagtttttactgtcttattttcaaattcattaaccttttcttttgcaatgtctaatttgctgttaatctcaattcagtatattttccatctcagacacagtactcatctctagaaatttgatttgggtcttttttatgtcttccatgtctcttgttaacctagtcattcttttatctagctttttgaacatatagaatgtagttatagtaggatttgatgtccttgtctgctaattctaatatctgtgtcaattctgggttggctgcaattggtttctttttctcttaatcatgtgtgttaatttcttgcttctttgtatgcctggtaactttttattagattccagacattgtggtttttatcttgttgggtggtggatatacatataattgaaactttctgggacagttacttggaacaatttgatttttttttgtcttgctcttaggattttttagataggcaagacccctttgagcactctatttaataccttatgaatgatcaacttttccagtctggcttatggaaacaagaactgagaactgcaagttctgttttctctaattcttttgaagattcttcccctagcctcagttactcttctcacatgcatgcacttatcagtactttgctgagtgctccagaggaatcctctgcagacctctggagttcacacatacatatacaccctatagacagagggagagagtgtatgtgtgtgtatatattgtcttgtgtgtgtagacatatatagacatacatatgtatatgtatatatatagacatacatatgtatatgtatatatgtatatacaatgtatatgaagacaatatatacaagtgtcttcattctggtactcttctctgtgaacttcagcttctgtggactcaacagaccctcagatccatcttttcaattctgggaattggttgggctctgcttagattcctcctccttgcatcatgacctagaaactttctctagacagtaaactggaacaatagtaggcctaacctcatttgtttcctacctttcagggatcactgcccttttttacttgatgtcttttgccttaaaaaccattttccaaatatattttaaccaaattttttagttgattcaggatggagggtaaatgtggtccctgttactccatcttgacgttaagtggcaatcactgccatggttttgaatccttgatttctttttaaaatttgacatggaatgtgaataaattgaatgtgacaatgtagataattgaaataattatcacaactagcattagcttgtaaatgcttagttcagttgttctaatcaatgaagactatttattaaatatatcatccatgaactctaagactgagaacaaatttttgtaaaggaattaataattggtatgtacagtaataaatattaatattctaatagaaatcagttttgttctacaaaatgtttcatcaaaaggtttgtttcaaggtaatatcgttcaacatatttaggcttataattgctgattcttaactctttttaaataatacactgtagactgctttggggggtaggggaccttattcccatccagcaacctctttctacatgtcaacgaaccatttttcttaatggttcatacttaacgccatggatgctgccactaaatcacatattcactttaatttggtttaaatcaatttaataaatattcaaggtacacatactgtattaggtattaaataggtcaaaaagataataagatagtttcttccccatgaggaatttatgatctagtacaagagtcagcaaacatcatctgcaaaggaccacatagtaaatattttaggcttgcaagccataaggtctctgtcacaattattcaactctgcagttgttacacaaagacagccatagacaacatgaaaacaaatgagcatggttatgttccaataaaaccctgatccaatggaaaaaagcagagaaacacaacatagaacaatagatatatcacaaagatgaccagaaacaagtgtcatgggatgtcaaagaagggagattcatatcttaatacttgatttgtaaatacaatgaattggctaggtgcagcacctcacgcctataatcccagcactttgggaggctgagttgggaggactgcttgaggccaagagtttgagaccagcctgagcaacatgatgagaccctgactccacaaaaaataaaaaattaactgggtgtggtggtgaacacctgtagtctcagctacttgaaaggctgaggcaggaggatagcttgagcctagttgttcaaggttatagtaagctatgcttgcaccactgcactgcagcctgagtgacagagtgagactgtatctctaaaacaacaacaacaacaacaacaaatgaatgatttaagagaggcagcaatatctaagctgatgtatttagacagaattacgaaaagcaggaatgacagggtgtattagtccattttcacactgctataataaaatacccgagactgggtaatttataaagcaaagagtttaattgactcatagttctgcgtggctggggaggcctcaggagacttaaaatcatgatggaaggggaagcaaacacatccttcttcacaaggaagcaggagagagaagtacagagcaaaaggggaacaaccccttataaaaccatatagtgcatgaaaactcacttactatcatgagaacagcatgggggaactgcccccatgatctaattaccttccacaaggtccatcacccaacacatggggattacaattcagattacaattcaagatgatattttatttttatttatttaattttttgagatggagtctcactctgtcgcccaggctggagtgcaatagtacgatcttggctcactgcaacctccgcctcactggttcaagcgattctcatgcctcagcctcccaagtagctgggattacaggcacccaccaccatgcccgactaatttttgtatttttagtagagacagggtttcaccatgttggccaggctggtctcaaacacctgacctcaagtgatccacctgcctcggcctcccaaattgctgggattacaggcgtgagccaccacacctggcctcaagatgagatttgagtgaggatatagagccagatcatatcacaggagaaaacctgaaataactaacagtgatgagtaagcactgaagattttgggaagaagtacatagttctgtttggctggtatgttgattatactaaggagtgtaatagaaaaataaggaaaatgtaaggtctttggataaaccaaggcagaaataatgtcttcctcttgtagacctgcgaagctcctgtctttggtcttttattttattctgccttatattatggttatttttgcacttctgtttgttcctctactagacaatcttcacatttagggcagtgattatatcccattcaactttgaattctcattgtttctagcacagagatagaacccagcagcagagcaaaaatattgcatggttagtaatgaaaacatccacttcaagcccaaaccatttggacttatcaaatagacattgaggtcctacagaaatggtttaaagactagcctactgacaaggaatgaaaatgttcattccttatattagcacctttatttttcaacaagggctttggttagagatctttcaactttatgtgcgttaattccctcataatgtagatttgaccatattagcagccacttgaaatacaacttctaagttgcaattctccacaatctgtttcgaggagagaatccagatggataagtactggggttttagtttttaatcaaaaggttaattaagtgaattaatctttatgtttgaatacattttgcatggaatttggagtaaataaatgggttaaaatcaaatcagtataatattaaaatgaatactaaagcttaggaaatgagttaaaagcttatgcgttctattatgtagcagcagacaaaattgtctatgtcaagtttaacctgagaagagaggaaagctgctaataaagtattctcaaatcctcctggaatcactagtatcgtcatagaaatcattttttaaaatgtataatgtttcacagacatagtttccaagcaattctttaaagaaaaacaccaagcagttagcatttaaataaatcttttgaattgcaatgagagtaaataactgcagaattataaatgagctgtcatgtccactgagaaaatgaagacagcaaaaatggaatctgaccacacacatgtggctgagggaagaagaggccgaggataatttaatgaagattttctagaagcaaatagtgccaccatccgtcatgaggatctgtttctataacgcttgtgtgtctttgagactacgtaggtggtagcttatgagtagtaatgttcttttgttagtaaatgtcaccaaataagcaaataagagaaacatgaaggccaaaaactgtgttactattcaggagaaaatggacggtttagcaacaatacaatgtagacttcaaaatatgaaaaatcaaggaaatttctgtcattgtctttaagggcctccagagaagtattaatttgttctttatgtgaatttaatgagatcatgtgaaatgtatgtctcatgttatgtctattgaaaacaattcctagggagaaattttgggtactgtatatttcctatccccaaatcatggggatcaaacattgcagtttgaattgagagcaaagagatgcttccccttgtgccctaatagaatcactgctcctggtatttcctggaccaactgagattgggtcaaatgaatatgatagggtatgtccaagaaacacaggagccaactgaatgagttcccagtgaccaaagctggaactatttaagcaacaaaataagtaaagtagtattgaattattacccacatcgtaaaacaaatatccataaggtcatactgatataaataaatgattgcataaaaataattgaggtagaaaaaacaaatctcccatgcagaattccaaataactcatatagatatattctgccctcaaggaggtagagcataactccctattacttaaatgtgggctgcccataatgacttcctcccatagggtacagtatggaaagtagaaaaaagagtaactttacagtagagaaacctgacaaatacgaccttagtcaggtgatcaaggtcagtatcaacaataagtcatattgattgtatataacctcggtatgatgtgatgagaagggcactttatctctgtggtcttccttccaaaaacatataatcccagtctaatcatgaggaacacatcagacagttcccaatggagggacatgttacaaaatacctgagtggtattcagcactgttaagttcatcaaaattaaagaaagtctgataaagtgtcacagctaaagggatcctaaggagagaatgataactaaatgtaacatggtatcctggatggaatccttgaacaacagtaagaaaaaaagttagataaaaactaagatatcagtattgatctattaggtgtgataaatgtaccacgccatagtaagatgttaacactaggggaaactaggtgtgcggtttatgaaaactgtattatctttacaactttctataaatctaaaactattctaaagtttttaaagtttattttaaaaagtgataaatatttgaaagcaactgaaatgtctcagaatctaagaatggatgtgtgcttaggcattcaaaatggactggaaggctggaaaaatctggaggaatcctctttctctgtctctgaataagagacctaatttgttctattctctctctcattcttccttgtcccttatccacaaaaggtagaaagcctggctatggacagtgccaagatattcatgttaaaaaaaatactagacacctggagaggaactgctctttcttttgacccaattccacattctcagaggaaaggatcattcactttgaggcaggagttcacttctgattcctatcatctgtgatgggggtagggtcagggaagggactctgattagcctagcttaggtcccctgatcaccctggacaaatgaattgccatcaagtgagtagagttacatgtatgtacctgacttcccagtgtatcacccctgtggatggtggggaactatgggggaggtggaatgagaaagaaaaggcgcttctcccaggatgaaaagtggtggaaaggacagaacaggttccacccaataaagctaaaggaataaaaataaagtatctaagtgagagagggagtagacttaatatgaaacataaatatttagcacttctgaaaatatgcaggtctaaaatcttctatccacacttatgaaatctcctaagctctgaaaaccaaaaggtttcccacagctcatttggcagcaaaacctgttctgaactgatgggaggctaattataggctttgcatatcccatttagtgtgaatattcatactgttttccaaagaaatattaatgtgtttgattacagggtcttccccaagccccactgggagtaaggggcatgtaatacattgtatacgtcacagtattaccttaataaaatctgaataactctgagttacagtgcataattgctcccacaggtttcatataagggatacatttataatactacacataatcacataaataaatgtccatttttatgtagctctgaaaacaagaaccacaaaaataaaaaccatacaagaaaacaaacatgctctttttttaaaccatctgaagaagtcctggatataagcaaggctaatactagtattacattttagaaataaaagaggggtacttagagaagattttactagagacagggtagggtctgagtaccaggtctcctaaccagtaatccaatgtctttgaactgccaccctgcatttcagatgaaaaagggttattgaaatggcattgttagcatgtaggtaaaagggtaacaaaacaacttaataggtggcttctttgatatttggagaagtatgaaaaggaaggtttgccaaggatttttggggagggtggtggtgggaggatggagtagagttgactatataggaatctgcacaatgtactttcaaaacctataattataacttttgccatatcttcaaaaaaacctattttcatggtatttttccttgcttttgcaactaacagctttcatgatcttctttattatttatatgaaggccaagtttcaaatattgtttctcattcaaataaacatgtggccatttactaatgaggaattttattttgttatttttacattaatggtaataatgaaatattatttttatccttccataaaccaatgatttccattacttttgggtttgaggaccttccttttaatatcaaaatatgccatgtctcctagatgaaagtaattttatgtttggtatcaacttcctgaaaatataattgcaaacacaaaaagctactatgaattcaggtacattcacaccagcacctatatgcatttgataattaggagcatataaatagaaagtataatatttattctactcacaatgtgttgtggaaatatgaattcctagaaatgtctaaatctccttgtattatagtccattcctgttttgactaatttaataaaatttactaatattaaaagccaaacagagtaaatggaatttaaaatatatatttgatatataattcaaataccataatgtgcttagaataatgcctctcacaaaagtaggcactcaataaacacttgttgagtgaatacctaaatactcaaattcttggtgaggcagtcttctacagtagataaaacatccagggttcatacttccttggatctgaatcctttgttgctggtaaatacccttgatcaagccaattattacacttgctacctcttaaggctgctgtaaggtcttacatgatatattccgtaagtaaagtctaatgtggaatattcaataaaaggtaattatctttctctctcttccttcaaattcctgctaatcttcctcaaggagtcactcaaacttccttcccaggagactcaatgggaaccacttcccagtgctgagaaatatgacactgtagaccttatccctcatgagggcagagaaccattgtgtacccagcacagcagacatcttggtatgaagcaggtgttcaatatgtatttgttgaatgaataactagaggaaaattaagaatttcccaatggaggaaatcctgtatcagacaaggaaatccttaacatttaaatagttaaattaggcaacttaacagtcttagaggaaaattccctcctgcactgcaattacttatgtttttctctattcagtgacaatgcttccctattttagtgccagtgtgggaaccccagggacaactgtcaaaaccagctcttcagttctgtgccctgtgctttctacccctcaaacactgcacatcattagcaatgctgagacttgtgttgcctttgtaaaatttctaaattctaacaaatgcctggagaccctaccaaaacaactgaaactggtgtaaacttgaggaaagtttactctcatttaaataaatccctgtttgttcacttgccttatttgttctttttactgtgaatgttttcatatagatatttaaaaactttattacttggcagaatatttgtaatgatacaaagaactgctacacagatgttaaaaatattcatagtaaaaagtttttaaatgatatatagaacaagtatatttcatatgtgaatttcacatatttggtgatccaagtagtattcccaattggaagaataccttgcaactctgttcctatgccattgcatggtttctccttctttgcattgtcacagtatagtaatgcccaacccaaaccatggcatgtggatacacattttaaattgatataatttttaatgtttgctttccttaaggatttgtgtttattttttttttaaagcaagtcttaaacttcccactactttgccaagagataggcaatatacaacaggcacttttaagaaaggaaacgtgcaatgcctcaccatgtttgcttggaagatccctaacattacgtggtaaactcatcacaaaaaaacgtaatcactcagcaaatatattgcttgtaccatgagcaaaggaatatcatgcaaatgaaaagaaaataaaaaagagctaaaatgtcctgttctatcgcaagtaaaacatttgtcagacacaaagtcttcttttcctttttctcagagtaaaacatatacattaaaatgcataaaatgcccatgtacattaaaatgccataaaatgttaagggtacaattcataaatttttatatatgtatacatttcagatcaagatatggaatatttctagtgtcctaggggtaactactgttctgacttgtttaactattgttacttttgcctcttactgaacttcatataaatggaattttgcagttcgtattctttcataactggcttctttcacaaaactcaatccctgtgggatgtatctgtgttgtttgtataactgtaattttttcccttttgttgtccgttctcctgttggtgggcatcacttccaggttttagattattatgtattaaatcttctatgaaaatttggtacatacttttgatggacatatgcacacgtttatcttgacaatatatatatatataggagtagagttgctgggctataaggtattgacatgcttgactccagtgtgtattgacagttttcccaagtggttgacacaatttacagtcccctagcaaaatatgagagttccaattgctccacatccatgtcaacactcattattgtcaggttgctacttttttcaatgtagccattcagatgacgtttagtggtagctcattgtggttttaactggcatgttcctaactactaatgataccaagaaaacaccttatcacatgctcagtagccatttagttgtcttcttttgtgaagtgcttgatccaactttttgctcattattttcttacccaagcacaagtctggatttgaactctttatccaagtactctatgttgagttctacatgattttaataaaacagtctaattaagtttttcataggtaataatttttgccttttttgaaattctctgtggtgttttcaaaagcagtggttttaaaaggaccattttttcaagagcagcattctatatggcaggaattctgtcttgcatatattatcagaagtaagataaaatcccacagtttggtggttcagatgagatatttgggttcaagccatatgaagttagttttatttacatacctctgatacctcatctataaaatgaggataataataggacctgcctcatagtgttgaggagatcatcggaatagacctacatgaagctctttgggtgatgcctagtacattgaaagccctcattaagtttggctattggtaacattcttggggtgtcatattaggccctcattgtgtccgttaaggttagaacattatccaacacactggggaaacattcacgtgttgatctggaccactcagacataaactgggtggattgggtctgaatctccaggtctagctgtgtgaaatgaccactgaaatgattactgaagcctgttgtaaatgtactttctggtccatctggcttttcagacccaccatatgcctaatggctctgttggtatatgagttaggagggcccatgccaaattatacatattcgtgactggtaaattgttcagtctggctctgggtagaaactaaaagatttaggagggaaagagcagctccctttacaggcagcccaagacacaggagcactttaataaaatagaaacttaggttccacaagaatcatcttgtaaaatctgcagtaacactcctataaaggttatatattccagggcatccaagtggccagagaaagcaagtcaaatgtgacaggagaggaaattgcctaaataagagaacctcctctctgccagtaacttacagggggccatggggtttttctctcattaagtccatctgcctgggctgggtgcctggcagttcttctgctaatgagaatctgctcttcctaatactggaagaaataagtcttcatctctacctctttgcatgtgccagtggcatgtcagaaacaatttttctgtgcatttcaaggcacagctaagtatgattattcagtcacccagctccttggccattggatgcagaggacagagaacagcgctgactgcctgtccttcttctgctgagtcattggatttcagaagggaatcacatcctttatcaatctatgccatcaagatattagcttcccataaatgcttatgtgaaaatgtgcaatgatttgcatctggtcatgatttttttttttttacaatacatcatgttatagctatattaatttcttactattatatatccatatagcatgtaattgtttttattttgcttagtttttttcaactttctacttcctgaattttaagaaattgacacaggaattatttggctcaagggaaaaatagactttgagtccttttgcatattcttattgatcaggtatggtaggcagatttctaaaaatcccttttcccatcaagattacatgcccttttcccctagaaccagtgagctgataagatatcatgtccatgattgcatcatggtatatggtacagttgaccctaaaataggaagatcatctaggtgggccagatctaatcagactatcccctaaaaacagagatatttctggcagaagagaaagtcagagagatttgaagcataagagagattcagctgtggcttgaaaatagcggtaaccacaggagaaggaatgttggcagccttaagggattgaaagaagcccctggatgacagcgatcagggaaacaggtatgttagttgtgtaactgcaaagaactaaattctgccaataataggaataataaccttggaagaggactccaagctccaggtgaaaacacagctggttgatgcattgaattcagcattgtgagacacaaaacactcagccatgatgtgtcagacttccagcctacagaagtgagctgatacatgggtgttgctttacaccactaaatttgtggtgatatgttaggcagcaatagaaaaggaacatacctggtttcttctcattgcattcttttaaatggctgaccagtagatgataattgggtagaaaaaattaaatggcctgagaaatacccggggttagtttgggttatttgaaatcatggggttatttcactagaaagagactccaattgacaccatcatgctcataattattgcaatataattgagacaaggaagaaagaacatcaagtctgccagtgctatcataagagttcaccaggtgctgagtttgacaaccatttttccttcaaatttgaattataccaggaatgttatttgctttttgagctctccttttatatttggtgtatagagtgcttccccattcctgtaacaacataggcaaggttcagtagtgccatgacagctccatcaatgcaatgggaacatgttgacattacatgtctttgtcacaaaatccactattaaaacatacatagcctaggtgtcacaaggtgctagaaaagtggaaggtgggaagtggtgattaaaaatattaaatgatttccagaattacattacaggaaactataatatatggatccagaaatcctggaagagaaacaggatgaaaggatgggtcctgggtgtgtctaacacagagctaaaataagaaactgttgagagagaagaatacacttctctgtcccagcagctcctgggaagagatgtgtaggccttctactctggtgtggtccactcaccttgggctctgctttccatgatgtgccaccaatcttgctggattttctctacactcctgacctcctttgcccttcttctgtggccaggaacagagccctttcagttctcaggataagatttttttcagaaagatttccccataatagtgcccaaatagtgctgttttccaaagcactctcctcaacagaggtcacatctcttgctttgttggatgagtttagatagactagtgggatagtcgaatgaagaaatacagtagttttttttaggaagagggaaactgagggtcatggattttcataaatgaagggggcaatctagatatttagaaaatccctctttcagagactatgctaagctttctaaatattataatagatatattctttacagaaaaaagtgtggttttcatgacctgctacttcaaatgagataagaactatggcattctctacagccaaaatctcaaaataaaaagcccagggtgtcaaatcagggtgatttattttattatccttactcacagtgtttcttttgcctacataagattttagagaatggattttattgctttttttgttcaaattaacatgcttttaataaaactagaaggcttgttctaccaagcaataattttattccctacctaaacgagtggttctaaattatctaaagtattactctgtccttaaacattcttgctagtcaaatgctgatttgagggaaagacaaacagaagaaaataattcagttcagtatcggcttttcagtttgataaaagcaatttctttcctacttgcttatcttctacctttctagtgctgaactctagtactaatcacagcactttaacgggtgttgtaaatgctgttcacggttggatctctgaaaacataatacttaagccttcatcttcaatgtgaagaagaatttggatggtagcacgaataaaattgtggcctgcacaactttactatatggccattaatgagaaatgttggttttaaaaaactgatgtgacttccatgatccatattaatagcataggtaggtaaagatgaacagaaactccatgtttgctctgtgcatggtttgattaattgacttgggtagacaaatgatgattgtagggtggagggtatatatttccttgatttgagccacaaaccctctttacatacagatcaaagtgtctaatacatagtcttcctttccttatactagtaaaggtgagaatttagttgatgctttcatttttctcttctccattcctcatggctgcacatggttcatatttttattgggttctacttcccagtatcttcctctgggatggatcatctatttgtcaacagaaaatgagaaaattatggagaaatgacagtaaactctatgttccctcctttcctctgagctcataattagacaccgtgcccaaatatacgtgcaaatggcagagccatttttcaaagcaaaatactttgaacatagatccaaacaaaacacaactctaaattcattatctcacctctttgcaattaacctaaaggagaaaccagagcaagaacacaccacagctttcggtggagtccacctggggcttgctggacttggtgcatcattagataacttgttttcccacagagtgagatagatgtgccttgaacaataattaaagggctttcatctgttgggttaattaaaactgcccatttgtttgcctattcccatgctttgctgtcttccttgtacaatacctccattgatcctctgtgagctgagaagtatcacaaatttagtctacaaaaaattagctcttctaccttccaacctgactgcatgaatacaccattaaagcacttcctctgaaaaaagtggagacagttggacaatgctccagaagaccatgattaagtagttagggaggggaattacattatcctaagaaataaaaatagccaatttaattgcatgccaattatgtaccaagccctcttctaaaaacgatttctacatattatgttatttaatgcttaacacaaccccatatggtgaagacactgctattatacatgaagaaattaaagcctacagagattaattgtctagacttagactgcatagccagtaagtggcagggacaagatgagaacctagagatttataattctgaagccatgtgcattatggctccattctaggttcctttaattggcacaaaatactgtacttgtattgactgcttacttggtactgggcattgttttgaattctttacctgattaatattttaattaactaatttaatcaaacaacaaatgaggcagggactgttactagcccattttatagtttcataaactgaggtaagagaatctcagtaacttgctatcttcagaaaggacgtatggcagaactagaatttgaattcagaaaatcttgctccaaagactgcacttttaactgctacctctccctgtatcactaaataactaatttgaacctttcttgtgataggaagtcagcaaagtaaacttaatttgaggagccagtctcagtctcataccagtccagtggacttgaaagaggataactgggatgtgcaggtagacatacgatagagaagacttagggtgatatagtccagaggtgggagtttaacaaaggtagagagaatcaattagtggagaaaggtatgtatcccagtggcaataatttcacagctttacctagggaggcacgatcttttaattgtgttaaaaataagaagtgacagtttactctgggcttccactttcccttcttgccgtatgtgtcccaggaccttgtaaaagacagtgacaaccaccttggggcagggctttacaactgcaaaacctgattaaatcaagcaaaataggtcaacattccgccttcatattagctgtacagagcctgacacggggaagcatgaacagatgttgggcagtgcacagagggatccaaaagcatctaattaaacacagagaaaagtgcagaaggaaccaggagagttacaagctcagggctcaccttggtacagggagattcaggagccaagagccattggaagtaacaccaatgtgggtgccccagaacacatttgtcccaaacatttgtcttcagctgtggggctgacagatgcatgaatttaagctaaagactgatttcaatcatgcttataagagtttgtataacatgttaaatttacaaatgactttcccatccattgtattattaatttccagagcagccttcaaagacaggcaggagtagatctcctttacaaaggaggcaattaagggtccaagctctactaccagtgcttggcagtaccagagtcggaatccatttcttataactcccagtctgtgtatacataaggctgaacagggcaatgtggagaaagggaaaacaggagaccaatgggaccctgctaatagaggaaaacatgctacaagtcaggagaatgggtattaagagaaaaatggtgagaagctaaggaaaaacaccatttattttatttaaggtaaagatggatggatatttgtggttatgtagatgaagaagcattcacatttatgtggtcatttatctagtcagatcatgggaaggtacataaaagtggtggcttttgagatggctatgatattcttagggagaaatgaagtagagagaattccaaggtgaaagagatagcttgaatgaatgtaaaaacgtagaaattaagggcatagatgaagaaaaatgaattgtccactttaagtgttgcaatggatatgtaaaaggaaatagtgaaaaacaaagctggaaaggttggaggataatatcatagaatcctttaaatgccaggctaaatagtctgatcttaattcattaggctttgaaaagccaacattagtttacaacatggaagtaacacaatgtctgcctcatgaaattcttgtgagattttaatgagaagttgatgcaaaaatgctttgtaaaaatatttaataaattaatataattgtattcctttgtttatgtaacaagtacttattgagagtctgttatttattaggcatggtctaggcattttacataaacaaataagacttatcactatgcattgaagcttacagtctagtggggaaaatgaacatttaaataaataatcacgtactctaaggtaagtgtacatatgatattatgaaaatacagagggtttgatgaactcttcctggaagaatcacatgggaaatgatatttgaaataaatcttgaataaacatagatctaaataaagtagctaaaattattaacttctagaagaaaacagcagggaaaatctctgagacattgggttagagaaagtcttctcagatcacaaaaacacaaaccattaaaaaatgataaaatagactttattaaaattaaactaacatttaagaaaatgcaaaagcaagccatatacttggagaagatatttgtaagacacataactgaacagaacgcttatatccgaaacacaaaaaagagctcttaaaaacaatgggccaaaaaatttcaacagaccctgccaaagaaggtatacaaatggccaatttagcctaatttaacttaaatttaacaatttaatgctcaacatcattagtactaggttaatgcaaaataaaatcatgagatatcattatacacctactagaatggttaaagtttaaaagaatgattaatgttggtgagaatgtggagcaactgaaatcctcatgcacttctggtggaaatgcaaaatgtttaaaaataatgtggtagcgaattataaaattaaaaaatatggctgggcgcagtggctcatgcctgtaatcccagcactttgcaaggccgaggcgggcgaatcacaaggtcaagagatcgagaccatcctggccaacacggtgaaaccccgtctctactaaaaatacaaaaattagctgggcgtggtggcacgtgcctgtagtcccaactattcgggaggctgaggcaggagaatcgcttgaacccaggaggcggaggttgcagtgagccgagatcgcgccactgcactccagcctgatgacagagtgagactccgttttttaaaaaaaaaaaaaattaaaatatacttaccatgtaacacaatgatcctattcctaggtatttacccaagagatattaaaatatacatctacacagagacttgtatatgaatgttcagagtagtaatttttacaatattcccaaatacacaacccaaattccatcagtagtaggatgagtatgaatactgtagtgtatctatactatgaactttaagagtataaggactggtggtgatcattaaatatatgtgtacctatagaactaaaactaaattatggctataaagaagaaaacatagtagataatggctttatgttctgacaatgcagatacagtacatctagcaagaattagagatggagaagaataaactcatgaccttgtaatttaaaaaagttaggccactttaaattaattgtatttttaatgttgagagattaaaataacttttaaagtaaataaagtccaagacgcaatacatgatatttcttcctaatatttaagttttctctgacctgcctaatctgactccaaatattcctaagtcttcttccctacctctcatcaggatacatggatttttactgcttactctaaaaaacatggagtttaaaaatgttaagcagatataaaatgattttctaaaagttgatcattaaaacacttcattgttctgaattagttgacaactatgaaatgattgttcaatgcaaaaattctaggtaagccaaaaaactaccaagttacagattcatatgacaaataatattcaagcccaggtagtattgtgttgcatacattaaagcttaataggaatattttagtttctgattatcacaggactactgaactaatcatcttcaataattaataaaacattggtgcgaggaaaacaaaatctaaacacaccataattactatagggaaatctttgatgcaatattacaatatataataaataacaattttgaaagctttttaaaactgtgttttaatcacgtttgcctccattaagctgctaagttaattaaataggcaaaccaacttgagacaaggaaattgattttctacataggacactctcaacagagtagcagacataagaaaacgatcaatttttcttcatggtgtgcaaattaagttctgttcagaaaaaaaaaaacaaaatccctgtttccttgttctcttctgctcttttgttctttagtgacaggttaatcaaataaatatggcaggaagggaaaatacatctgaatattccctgtacctttcactttcgggaagtctctagtgtcagagagagcttccaaccactccttccagcctcctctctaacaaagcctgggcacccaggctttctacccattgagaaattctagcagcaatctatttaccatggaccaaaaaaaatgtaacttgtgcattgcaatttttaattataatagacagtctattcctttgtcttccctttcatcacaatttcccccatctccacacctttcccaggtgcacaagggtcttactttcatttgcatcccaaaagagaaatcaggaggatccacatttgcctgtatttataaggctagagaaagcttaactgtggcatcccaagcttgaactctctgacatgggattttattgttttaaggacttcatcaatgtccacttataatctggaataagtgaatggagggatctttgctttgatgcataaaaatcaaaagaatatccctttgtgaattctgatgctgaaaatgtgttcttgtttggagggtagaaaaggggaattttcctatgtcctttgcttattatgacattagtaaagatcgctatagtccagaacatatatgtcaacagtccaactatcatagtgtagtattcgctgtagtgtgccatctctgagataattttgtacaaacatgaatatattttttactcttttgttgaatgtgaaccacaccaagacatttatcacttgcaaaagaacttgtagggcttcatgagggaagaatttttgaatacataaaattcaagcaggagctttaaataattccagaaaactgttttcccatactttgtaattccaaagctggggataggaagcagtgtagtttttttagatgtaaatatctgagttgtgagaaatttcaaagtaaaattgatattacattattatataattattataatatacagtcatgtaccacacaatgagctttttggtcaacgatgaaccacatatacaatggcagtcccataaaagcatagtactgtatttttaccatgtgttttctatgtttaggtatgtttagatatacaaatagttaccattatgttacagttgcctacagcattcagtaaagtaacatgctgtacaagtttgtagcctaagaactataagatatgccatatagcctagatgggtagtaggctatacagtctaggtttctataagtacaatctataatgcttgcacttcaaaattgtctaacaacacattttgcagaatgtatccccattgttaggtgacatgtgattgtatatagcctaatgccatgttattatatccagatatcccccagtaaaatcagatctattatgaaataaatgtttgtgtctcaccaagatttcttgttgaaaccctaacctccaatgcgacggtatttgaagatggggccctttgggaggtaattaggttgagatgaggtcataagagcagggctctcataatggaattagtgcctttgtaagaaaagacaccagaaagcttacttgctctctttctctccctccccatatgagcacacaatgagaaagcagccattcacaagccaggaagaggaccctcaacagaacctgaccgtgctgggaccttgatcccagactttcagcttcccgaactgtaaaagaatgattttctgttgtttaacacacaagctatggtgtttaattatggcagtcagagctgacaaaggcactaacttagaacatattcaactaactttgcttagtgtgctttacctagactgtcatctagccactgctttgcttgtctgagcagaaactgagtcaggggattaccggacataagtaagggcagaaaatcatcctggtgtccttgacacagcagaataacattgtttttgttgtccctctgcatttctctccacatatataggcgtatctcattttactgaactttattgcatttcacagctattgcattttctacaaattgaagatttgtcgcaaccctgcaccaagcaagtctataagcaccccttttcccacagcatgtgctcactttttctctgtgtcatattttagtaattctcacagtatttcaaacttgttcattattgttatgtctgttatggtgatttgtgatcagtgatctttgattttactattataattttttgggggtaccaggaaccatgcccatataagatggtaacttaattgatcaatgttgtgtgtgttctcacttctctatgaaccagctgtcccccagtctctctccctctcctcaagcttccctataccctgagacacagcaatattgaaattaggccaattaataaccctacaatggtctacatgtttaagtgaaaggaagagttgcacatctctcactttaaatcaaaagctagaaatgattaagcttagtaaggaacgtaagtaaaaattcagaataggttgaaagctaggcctcttgtgccaaacagtcaagatgtgaatacaaagaaaaagttattgaaagaaattaaaagtgctactccagggaacacctaaatgaatatttaggctcactgttgagatccactgctcagaaaaaaaaaaagattcttttcaaaatattactggtcattgacaatgtacctggtcacccaagagctcttatggagaggtacaagtagattaacatttttttttaatgcctgctaatacaacatccattctgcagccaatggatcaaagagtattttcaactttcaattcttactattttttaaaaaatgaatttcataagactatagctaccatagacagtgattcttccaatggatctgggcaaagtaaattgaaaaccttctggaaaggatttaccattctagatgccattaagaacatctgtgattcatggaaggaggtcaaaatatccacattatcaggagtttggaaaaagttgattctaaccctcatggatgactttgaggggtctgagacttcagtggaggaattcactgcaggtgtggtggaaatagcaagaaaactagaattagatgtggagcctaaaggtgtgactgaattgctgcaatctcatagtaaagtctgaatagatgaggagttgatgaagaaaggaagtggtttcttaagatgcagtctacatcctggtgaagatactgtgaacattgttgcaacaacaaaggatttagaatattccataaacttagttgataaagcagtggcaggagttgagaggattgaatccaattttgaaagaagttccactgtgggtaaaatgctatcaaacagcatcacatgatacagagaaatctttcgtaaaaggaagagtgaatcaacacagcaaactacatggttgtcttatttaaagaaattgccagctgggcacagtggctcatgcctgtaatcccagcgaattgggaggctaagtagggaggatcacttgaggccagaagtttgagacaagcctgggcaacatagcaagactgtgtctttacaaaaagtttgaaaataagccaggcatggtggtgtgcccctatattcctagctactggaaagactgaggcagaaggattgcttgagcccaggaagtcaaggctgcagtgaactatgatcgtaccactgcactccaccctgagtgacagaatgagaccctgtctcttaaagaaacaaaacaaaacaaaaatcactgaaattaccactgtcacccaaccttcagcaaccaccaccctaagcagtcagcagccatcaatgtcaagacaagaccacatcacaccctctaccagcaaaaagattacaactcactgaaggctcagatgattgttagtattttttagccatgaagtatttttaaattaaggtatgtacattgttttttagacataatgttattacattgtgctatgttttagacataatgctatgtctaaaattttagacatttttagacataatgctattgcatattgctattgcacacttattagactataacttttatatgcaccaaggtaccaaaaagtttgactcacttttttgcaatattcactttattgcagtggtctgaaccaaacccacaatatttctgaggtatgcctgtagttagcatgtgggcatgttttctatcactaatgcattttaattctctgaaatcagtatccacctctagtgaacttatatttaaactcagtgccctaagcatgatggatactgaaatatttttggttgaaggacatggtagcctggattttcagagtagttgtattagtccattttcacactgctgataaagacatacccaagactgggtaatttataaagaaaaagaggtttaatggactcacagttccacatggctggggaggcctcacaatcatggtagtaggtgaaaggcacatctcacatggcagcagacaagagaaagaatgagaaccaagagaaaggggtttccccttataaaactatcagatcttgtgagacttattcactaccacgagaacagtatgggggaaactgcccccatgattcaattatctcccactgggtccctcccataacatgtgggaattatgggagctacaattcaagatgagatttgagtggggacacagccaaaccatatcaacagtattccaaaatggaggagagggagagctgtttggattagaaaataataataataagccaggtgtaatatagacactgagcagagactgcttgcacatggggacttctctaaagatggaagtaagtgattacttgggtaaatcacagaatcctgaaatttcattctgcaaatatggagaagttaggtaaaaaacaaactaggtgagatggaggcaagctaggttgtttggagcatctgtggagcacagagctgggtgtctgccaaggttctctattatctttgcagtggtgggttcctgttctccccactgtaatctgggcgaggtcacctgtaacaggcttaacttcatttttgttcagccactcctgaattacttccttctgtagacttggaaaggttatggccagattatgttctccatgttaaatctctgttattcttgatgaaaataatccaaactgagggttcctgcacaaactccccatctgactctttgatgtccactgttccctagagaaatgtgaagttggctcctgcagctgcacttttggatttgttccattctcagaataggcccagaaggatgtttctacagcttggtacttattctcagctcttagaatattttcttaattgcttccctccgcatcctcccagcacttgtgagctatgcttccactgggcttcgttgcctgcatttgtacattgttggtttcccattttttccccaaatatgatgtaacctccctattaagtatggggtctttgccatgagtccatctgtgttgtaatgtggctctctgtacttatttcataactatgcaaatacttttttttctaacccaggtcacttacactctagaacctccccattcaaagtgtgatccacaaaccagcataggcataacctgggaacttactggaaatgtaggatctcagtccctgtcccagacctactgcatcacaatctgaaatttaacaagatcctcaggtgattcaggtgcatattacaatttgaaatacgctgggctacagtggtggtttttgaagctggttgtacagtagtcacatggagaacttctaaaaaaatatcaaagttgggtcccactcctagggattctaatttaattgatttgaggcagggccctaatatggatattattttcaagttttatatttgttccatatttacttcatttcacagctgaaacacactttcctagaataagcaatattaggtgaaatttgtgcccttttagctgtacatgttgtatattctgtgttagactagaagatccttgaaggccacttccacattttctatgttttgtgaatcctccaaatcatccttggtatggtgttaagtgtataatcattgttcaatgacatgttcatggttgatggggtactaaagcaggggggagatgactagcatttatgtcctggccctgtaagccatgacctctttgaccctgagcagatcacttaaacctctcagaagtcaatgtttttgttcagtcaaatgtgaatgacttctaactctagtagttattcagtcattcattcacataataaatgtgtatgaacatctgttctttaacagctactgttctaggcactgaggagatagtggtcaacagccaagacagaaaaagcctttgtcctcatagaacttataatgggagatataaataacaagcaaataaataaaaatatgaagcaggatagaggcataggtagtaataagtgctaagaagaaaaatagagcacagttaagtgttggagcgtggtaaattgttaggtgacagtggggagactttatttaactaggttatcacagaagacctttctgaagaggggacatttgagcagagacttgaatggtgtaacaggaaagctaggcaaagatctgggggcaggaaagatctttctaagcagacagcctccaataatagaagtcctgggtcagaaacaagctaatgatggtcaagcgctagacaaagagcaagggtggttgtagtagcattctttgtggatgtctctagtctatgacttaaaggatccgtatttaagtcttaaaagtatcaaagctttagagcacttatgggaaacataaatcacctgcaggcataaatgcccaatattggggcagcacaaaagtaacagaaaccaagagtgtcatcatcattggctcaacttctgtactttccaatatagtaatattttactttaggatcagcaggatcgtgagaccaaacacatacagagataatatttacttctctaggcagtgccttgagttcagcaaatttactcctgctctcttgtgtgatgtaaaggtccatttaggcactctcctgcttctgtctcttcccctttgagtgaactgctcagaaaacagggatcagcacaaagagccagccctctgggcatggtgtcctgggtgttggggcatggctctgattccaaactgtttgagtctctggttccagccaaggggctgagtggcattaattttgttgctctcttgcttcttgaaccattttgtttcagatatcatggttttatttctacagttcagctgccaaagtccatctagggtccatagatttgtgtcccaattatagaaaccttaattgcaaaatcttgaagttaaaatatcagccctcaaaggaacaatgcttgatgatgatgattggtgatgatgatgattatgagtaatgtaaccataatgggtctcctctttttcacatgtcatttgactctggcaatgcacattaaacatttataatataacaacatggacttacacaaaataactttaattctatttcatctctcttctaattaccttatatgtattatcaaattcgatcccccttctgtattaggcactgtcttcattaccaggaaactgagtcacatagacattaggcaacttgtccaaagttatacacttaaccaggcctcaaaccccagcatttctgattccaaagcttgagttcatagtcatattgcatatcttcctgagaaataaccacttattttacaaaattcggctcaagaatctactctcaatgaaactttctcttacctgcccctcatcaggtatacacactatgacaaagactatattattatcattttcagttcttattctgtgtcaagctctgtgcttggtgttgtgcttgtgtaacccttataaagttaggctgcctcctggccatgcaataaaatggttttattcaaagtcctatactgtaaaattaaatcgttttcgtctttattgcattatctttaaaaagtccagaaagataatagtattcataacacagaacaacacttctgataatctttctctccctttgtcctcatcctccctcatcataagcaatgcatgagagctgtatccaatcccacttcttccaaactctaaaaatctttcctcaaaactcattccaggtttgatttgctcctctgtctcttcctcgtttccttctttcctcctttttctttccaaatctagtttattttttctccctacagtagttttgtatcctttctagtgtaaataaatctactgtgtcttaagcttcttcacactggcagttctacacacccaatgagatgaaagctgaatcaaccaacctcatcaaacaggcagccctagcaacaaaggaaccttagaagaaaaaagaaaaggcaatggccattcatatgtttatattttccccttgtcatatatatattcttatctatcatcaccactcttaaatggctttaagtttttgccatcttaagatgaaaaattgaggatcagagacggttatctcttacccaaagtgatagggtaaatgaatacaaatccagaatatgaacctactctgagtaaataaaagcccctgagtttagccagactagttattggatgtgttgcctaatctcttcactctgccttaaaggctccagtgtcctctatagcaggggtcagtgagctatggcccatgagccaaatccagcccactacctgtttttgcaaataaagttttattggaacatagtcacactcattcatttacatacatctatggctgcttttgcactacaaaggcagagttgagtagttctgacaaaggctgtattgctctcttaacttaaaatgcttactgtatggctttttacagaaagtttgctgactccagctctagaagaccctcatagcacctcttacagttaaccagaaacaggccaattcaccaaaaatctatttgtagattatttatgacatttaccatactatatttaccaatctaacaaaaatatatttatttgaactacttataggatttaaagcaatttgtgttgggtgaaattaacagcttttgaatcattctgcaaaggtttctttgcttggttcttatgttgttttcttaattaatatgtcagtgatgctcagtttctcattgcccttgcatcctgctgagttagctggagggtttggggtagagaaaggggaccctgagtctgggggaaggcagagagaagagccattttagagcacatcctgggctgccatcaagaggagtgaacctgggagaaagaaggagaaaggccaagcacaggaagataggagaccctgcagctgggggcgagtatgacagcccagaactctggattctagctactcacaacattaatgagtgagtcctactatcacatccaatactaatttctgtcaacctacaaatagttttaaaataatttggtaatttgataaatttgttcaatatgacacgcagatcattcagtggatttatctgttgcaaattgggttctggcaaatcgttttagttaacaagttcatcaagaaatgtttatggggcatctactatgtgccaagtacccttgggatttaccagtcaaaatttaaagacctccgtaatcttcttataggttatattccatcagggggagacagataataagtaatatatacaacaaataagcaaattatatggcactttagaaagagttaagtgctgttggggggcaggaaagaatcaatagtgtaatgaagattgagactacaaatggaggaatacaattttaaatagtatggtcagggtaggcctgattgagaagataatatttgagcaaagacttgatggagtgaggagaaaggcacatagacgtctgggaaagaacattccaggcagaggaaacagtcagtgcagaaactctacggtgaaagcaacaaagaggacagtgtgtctggagtagaaagtgaagggagaattagaaaatgaggtcaaagtaattatggtggatggaccatgtaggtccttgttgaccactgaaaggattccagcttacatactaggtgaaatgtgggccatggaggtttttggacaaagaagctgcatggtatgacttaggttttaaaaaggatactgcagctgctttgttgattatagactgtgggtgaacaagggagggagcaaggataccagttaggagattattgaagttatcaaagcgagagatggagattgggaccggtggctagcagtggagagatgagaaagggtcagattttgctgcatgtacattgaagtagggccaacagaacttcctgatggattggatatgggatttaaatgaaataaagtagttaaatgttttgcgtagtaactggaatgatggagttagcgcctacttgaccatgagaaagactgcgattagaacaggttaatgtagacagctatgagacatcaaagtagagtcagtgaataggcatttgatataggagtgtggagttaatagaaggttttggctaaagatacaaatttcactgattgaaatacagctcctggcatttctttgtttcgtttactagactgtaaattatttcatggcaagagcctgtctcattcatttatctccagcccttaacatggtgccagaaacataataacactgtgttttgctgatgttcaaagatgctacatgaatgaatgaatgaatgaatgaatgaatgaacagacacatacttttatgacgctaacttacttatgcactttgagacaagaacattttcctcctgtggaaggaaaaagacttcaagttgtttcatttacctctaatggtatttagaaagcttgcatgttcaagcaggtatcatagtaaaggatcaaatatggactttgaacttggcagtgtgctatcttttccatcatttaagttgtaggaagagataatacatatattgacagtccaagttattcttgctttaagaggatgactcatattgatcaaagaagagttgtcaatttctagacaagctggatgatcagagtaactaaagtctaaagtaaaaggtcaggaatattcatccatctgagaaaaaaaaatgtatagctgacagactaagacaagagaaaaataataacttctaggaagtagataactttattatagcttaatttaaaagtagaaaatggctgggtgtggtggctgaggcctgtaatcccagcactttgggaggccaaggcaggtggattgcctgagctcaggagttcgaaaccagcctgggcaacacggcaaaaccctgtctctactaaaaatatgaacaattagctgggtgtggtggtaggcgcctgtaatcctagctactcgggaggctgaggcaggagaatcacttgaacctgggaggtggaggtttcagtgagccaagattgtgccactatactccagcctgggtgacagagtgagactctgtctcagaaaaaaaaaaaaaaaaaagtagaaaacatttgccaatatcatccacagtctaagaattaagtatatttttgcagcttactaataaatttttgaggttcataatatctcaagcctatgatgtattcaaagtagcaactctgcccaaataaatatactaatataaatatttttatcaattttaatttccagctcctatttaagaaagggaatggaatagtttggtagatagaactgatgtatcaggacaccgagatttattattttcctgaatattaccaagtttgttactataattccttctgttgagttgtgacaaatgagaataaattatacattttcagatctgttcctttgcaattcataaagcagaataaaacacacacacacacacactcttacatatacacagatacctattaataaaaattcatgatcaacaaggcagttttatttaaaggagcagatataacttgatttcagagttgcagaaagcttggctcacatttttttacattaatttcagtatatattactgcacagaaagatgagcaacactattttcttaagctaactcatttttaaaactgtaatttcagatgtgaatgatgatagaaagcagagaaattatcctgataagcattccaggctccaaacaaaatatatatgaatgttcaggctttaaaggtttaggcacacatgagttataaaaatatttatttaattttctgaacaagaatagatttacatgaatgctatatatgatttgttttaaagtcttccctgaccacatatactatgggcacagtacctaagtttgcatctctgtcaacaggcaaacaatttatatatttattaccaacacattacagttacaaagttaacttataaaaggattaaaacataggatactgaacttttctatgacagagcacggaatgtcttttcatttgttcaaatcaacttttgtgttcttgcacatttcctgttaagtttattcataaatattttattatttttctgttgctattgttatttttcattatattttgtatgaataaaagttattaatttccacatattaattttgtattttactactttactgaactctctaaatatttatactagtagtagtagatttttcagttggttctcttgagttttccagatagactgtcatatcattcacaagtagctaccatgttaccatctcctttctaatttgtatacctttagttatttttcctaagtgccttaatgtctaccttgagtacaatgttgcataataatgctaatgtaggtatccctgtcttgttcctggtactagtcataattctatatttccccattaaacatagttttggcttttgtatatatattttccctgaattagtattattaaagattttcatgaagaatttaggttgaatgttgcaaaatctgtttagcatatcagtagctgatcatataatttttgcattagattccaggcgcagatggattcatagaagacttctagtataccttgaaaaagtagatgatgctaatttgttttgtcaattccagaacctaatgtatgaaagaaaaacttctaaatcataaagcaagcataacaatcatgccaaaattactagaaaagattacacacacacacacacacacacacaaaataactgaagacaagtctcacttaggaaaatggatgtaaaaatgctatgtagcaaacaattcagctagaaatttaaaaataagttatgaccaagtacgatttatttaataatgcaacgataatttattataagaaaatctattactaaaatatttcatgttaatttatctaaggagaaaaatcatatggctaaatgctgaaaactgtagcccttgaaaaaatttttctagggaaatgggctacttagattttttaaaaatatctcctcagtttcagtaaagtatatttttctacaaaactgtccatttcatcctgattttccaatgtatatgtataagttaaagtagtctcttaagagtcttttaattttctgtgttctttcccattattgtttcttattttatatagctatattttctctctttcttgattagtctagcagtttagtttatttaaaaagctagttcttcattgtatttattattcagctaatattcttttttaactcattaactcctgcttttatctttattaattcctttattctattttcccctagtccattttgttgtttactgataaaaatattaaatctcattctgagtatgtctctagataggtcatataaattgtggtataaattgctttattactattttgtagacactgtgcaatttcagcttgtatttcttctttggttcaaggactaagaaattcatgctttccccagaaagcaaaatctttttatttcctacattttgttgttttatttttagttttatcacattatgggaaaatatttgctatattgtttttaatttttgaagtttattgagattgtctttgcagtctagtacatggttgatttttatgaatattctatgggtacttgcaaagaaggcatattctttatttacagaattcagaaaataccggttagattttccgtgttgcttatgttacttagatcttccatttgatctcccttcagctgtcagcttactagagatttccatagatattttctcaaacttgcacaacctgaggccagatgatctccttttctctgcttttctagcacctgtacttcctgctactttaacaattcttgcattgcattataatttacttgtccatacattcaaggtccttgaaaacaggacctgacagctgttagcacatagaatgacctcaaaatcatttgttgaatgaatggatgagtattttataactttctcccatttagaatttctctttaaagagaaggctggaggggaggggtcagggaaggagacactgggaagaaaatattatagatacattggaggtgtccggcaaatggaaaatcttccaaacaagttctataattctcagtcagacactggcagcctaacacattggtactcagatatggatcagtagcacgccatcagcccaactgcaacaggaaaaatggcaaatgggccagtgttcatcaccagcattacctatttccctaattttgtaccctgcctctgaagacaccactaatctcatattattattctggcttcaatgtttagaaacttcctcagtccttttctcccttttgcaatgaaaattccaattaggccagtctcagttgagtattggttttattaaagtaacttgcaaggagttgtgactgactctatcaacttaatttttcagggcatattttctttgccaaatgggagcctgctaatctaaatacatcttctgaatagctcttccactttcatgcctaatcatactttgtgaatgcatggaatcagcatagtttattggaggcggccatatacaatcttgccctttccctttcgtttcctcatctgaaaaatgataaattccattagctgatttagaaagttgtctcagctctgaagttctggcatttagcctttgtaaattattttaaataaccccaatcaccattggagaattgctgagggtaagcaaggcaaatattgaattcataataaatcctcaaacggcagatggcatggtggaggggatgtatagtcagtctttgaccatccacagcactgaggtatggcacaaatcatcttaacagtggataatacagaaataggttatcaatgatcaaagacaaagaatggagaaaggcctaagagatcatctggtccatgtcctttccatagacataaatcccctgggaaaaggtagtgtaggttaatcaaatattcttattaattgctaggtgcaagataccaggaaaactaatgctgaaagaattagagtaaaataaaagatattccaagtggtaaaactagaatgagtatgtgatgtcacagtggaaataaagctggaccaagaatctagctccaggcttggtttttctcttaactggttctttgagattgggaaaatctctcaagctctctgacctcagtatttgcacaagtattgtatgtagagatagaatgagttatatattaactttttgaaaaattagtttatcctacacaaaatacataataattgttcacagtgacaatgtgcttcatgtgagagaaaatcaggcaaaatgatacaaacttggtattttcataatgttactcattaatgaaaagccttcattatcaccactatgagtcataacactggataaagctcaacaaatgtttatggtaaaaatcaaattcaattatgcattataaaagcataaatggatctctagcatttgagagactatacagttgatatacagtttatccaaaattccatggaaataattttgcctggctttctgaaaattaataattaatagttttagatgtaaaggtaaaactgagctgtttcaaaccaaacagtaattttaaagcaagaattgtagcaggaaagttagcccctctctgatagcattgatgtcaagaaacagcagttttcccatatctcttaagtgctactatccaggaagaagtcacacaagaatgactcccacgtttaactttaatgaagatcctaaattggatgaaactattaattaatctaactaatttgcagcactcagggcattgattctaatggccggatagaagtataaaaggtaattccaccatgatgatgagagttaacatgtttgagcatttacaaggtaccaggcccagttctaaagcactacctacttgttatttcacagatatctcaatacttacagcaaacctattaggtgggctccattattatcctcatttttcagctgagaaaactgaagcacagagtcattaagtattgtgtccaaactgtacagctaggaagaggcaagacaggatttagaccctcaaagtccaatactagtgcttacagggtttatcaccactctaactcagcactgatagagtgcaagtcaatcatctattctcttgtatttatttacctctgtaaaacagattacacaagggcaggaaccaaatgttaatcatctttgtatacttctcagcatttcacacacaaggaacagtctacggtgatttgttgacttattgctgaaaatatgcaattcattttggggccccatatctgtgtatacaatgacaagtggaaattgagatgagaatttatttaagtgattccgtaataaacccttacaattaaatgttttaagatatgaattatccagttttactttttatgatcattaaaattagagaaaatttgttgattcagactatattaggtaatgattagcttgaattaaaatataggattaaagcagtaattcataatactttttttctataaagagataaatagataacattttaggctttctgggcttaaagttctctgttgcagctactcaactctaccatggtaagtgggcactagagagccatagagaatatgtaaatgaatgggtatggctttgttctaattaaactgtatttgcaaaagcaagtagcagaacagatttaactgatggacagtagtttgatgactcctggacttcagcttaggtaaactgattttgaatagctacttttatacatgttcaagcatggagcctacttgaatggatagattaaaaatgaatatattatggtttttcttctcttatactgattaattatcctcccagataccttgcttattatttttaaactgaacttttctctttaaatagtaaagaaaaaaaaatcaaatttttccaaattctggattcatgaggcccaaaataagcaacttatctcccttttctcatcttttttatctatctatatttctttctctctcctccacaacaaagataacatatattaactgtcaattgctgcataacaaatttctgccagattttagtggcttaaacaatattttaatcttacagtttttatgagcatttttatcttgtagtttctatgggttaggaatccaggcacaactcagctggaacctctctttcagagtctcccacaaggctgaaatctcacatgatttcatagccaaggctgtagtctcacatgaaggctcaactagagaaggatctacttccaaagctcactcatatagttgttggcaagattcagttcctcctgtgctgtcagactgaggcctcagctcttcactggctattggctgaatgctaccctcagttccttgctaggtagccctctccacaaaggcaacatgagaagagccagcaagagagtgccagcacgaaagaaagtgcaagcaagatggaaggcagtcttttataacctaattgtggaagtaacatcccatcaattttgacacattgtatttgttagaaacaagtcagtaggtcagcccatagtcaaggggagcagattatccaagcacatgaataccaagagacacgaatcattggggcccattttagaaggctgcctaccacacactattttaataaaactaactctgcattggtcttttagtgtaatgctgtttgtattagtccgttttcacactgctgacaaagacatactgaagactgggcaatttacaaaagaaagaggtttaattgacttacagttccatgtggcaggggaggcttcacagccatggcagaagatgaaaggcacgtctcacatggcagcagacaagagaagagagcttgtgcagggagacttccatttttaaaatcatcacatgtcgtgagacttatttactatcatgagaatagcacgggaaagacctgcccccatgattcaattacctcccactgggtccctcccacaacacgtggaaattcaagatgaaatttttggtggggagacagccaaaccatatcattctgcccctagcccctctaaatctcatgtcctcacatttcaaaaccaatcatgccttcccaacagtcccccaaagtcttaactcatttcaccattaactcaaaagtccacagtccaaagtctcatctgagacaaggcaagttccttccacctatgagcctgtaaaatcaaaaacaagttagttacttcctagatacaatcgggatacaggcattgggcaaatacagccattccaaatgggaaaaattggtcaaaacaaaggggctacaggccccatgcaagtccaaaattcagcagggcagtcaaatcttaaagccccaaaatgatctcctttgactccatgtctcacatccaggtgactctgatgcaagagatgggttcccatggtctcaggcagctctgcccctgtggatttgcaaggtacagcctccctcctggctattttcacaggctggcattgaatgtctgcagcttttccaggtgtacagtacaagctgtcagtggagctatcattctggggtcggaaggacggtggccctcttctcacaggtgcactaggtggtgtctcagtagggactctgtgtgggggctcccaacccacatttcacttcttcactgccctagcagaggttctccatgagaacatcaaccctacagcaaacttctgcttgggcatccaggtgtttctatacctcttctgaaatctaggttcccaaacctcagttcttgacttttgtacactcacaggttcaacaccacgtggaagctgccaaggcttgaggcttgcaccctctgaagccacagcctgagctctatgttggcccctttcagccacagctggaatggctgggatgcaggtcaccaagtcccaaggctgcatgctgcaaacagcacagggaccccaggcccaacccatgaaaccacattttcctcctaggcctctgggcctgtgatgggaggggctgctgcaaaggtctccaacatgccctggagacattttcttcattgtcttggtgattaatatttggcccctcgacttatgcagatttctgcagacagcttgaatttctcctcagaaaatgggatttacttttctattgcattgtcaggctgcaaattttccaaacttttatgctgtttcccttttgaaactgaatgcctttaaccacaccgaagtcacctcttgaatgctttgctgcttagaaatttcttctacaagataccctaaatcatctctctcaagttcaaagttccacaaatctctaggccaggggcaaaatgcctccagtctctttgctaaaacataataagagtcacctttgctctggttcccaacaagtttcttatctccacctgagatcacctcagcctggaccttattgttcatatcactatcggcatttttgtcaaagccattcaacaagtctctaggaagttccaaactttcctatattttcctgtcttctgagccctccaaactgttccaacctctgcctgttacccagttgcaaagtcacttccatatttttggctatcttttcagcaataccccactctattgtaccagtttactgtattagtttgttttcacactgctgataaagacatatctaagactgggcaatttagaaaagaaagaggtttaatggacttatagtcccacgtggctggggaggcctcacaatcatggtggaaggcaaggagaagcaagtcacatcttatgtggacggcagcaggcaaaagagagcttgtgcagagaaactctcatttttaaaaccaccagatctcgcgagacttattcactatcatgacaacagcacgggaaagacctgcccccatgattcaattacctcccaccaggtccctcccataacacatggaaatttaagataagatttgggtggggacacagccaaaccatatcactgttaaaacctttaactaactgatgtcctgtcaacaggagtaatttgtactttcgtaatatccacatccttataggctcaaaatgtaactgtgactctgtcctcctaaggagctcagggtgggacagattatttatataacatttctgcaaataaggtgctctcattatctgaccccaggagagttggcatatgctgaatgattctcgcacagtattagacaggaaatactagtttctgtttcagctccattattctaattttataaatttaaaactagctgtgcagagcaaaaagggaagtgataggtgttaaatcatatgggcaatataggtcctaaattgatttggtacttactgcttgaagaatgttttttgattcatgtcaacactccattcttactggtgatgggcaagccagccaggcataggatatttgctagtaagaaaaaaattttcaggatgtgtttctttgctatcctggttctaaatggcaatgatgtggcaggcatcatttttgtgataggctctcctgatctaatttggggtttgagtcatttgtttcagtaaactgcagaccctgtgacaagcatttggatgcagtttatttgaaagatggtgacaagaaagacaagagagaatgtggaatgtaaatagtgaaaagagaaaaggcaaacaagtgtattattgagttggttaccatgagggacaactagtgttcaattatgctagggatcctccaaaaactgtgtagaattctcttcagattgccccaacaagtaccaggaaatccagggtctttatccaccaacccccatccttccatggttgaggactgcccctggtagtgttctaggcttccttgcatgcatgtcaagaaagtttccaaggtaccagagaaatctcttaggcagaaaagcagagcttggggtgagttgctgagggtttatgtgagaattgtccattgaatctgcaagtaaactcagtgtatctgctatgcacatagtattgcacatgcaattgtttttcctgaattagtactatttgcttctaagcaaggaattcactattttaggcaagtcttgcctggcacatagaggcattcaatgaatagacattatcagatgatactgaaagtgctaagaatgcagagtagagggcctgaaggctgttactgggactcacagctctgatcaccttgacattgggaacccatactgctattgatgtggtttcctctctcatcactttttatttcccttgagtcacagaatcttagaatagcagaacccttgaaaattatcagcccgatccttttatatcccaagtgggagtgtgagaccccaaatcgtgagataatgtgcccaaatttgcaatgtgagccagtggcaaagctgaggtccacatttttggcatcttctcatggctctctctaacacagccttgctgctttctcttactttagatagtcatactggattgatttccgccaaggggctgagattgatctaaactttctgaagcagatgtatgcaactgatatgttagaaactgaggcactcaatgagcccaaccaaaatattttcacacttacactttatcttttaagcattctgtacacttccatattgaaaaataataatgctatctgatggcatggccttttatttcttcaaagagcttacacatctacttatgtcattttactcaagaggcagtaggatttctttttaatcattacagactcctgtaggctagtatctattgcaaataggtatttaactattaatgggtgatttgtgcttctggtttttttgttaaagagaaaggaatggagctgacttgtatcaaaatgctgctcaactataggaagtggatacagtagagacataatctttggtaatttataactaacaaaaagtgagatcaacagcccagccagaagcttttgaaccacattaattacaaacctttgactgacctgtagctccttttcttgttttctcctccccacatggaacctggagcgtggtggatgcctggaatttttccatttcagtttcactttgaatagtatgaaacagtaggtagctgattaacttcaagagctttaggttagaacacactaggcttgagcgcccagagtgccatgccaagaagggaaggtgtctggcaagttggctcctatcgagacatccttgatgatctgcagcctccactgtgagctcacattaaagtacagagctgacactaaatcagtccacaagccagagtctgggtcggaaagcttctcggctaccactgactctaccattcaattgaaattcatatttcacactatactctcatatattaaatactctatggccctccactaaaggaatccctgttctcatccccaggatgtagcatcacagtgctcagagggttcaggtgcattggtggagaagttcagcaccagaaggggcctctttgtatcctggagttatcacaagattctaggtattctgaggaaatgatttctccatcactgcaacttgaactgggcttctaagactgcctctattttgtactccagaatcacccattccctacatatcttacccactgttcatctcaggagtacatcatccataattgttatgagatgatgacgcatctgcacatagtcacttaacacaggtacacccactcactctggtaaggttctgagtttgagaaatggtcaggggtgaaaggtttggccactgcttccttcctgatttggctcctcatcccactataggaggcataggcaacttggaaatcataaaccaacaagctcagtccagggagtggagacctgtcagctcttccatattcctctacccatcactataaaccttacccaccattccaaggcctttccaaataacagttattaaacttccctcttttatttccttgcttgtaagtatgaattttgaacctgggttagggtagggagtaaatgcacaaatagtatacaagtagtcgaggcactaattgctgactgagaaaacaaatgaagattgcggttatctgccatctatgaacacttatcttcacagtatgtccatggctgcaggtgtgacagtgctactgttgtttcttgcttgccagtcccactgcatgtaccttctcacctcttttccacatcagatgttgtcatctggtgtaagcacagtctgtgagtaattcttctgactcatcgccagagagggaggttcccacaggggtcagtgaggcagaaaagcacagaatttggagtcaagccagatttaatgcaaatcgcagctcaactattcttttgctgtgtgatcttggtaaagttaatgagtgaactcagcttccttatccttataatggagataactcatagaatggtggtggtgtaagctttttgttgatgatagtggtggtggtgattttgttctgttttctttttgtaacagcatatatcagtccccatgatatacaggagtgctcactgcaatgaagttccatttatgtgaacttagattatgtgaatttaaagcaaagcaatataaaaatactaacaaagtcttagtccatgcacaaaacatcaaatacaagatattttactttacattattcctgtggggaaaactgccttgaattatgcaagttttgaattatgcagtgtcttcaggggctcatcccttacaagccaatgtgtctgagaatctacaatctgccaaatgagtgttaagttttatataaagtatcttattcaatccttcaatgaccccatgaaactggaatgtgtgggcccctactttgatatgaagaaatcaagattcaaaaaggttaagtaatttttccaaattcattggtcattcacctaggattcaaatccaagttggtctagcttcaaaaatattcattatttttccttttttttctttcttccatatcttcatagtctcccagtttttctcttctctttctttctccttttctctctctctctcccatgcacacacacacaaacacacacactctctgactacacaaacatttattaagtgaagcatcatctcatcatctccccaaagcccattgttgtctttccaatactgagatcacccaattgggtcttttcttcattgagattgtttttccaccagtgggcaatttgttccgaatccccacttcccccttattcctgcccttgttagataataaacatacatcacttgttttgtcactgaaggtgcaggcacaggaagtagactatggcaggaatcaatgtgcttgtctatcagccaaaaatgtagtgacgtggcagacataagcacagggaagaagatgctgcattgccctacttcctccagatgctaacccctccttcaccttgactctctcagatgcctacatttgcaggaggctgagacttagaggtgcctttctgcagagtgtccctatggtgcctctaacaatggatatcacctggtgttgcttgtgtattctagggctggcagttttactcttcttgtacctctccactcatgaaactcacacggatagtaagttttggcaagctactttaaacaattttctgaccaccataatggagagaaatgtattcatctttggaaagaatatcaactcactaggcctgtgtaccgtccaatgcccaacaaactaattggtccccaaaggtccatttataattgggtggttcctgcagataccaggcttggaggcattgccactcagtgtctgtttctgcaaacagcactttaataagtaactctttactcaactactcagtatagaactcaacaatattagatatggagagaaaatggggtgagggtggtgacactgggatgggccaggtagtcagtgctgtcatcatccatctctgccaaggaaatctgatttccccagcattaaatggcaggtgtgagctccttaattaggcaataaaaatggcaacttggcagtgaaactataaacatgaaattgtacagcaccatgaatctttggcaccaggattaacttgactatatttttttctcgtgatacagttactgaatataggtaagagatcaaacagaaaaagcaaagccagaattctcattcccacctctgttaattactagctatataaagtttagatatgcatttaataaactaatttccccccaaaatgggaatggaaagcatgatggtatactttatagcactcaataaaagataagttgattggagttaccaaagccttctattttatgtaacagaaacacatctcaggctactgtggccaacagttatctctcatttcaacagctgcattaatcaaggttaattacatattttccacatataaattagataaaatgaaattgtactgtacagaaaactattctgctttaccaatagttttcaggcatagtttgagaataattaaacatttttatttgtataaatgtaagtggcacaagtgcaattttgttacatggatatattgtggagaataattaaacattgactcaagcaggtggatatgaggaatcattccacttaaagaaggaatatctgaatattttgagattgccctatgaatttcattttgtttcttttctattacaaaacaacacttgatcatagtcatttgtgattttttctccactgtagtgaactgctctctgtacacattcattagcaatcctccttgattagctgctggaggaatgtcgcagttctctggggtcagcctaggggctgggaatgtgaatatactttagttggcacattatcacatggaagtgccttgcccatgaggaatggagagggtatccaagctgtaaggacattcaagtaatccttgtacaatggtgactcattcttctgtcctggggataaacatcatgtagaaaatgtcccaaccaataacatcaactggcttcatggcacaggaaacagtacagtgtctgaacacagacaaaacaaattgtggggctaaagtaaataaattcatgacttgattttctactttgaaactgaactaatgatgtaattcatgaaaaaaattgactcaataaaacttgccaaagttttcaaaaatgccaagacagtattaaaaagaatattaatgggaaacacctctaagaaatgtctatacaatgcgaaacaactgagcaactaaccaaattccaccatctcacttatctgttcaaacaacagataaatgcttatctagcaccatgaaactctaaaccacttgactggttctactttcccgccagatatatttgcaaactacataagttataaagtcatctaaataataagtattctcctttccgttaatgaaaataaatccagagtaatttggatatcaacaactatcatctctaaaagaccaaaactacatttttcttctttttagttgtcttttttttttgtagcttaccctttatataaagcaataattgtgaaaggaatttgaatttatatagcacttggaaaatttgacagtcaacaaaaacttacagggacacttactatatgcacaaaaacttgtccttggtggcatggatacagaagacattactggatctatattcccccaagtatcctatactttagttgggtggataaaacacatatgcatgaagcgaagactaaactggatgattctatctttaagtgcgttacaaattctaaagatgggcaagacgaccgtgggctagaataggcaaagaaattatcaccttggggatggaatttggtctactccttgaagaattatctggaaataaacagatataaaatgtgggaaatgtttctatgctgggagaagagtgtagaccagggtttttccaccttataacactattaacatttgggactgggtaattatttgtcataaagagctgtcctttgcattgttgggtatttaacagcatccctggcctcaacccactagaaaccagagcaactctttacttcccagatggaacaaccaaaaacatcttctggcactgctgaatgttcttcagagcaacatcacttctggttgagaaccactggactggatatagttacctcggttttttgtttgtttgtttttgtttttgctttctctctctcagggttttccaacctcagaattattagcatttcgactggataagtctttgttttggatgctgtcctgtgcataataggatgtttagaagcatccgtgacctcaactaccagatgccaatagcactgctccctggttgtgacaatcaaaaatatctccagacgttgccaaatgtcccctggagtgaaaagtcaacctcatttaggaactactggtgtagacaaagtcatcagtgggaatggatttggcttactcagggctaagcaaaattgtttaaacaaaacaccaagcttgtgttatgaaagagtgcaataagattgattaactagggtagacacatgctgtgcgaggccttgaataccagagactgcaataggcagccacagtaattcctaagcagatgtgtttcaaaatgaaattggtgttttaaatttaatttcacagaagcaaaagactaggtgccatggggaagaactgaatgcagggggactggttaggaagttgttataataaccaggcattaggtgttgatggataggattaaagtgacatctttggaatggagagagtaaagagtaaacccaggattgctttacagagagaaatgttgagtctgtgcaatagattgagtattagagatgaagacaatggagggggaaacagtggtaaaaccaggttgctagtgagaagaaagatttaaatgagatgaataagaaggaggtggcatttaatatgtttaattttgcaaatactaactagctattttagtattatcacagaatgctgctgtgaggtcagggctgagggaataatttgagagctttggaaacacaaaaccttcatatcctcaatgaatttatccactcctatagctttcttcttattcctgtagcttgacaaaataaaaatttccttctcactcacattaaactctactatggggttggtggccctaggtcttttggggatccagccttcttccatcttacggcactgccatcttaaaccggtgacatctaaggtggctgcagaaggtatagtcttaagggcctcatggaagattttagcggtcctaacatgtgtaacttctgcctacattccatggaggatccaaaagaagtggcaaatccagcttactggtagaggaaatgaaatttagaagaatatagccagtctctgttatagcgctcaacatacacaccaccaccaccaccaccaccaccaccctgacacacagaaataagaagaaagctataggagtggattaattcattgaggatatgaagatagagtgaaaactgaggaggagagttcaagaaatggaaataccaaatggaataagatgtcccaaagagagtaaggaagatcagatgattcagagatgttggagagcctagaagagaaccaacctatatagaggtgaaagtgccaagaagacggaaggtaaatttccataaggaggataatgtctactttgctaagactcttgctttcatcagaggcaaagagcatcatgatgattgttaaaaaaaaaaagaaaagaaaaagacaccttatacatctatactccacctcaaaaccatcattagcttatctttacaaatttttgaaaccccaaacctatcagcttggctttcaatgccttcttttgccagcccagcctaactgtccacccctcaccgttaactcccaggtgcccagcatatcccggtcactgggttgctcattattcgcaagaccaccatactctctcccatctttacagctttgattttacagcttcttctacccaccaaagacctggctctcctcaagcctaaaacaagtgctacaccacctaggaataaagcctttactgatttttccatcgatattaacctccccgtattctaccgactttttgtccttcctttactttgtcatgtggaaccatctactttatatcacttatatgttcatgtgactgtttccctcagtagaccatgggattcttaagtggtgaagcagggccactaagatgtacaaccccaagaaaaacaagataacactaaagtctaggtcagaggctggaaaatgttttctgtaaagagccatatggtattttaggctttgtggccatttggtttctgtcacaactactcaactgtaccattttagttcaaaagtatccacagacaatatgtaaatgaatgaatatggctgtcttcaaataaaactttatttataaaacaggcagtggactgaatttgatccatggactataatatgctgctccatgatctatgtgaatgatactttctagagcacagcatgagtggggtcccctgaaatataatctgggaagtcctggggagaattaatatacttcttagtcatctttgtatcttttaccccatttcccaccagcacctagtagagccttcaatgtagtatgctctcaatgtttgtttttgtttttctgaattaaatatgctatgcctgaaaagataccaacttagttaatcataacagcactttgagaacttcattaccttttaaaactatcttgcaagtttgtagtaaagtagttcaagaaggaatcttgtaagcccaagaatcataaaaataatgtaacaggggaagatgtgagctcaaaacatctaaggattagcagctgaaagaagagaatctgacatcagagctgggtaaaagcaacaaaaaggcatttcagttctgagaaaccagcaccaaggaacatcacatcatatgtgatagatgtctcacaacaccctctaaatccatgtgaataatgcatttaatgccagcacttcaatgctggaaagatgttcatgatttggaggaaactcagagagcaaccaaaatgattaagagactgaaaggactcatttgtgagcagctgaaaaagaagccaaatatgagcttggtctgctgattgctagaagatggggaaaaggtgtataaattactgaatgctgtaaacaccaggaagaggaggaatgatggtcagctctactggacttagctcttggtaggcacatatctcgggcattaacacattcctctcattattgggtcttaaaacatttatgggccatgtgaataatatataactggaaatgctgtgattggtaatgttctattattacaggaaaatagtataacttaattatactttaagttctaggttaaaggtgcacaacgtgcgggtttgttacatatgtatacatgtgccatgttggtgttccagaagagcaaatacaagacaaactattaaggaagcaaatgttccaggaatgttaggcgagctaagagaataaaaactcactaatagtacactcttagaagtatcaaatatatacaatcgtgggtaacagtatatcattcataactgtttaaattaaagcacaaagatgcaaaaatagctagatatttccttcctttccttccttgctttcttccttccttccttctttcattcaattcattcattcattcaaccatcagtccatccatcatagatccatccaccatgtatttatccaccaatccatctatccatcccacataactactgcctatgcactatttgctaggtcctgtgctggtgatacaaagtaatactgcacagggcctaaactaaaaacgaaaacaaaaaaataaacctacagtctaagagtagggtcagggaatactttaaaatataactggccgggcacagtggctcacgcctgtaattccagcactttaggaggctgagatgggcaaatcatttgaggtcagcagtttgagaccagcctgggcaacatggtgaaaccctgtctctactaaaaaatacaaaagttagccaggtgtggtggcacgtgcctgtaatcccagttactcggcaggctgaggcaggagaatcatttgatcctgggaggcagaggctgcagtgagccgagatcgcgccactgcactccagcctgggcaacagtgcgagacaccatctcaaaaaaaaaaaaaaaaaaaatatatatatatatatatatgtatatatatgtgtgtgtgtctatatatgtatatttatgtgtgtatatatgtatttatatatgtatgtgtgtgtgtgtgtgtatatatataaatatatataaaattgtaagttgagtgagatgagggacatcttccatgtaaaaagtgggctaagaaggaacagataagttcaatagagagtgataagggaacaaagaaacatggcccctaactcagatgagagaaaggggaaaggtcgggatattcccaggggaattgatatcttggctaagtcctaaagaattctgaggcatctattaatcagaaggagtgggaataaccatcccaggtaggaagaataatatgtttaaaagactggagataaagtgctagatcattttatcacaacacatgtggaactgatacaagtacttcagattgttttagacaaatagtgtaaggcaggtggtgatcttaaaaataataattagaatatattatgattgtgggtgagttttatgttccttattaatttttgtctcttccaaaatttatccattaacaaaatcacacccttctatggccaaataattgcaaacatttataaggacttattctgtgtttgaaactattttaaaatctttttttttttaattatactttaagttctagggtacatgtgcacaacgtgcaggtttgttacatatgtatacatgtgccatgttggtgtgctgcacccgataactcatcatttacattacgtatatctcctaatgctttcctttccccctccccccaccccacgacaggccccggtgtgtgatgttccccttcctgtgtccaagtgttctcattgttcaattctcacctatgagtgagaatatgcggtgtttggttttttgtccttgcaacagtttgctgagaatgatggtttccagcttcatgcatgtccctacaaaggacatgaactcatccttttttatggctgcatagtattccatggtgtatatatgccacattttcttaatccagtctatcattgatggacatttgagttggttccaagtctttgctattgtgaatagtgccgcaataaacatacgtgtgcatgtgtctttatagaagcatgatttataatcctttgggtatatacccagtaatggggtggctgggtcaaatggtatttctagttctaaatccttgaggaatcgccacactgtcttccacaatggttgaactaatttacagtctcaccagcagtgtaaaagtgttcctatttctccacatcctctccagcacctgttgtttcctgactttttaatgatggccattctaactggtgtgagatggtatctcattgtgcttttgatttgcatttttctgatggccagtgatgatgagcagtttttcatgtgtctgttggctgcataaatgtcttcttttgagaagtgtctgttcatgtcctttgcccatttgttgatggggttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctaatggtattgcctaggtttccttctagggtctttatggttttaggtctaacatttaagtctttaatccatcttgaattgatttttgtataaggtgtaaggaagggatccagtttcagctttctacatatggctagccaattttcccagcaccatttattaaatagggaatcctatttaatgcagtgcaccagcatggcacatgtatacatatgtaactaacctgcacattgtgcacatgtaccctaaaacttaaagtataataataaaaaaaaaagcagaatcagtagggccatggagaattcttagctaagaattttattatgggcctataatgtctatgacattaatttgatgggattttgctacgtgaatgtacagaatagtaaaacttgggtttcaaaaataaaaaactaaaaaataaataaataaatggggaatcctttccccttttcttgtttttgccaggtttgtcaaagatcagatggttgtagatgtgtggtattatttctgagggctccgttctgttccattggtctagatctctgttttggtaccagtaccatgctgttttggttactgtagccttgtagtatagtttgaagtcaggtagggtgatgcctccagctttgttcttttggcttaggattgacttggcgatgcaggctcttttttggttccataggaactttaaagtagttttttccaattctgtgaagaaaggcattggtagcttgattggggatggcattgaatctataaattaccttgggcagtatggccattttcaggatattgattcttcctatccatgagcatggaatgttcttccatttgtttgtgtcctcttttatttcattgagcagtggtttgtagttctccttgaacaggtccttcatatctcttgtgaactggattcctaggtattttattctctttgaagcaattgtgaatgggagttcactcatgatttggctctgtttgtctgttactggtgtataagaatgcttgtgatttttgcacattgattttgtatcctgagactttgctgaagttgcttatcagcttaaggagatttttggctgagaccatggggttttctaaagataaaatcatctcatctacaaacagggacaatttgacttcctcttttcctaattgaaagccctttatttccttctcctgcctgattgccctggccagaacttccaacactatgttgaataggagtggtgagagagggcatccctgtcttgtgccagttttcaaagggaatgcttccagtttttgcccattcagtatgatattagctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttccatttatacgctggattacatttattgatttgcatatgttgaaccagccttgcatcccagggatgaagcccacttgatcatggtgggtaagctttttgatgtgctgctggattcggtttgccagtattttattgaggagttttgcatcgatgttcatcagggatattggtctaaaattctctttttttgttgtgtctctgccaggctttggtatcaggacgatgctggcctcataaaatgacttagggaggattccctctttttctattgatggcaatagtttcagaaagaatggtaccatctcctctttgtacctctggtagaattcggctgtgaatccatctggtcctggactttttttggttggtaggctattaattattgcctcaatttcagagcctgttatgggtctattcagggattcaacttcttcctggttttgtcttgggagggtgtatgtgtccaggaatttaaccatttcttctagattttctagtttacttgcgtagaggtgtttatagtattctctgatggtagtttgtatttctgtgggatcggtggtgatatcccctttgtcattttttattgcgtctatttgattcttctctcttttcttcttagtcttcctagtggtctatcaattttgttgatcatttcaaaaaaccagctcctggattcattgattttttgaagggttttttgtgtctctatctccttcagttctgctctgatctcagttatttcttgccttctgctagcttctgaatgtgtttgctcttgcttctctagttcttttaattgtgatgttaggttgtcaattttagatctttcctgctttctcttgtggcatttagtgctataaatttccctctacacactgctttaaatgtgtcccagagattctggtatgttgtgtctttgttctcattggtttcaaagaacatctttatttctgccttcatttcgttatgtacccagtagtcattcaggaacaggttgttcagtttccatgtagttgtgtagttttgagtgagtttcttaatcctgagttctagtttgattgcactgtggtctgagagacagtttgtaatgatttctgttcttttacatttgctgaggagtgctttacttccaactatgtggaagtaattttggaataagtgtgatgtggtgctgagaagaatgtatattcttttgatttggggtggagagttctgtagatgtctattaggtctgcttggtgcagagctgagttcaattcctggatatccttgttaactttctgtctcgttgacctttctaatgttgatagtggggtgttaaagtctcccattattattgtgtgggagtctaagtctctttgtagatctctaaggacttgctttatgaatctgggtgctcctgtgttgggtgcatatatctttaggacacttagctcttcttgttgaattgatccctttaccattatgtaatggccttctttttctcttttgatctttgttggtttaaagtctgttttatgagagactaggattgcaagtcctgccttttttttgttttccatttgcttcgtagatcttcctccatccctttattttgagcctatgtgtgtctctgcatgtgagatgggtctcctgaatacagcacactgatgggtcttgactcttaatccaatttgccagtctttgtcttttaattggagcatttagcccatttacatttaaggttaatattgtcatgtgtgaatttgatcctgtcattatgatgttagctggttattttgctcgttagttgatgcagcttcttcctagcctcgatggtctttgtttttgcagtggctggtactagttgttcctttccatgtttagtgcttccttcaggagctcttttagggcaggccttgtggtgacaaaatctctcaacatttgcttgtctgtaaaggattttatttctcctttacttatgaagcttagtttggctggatatgaaattctgggttgaaaattctttcctttaagaatagtgaatatttttccccactctcttctggcttgtagagtttctgccaagagatctgctgttagtctgatgggcttccctttgtgggtaacccgacctttctctttggttgcccttaacattttttccttcattccagctttggtgaatctgacagttacctgtcttggcgttgctcttctcgaggagtatctttgtggcattctctgtatttcctgaatttgaatgttggcctgccttgctaggttggggatgttttcctggataatatcctgaagagtgttttccaacttggttccattatcctcgtcactttcaggtacaccaatcagatgcagatttggtcttttcacatagtctcatatttcttggaggctttgttcatttctttttactcttttttctctaagcttctcttctcgcttcatttcattaatttgatcttgaatcactgataccctttcttccagttgatcgaatcggctactgaagcttgtgcatgcgtcacgtagttcttgcgccatggttttcagctctatcaggtcatttaaggacttctctacactgtttattctacttagccatttatttaatcttttttgaaggtttttagcttctttgtgatgggttcgaacttcttcctttaacttggagaagtttgatcatctgaagcctcctctcaactcgtcaaagtcattctccttccagctttgttccactgctggcgaggagctgcattcctttggagggggagaggtgctctgatttttaggattttcagcttttctgctctgttttttcaccatctttgtggttttatctacctttggtctttgatgatggtgacgtacagatggggttttggtgtggatgtcctttctgtttgttagttttccttctaacagtgaggaccctcagctgcaggtctgttggagtttgctggaggtccactccagatcctgtttgcctgggtatcagcagcggaggctgcagaacagtgaatgttgctgaacagccaatgttgctgcctgatctttcctctggaagcttcatttcagaggggtacccggccatgtgaggtgtcaatctacccctactcaggggtgcctcccagttaggctactcgggggtcagggacccacttgaggaggcagtctgtctgttctcagatctcaaactccattctgggagaaccactactctcttcaaagctgtcagacagggacatttaagtctgcagaggtttctgctgccttttgtttggctatgccctgccccgagaggtggagtctacagagtcaggcaggcctccttgagctgctgtgggctccacccagttcaagcttccaggccgctttgtttacctactcaagcctcagcaatgacaggcgcccattccccatcctcgctgctgccttgcagttcgatctcagattgctgtgctagcaatgagtgaggctccgtgggtgtgggaccctccgagccaggcgcaggatataatctcctggtgtgccgcttgctaagaccattgcaaaagtgcagtattagggtgggagtgacccgattttccaggtgccatctgtcaccccttcccttggctaggaaagggaattccctgaccccttgcgcttcccgggtgaggcaatgcctcaccctggtccggctcacgctcggtgggctgcacccactgtcctgcccccactgtctgataagccccagtgagatgaacgtggtacctcagttggaaatgcagaaatccctcgtcttctgcgtcgctcaggctgggagctgtagactggagctgttcctattcggccatcttggaacttctttctgaaactattctaaaatctttatgtatattaagtgattttatccacttaacagctctatgaggtaggtactattattgctcctattttagggatgaggaatagaggcagagagaggttaaataacataactgaattatacagatagtagcagagcagcatttcctaattggggcatcttactccagaatctctgcttttatgtccactgtgctcctgcaaaccttctaattcaagagcctgttttcatatctttacttctgtaactcacctaaaagttgatccaacaaataatcagggacacagtcaagtattttgggagaagaatgttcatagcagcaaaacttacagtcataaaatattagatagaaaataacctatatgtcctacaatgtagaatgtttaatcatggtatagaccattaggcaagcattagaaattatgatctagaagaaaaataagtaacatgggaaatgctcagtataaaggtcaaagggaaatgcaaagatacaaactgtgatcctagcaatgtgtttgtgtgtgtgttcagaaaggaaatccattagtcagactgagttccaattccaatcttgactctgtcatttattacttttgttaccttggataataatttcatccctctttaccccagttttctcatcagaaaattgggatgagttgttgtaagggttaaaaaattcacacatgtaaaatgcttaaaatactggctggcaagcacttgacagctatcaaaatataggaaactctatttaaaaattagaactgaatagtacacattcagatggtagtttaataagtattctttgtagtctaggatccaatattttatagcttcctccaattatttttcccttttacacttgaaaaaataattgtaagtcgagtgagatgaggggcattttccattgcaagcaaaaagtatttgctttcagaatctactttgtcaaattataagacttactaaacacttaagcaaacactgaagggttatcaaagttttctttttaaccagataccttctcaaggctgtattcctcatattttactttggttgaatactctttaattgtgaggatttaaaactatttagaactgtgttttcatgtcagttaggatcagtaaattgaagaaaattacaaattggcttttgaagagcctaaggccatatatagtttatttctcatccatgttttgaaattatcttaattatattgatttttaaatttcaatttaaaaaatagaagtgagcagtttgaataatagcacccatctattttgcctcaaagttttgtttttcttgtctaattaagagaataattatttttaattgataagtaaaaattgtatatatttatggtgtataacatgtttcaatatatgtacacatcatggaatgtctaaattgagctacttaacatatgcattatttcacatatttatttgtagtgagaacacttaaaatctgtcattaaggaaattcttgaagtcattggagctggtctcaggaataaagctactggttcaggggcgtgtgactttcagtgctctgcccagaatcttcaaagtagaatcaatggcttaagcactttcttaagaaaacgctggaaaatcattgaccaaggaaattaggttattttgctgctcacaccattaagaatctggtttcctggcaggctttcatagtctttctttctctctctctctctctctgtgtgtgtgtgtgtctctctctctctctcaggtctcctatgtaaaagcgattgacatctggatggcggtgtgccttctgtttgtgtttgctgccttactggaatacgcagcggtgaacttcgtctccaggcaacacaaggagttcctgcgcctccgaagaagacagaagaggcagaataaggtatgattgcccctcagttcagacaatgtagagcttgagttggttagctaggcaatgtaattcagaaaacagaagagcacacaataagcaagaagccaaggttaatttttgttctgatttgtcctactacactgacttagtgctcagcttaggcctttaaaattggggaggattgtcagattcagcaaataaaaatacatatcatggagttaaactggaatttcagataacaagaaacaatttttagtataagcacataccaaatattgcatgggacatacttatactaaaaattgtttatctgaaattcggaagtaactgggctccctgtatttatctggcaactctaattggggatatatacttgatttgacaaagttactttaaaatcctggttcttctaaatattgactgtgtgtgtgtgtgtgtgtgtgtgtgtgtgtgtgtgtgtgtgtgtgtgtgtgtgcgcgcgtgcgtgcgtgtacatcactgatctgattgactttttttcatcaattgctctggctttatgtaaattatgccgtacccatgtagattgcaacatgataaatccagtgagactggcctcattatctcaacttaaactttagtgcagaattctaagctttacactgtccagagacttcaggtttgaaatgcatagctcaagatctccagtcctgtggttcccaaacttgcctgcacattagaatcgcctggggatattttaaaaatcccaagccttagacacaccttacaccaactaaacctcaatgttaggaggggcaccagcctctgtatttctgcagctccccaggcaattctggtgtgcagacatgcttggaaagcactgttctggtttataacccaatctcatagaggctatcaaaaggcttgcacctgttttccatttcaaactctgggagagaaacataccctttgatatgaagaatgttacctcctgtaacaatattgcttgagaactaaagttaacattttatgtacagtagagagagaaagatttttcaaaatctgttccagaaaatatttgataaattaatcctgctggtgaagtaatagttatatgctactctgttggaatgaaaacaaaaatatttcacagtccctattaatgctgcaaatacctagatgtaaagctgaatatttgttgtgagacattgcttatattgaggagtttatgtgggtatgagctcactgagttctgactgcatccactgaaaggtttcctgcacatactctgggctggaagagataaatctatcctgttagctgccctgtctcactcttcgctacctctcaggaacattttgtcctgccatagataaggaaaacaagtaaacaagcacaaatatcctctttgctgtacattaccttttaatgttgtgcctttctcaattttctcctcactgcctccctgttggtgctaacgtttctttaatcacattcacagaagtccagcacacagcagcaaaagttcaggatcacttgtgccacctagaaaatattcttacattacgatggtatttcaacacaaaacagtacagagttaaaagaattcatgctgcaactgtctattggtcagtggatggtttaagtccttcaacaacttcttttacatatggtaatactgctcaggtttcccaaacttaccttatcataatgagactcacctaggacccttgtgaaacatactaattctcagcaaaattcctttcagatgttgatttataaagttgggtggaatacaagaatctgtacccttaataagcactctaggtgattattatgatgagataaatttaagaaacactatcctggcttactgactgcatactctcctagaccaaagatggaaaatgggtttcattttgcttcccaattctaaatagttgttagggaatttttgaaatgctgtgtgaaggattcttagactgtacctgggctctgtgggaatgagatctgtcatcaattagcaatgtctggcattacataataacagatattaaagactaatttttaaaaaagtataactagcaaacaaggggggttggatatggaataataaacagacaaaatcaatctaaagcaccagcatggcacatgtatacatatgtaactaacctgcacattgtgcacatgtaccctaaaacttaaagtataataacaaaaaaaaaaaagaaagagggaatgcagaaccagacagacaaagagaaagcaaatagagaagtggtagattaaacccaaatatattataaatgcagtaaagaaaaatagaataaatacctctattaaaagacaaacattttcagatgaaatttaaaaataaaactcaactttagtcagcctccaataggcacacctataatataaagatagagaaagcttcaaagtaactgtggataaagatatctcatgcaaacactaaccaaataaagccagtttagctccattaatattagataaagtagactttaagaccaaaattattactagaaatagagatatttcataatcaaaatgatcacttcaatagggggatgtgattactatagatatgtctacaacgaataacatggcctcagaatacaccaagtttaaattgacagatataaagaagaaatagacaaactcacactcatagtgaggaattgtaatatacctctcagcaactgatagaaaaaaagcagacagaaagatcagtaaggatataaaacatttaacaacataattaacaaactacaccctcaaatgcagtaaacatatacttttcaagtcagaagaaacattttggtatatttatcatgagttggactataacgcacctcataacaaatatcaaaacactgaaataatattatctgagtaaatagaattaggctaaaaatcaatggtacaaagataactagaacatctctataaattgggaaataaccaaatacttctgaaataattcaggaatcaaaaagaattcacattggaagttagaaaatattttgaattgaaagataaattgtacatatcaaaatatatgaactgagctaaagccatgcttagtgaaaaatgtatacttcaaatgcatattttataaagatggaaagctgaaaactgattatctaagaatctatttcatggagacaaaatgaagaataagatattaaatccaaagagtgtagaaggagtgaaaaactatgaaaaaaaacacaaagagcaaaaattaataaaataaaagaatggtccattaagtttactgattatcttgtcatgaatgttttcaaatcagcatttgggaagaaccagattgcagtagtttaaggtaggtgaggatatggaaaaagcaagtatagattacttgaaaatttagctctcaaagggagagagggtaaaacaaatttctgcacaatctcactccctgtcatcattagactactcacaggttaaatatatatattcattcaaaagatgtttattgagcacctactatgcttaaacatggaaagctgtgaatatagtagagaatgagagggacaaagaagtagaaaatgaggttgaaaaataggtaatttcaagatttatttgcaagccagtataaaggattttattttattctaagtgattggaatccactagttagtttcaatatagcaaataggctattgagtggatagttgtggtgtcaagagtagcagcagataagttaggaggctattgtagaactataggtggaaatgttgatggcttagattatggtattggtcatgagaatgaaggaaagtggttaggttcaggattctttcatttgttccacaaaaatttatttacttcttactatgtgccaggcactgtgtaaatccttagaatacgttgcttcacaggacagaaaaaaatgcagccttttgatgaaacttacattctagtggttatgctttggaggtaaaaccaataggtcatgctgatgcattttatgtgaagagatgagaagatgaattgaatatgactcacagatttttggcttaagcaactgggtaagtagtgttaccatttattaagatggggactattgtgacaagcgcagatttggagtggaacttgagtcacatttttatgctcttaagttcagatgcccatgagacatctcgatagagttggcaagtaattagatagaaatatatgttcaagaaagggataaaatctggaaatgtatatttggcagtgaccagcaaacagatactgttttaaatccacaaaactaagtgagattacacattgagataacagaaacaaaaaaaaaagctctgagaatggagcattccatcatttagaaagcctatctagagtggattgggcagaaaaaggaacaaaggaaatggtgacaaaccttagatatcacttgcaattgcctttactgtgcaggggaacatagaagatggtatggaataaaatgtgtgctcatggggggatatattttttccaaaatggaagataaaagaatgcatttggcaaaggaaaagggaggtattcacattgcagtgaaaggagggcataatttcaagaacaaatgtcttaagaaggtgagaaaaaataaaattcaaagcaaagggtcagggttggcattacatggagacaactatttcacccattttaataatgacttaaattattgccagttcatagatggagatactgaagcacaaagaggttaaatagcttgctcattctcatgagccaagaagtggtgtagtgggtctgaagtgagatactgtgttcccagagtctgtgtgcttcaccattgtacaaacaaaatgggagaatgactatggttgctagccaattggtatgtccaattatgataggatgtaggagctcctaactaatagctcctatcatgtccatgaattctgaggctatcagctaagagtatggtggaaaaaagaaacataggtttgaggaagaaggatcaagtattaaatagtagtttgggagggtaaaaaagccattcctccaagaagagtaatggggcagaatgctgaggcagaggcagtgggagtgcccatatgagaactgtggttatgactttaaagtgtgaacaatcaggaggtatgtgtttccccccagcaagcttccaggatcagattcaggtactgagataacaggtacttcggtttaactacaattgaagttttgccaaatgagcaggaaagtgagtggaagacaaagagaagacaatagaggagttgaaagaagagaatgtagaagggaagaaggaaggaagaaagaaaccaagaaaggagaagaagggagggagagtgggagggagggagaatgggatggagggagagtgcgagggagggagggagggagggacggaagtgaagttaagggaggttgcatggcagtagttgcagtgatgaaccagaaattctaaggtggatagagaggggaaaacacggaagagacactgtattcaagagagagaaagagagagactcaaaattaagatttcacaggaagtaaagacaaagataaggttatgatcataaataagcatgtgtgactaaggttgggttgagaaaaaattattgacagcaaggcagtccaggaattggaaggccgaggatggggtctattatccatatgaatattgaagatcccccaataaagatgacattagtatgagtgttgggttgacagggaaatggatgctaaagtcatcaactaataaaggagtacaactaataaagggtaacagcacagataggtaacagcagtgataaggaaaatcagtagtgaagtctaatgacctgagcttcagagacgccaaaggatctgggtttgaggaaggaggaaaaagatatggtttgggcattgcagtggggagcaaaaaggataccttagattaaaagatgttttagagatgccagttggcagttacaatccctgctatgtttattgagaaatgcaagtttgcatgtttgacatggagatgttcttaagtttgtgtatggctattcagaacataatgttttattaccaaagttaagtcttggggggagttgaagagcaaatcaaatcatgcttaagctttgtggtcaagtttcctaattatcaccgatggttgaattttgaaaaaataggcaagaaatatttccaattatttgtcccttaggaaaggcagcatttttcagctttttaaaaaagtctgaaccatggttagaaaaaaaaaaatgataacaagagctaacatttattgagggcttactatatgccaggtactcttctagatactttacatatagtaattcatttaatcaccactacaactgtgtgagtaatgcaatcatacagcccagtttacctgggaaagtcttgatttaggcctatttttccaataccttgtgtgatttagaatttgtcctggattactcattttaaacaaaatgttttttattaatagttgcattaaaataagtggaaacgggtttggttgacctccactttatagacctggattctgtcatagggtgatcctccggtataggggtatgcatgtgcagtgaacgagttctcaccttaacacatggtgaaatcgaaaaaataataataatcactactatccaggcatcttttcttcatatgttccagatgcagtgtcataactaacactccctttccaggatagcttgcgggaggggagcttgcttataaaatgaagtgcaattggacaccagaggctggggacagatgttgctctctatcagtgatgggtcactgctgcccctactggtcacttgggataccagccttgttctatggcatggcatggcatggcatgcaaaatccatgaagccaccgggctatcacttcatagggtcagtgggaaacatggaaaatcacaggttctgtacacataaaaaggaaagaaaaactgagcagtcttgctgttgagcatctgaatgctcataattgagtgatttttttcatttttgtatgatataaatccgttttaactacgttttattgtttgataaaacttttttttactttgcaattgtcaacattatagagttgtaatgtctgtcagtgccacttgccactatcaaaattgtccttgtttggattaaattgagtaaattaactaataacaatgaagatactgttcttatctcaatttacagatgaggaaactaatgcaaaaagaaaatagggtgaggcaaggtgaagcaaatagggtgaggcaagtgagtcacacaagtacagggtcagatcctgttttattttttatttaatgttttgttcaccatggattttttgtattaataatgatattttcaaacattgcattaaatatcatttgagtactggagttttgggtaccccctcagattttgcccctgaggcctcacttgttttcccctagtttggggcccacctagtcatgaactactaaattaattttcacagaaatgcattgtggcctgagttaatttttttttaattatttaaaaatgttcaatattttggccgggagcggtggctcacacttgtaatcccagcactttgggaggccgaggtgggtggatcacctgagggcaagagtttgagaccagcctggccaacatgtgaaaccctgtctctactaaaaatacaaaaatcagccaggcatggtggcatgcacctgtggtcccaggaactcatgaggctgaggcaggagaatcacttgaacccgggaggtggagattgcagtgagctgagatcacgccactgtactccagcctgggcgacagagtgagactctatctatctcaaaaaaaaaaaaaaaaaaaaaaaaaaaagtaaatattcccaaggcaatatgtcatctctttaatttcctactgagaaactgacctctgaaataacatacaggttgatattttagaaggtataacaaaaaacaagagcagatcatctcccaaaaagacaatggcattaagctttattcagggaaggtatttattgagagaacacctgagattacatttacatgcatgggaagagtgtctggtatttactgagcaatcaagttatcaaatggggtcactttcaaggagtggccgggcaatgtgcaactaggtgtatttgctttgattatcttttctaggttttgtaaagcagccactgtcaattttatcaaaacagagtttctcagaaacaatcacgcccagatcttccctgacagaactggccaaccccagtctattagaagctgatgccccaggtctatgcaataaaactctgttttaatgttatcgcctctgctccaataagaaatatgtgcaccatgtgaagttataacaacttctctacaatgcagcctcacctgcatttatctcccactttcattttatatctggctgcaccatgccttacttctggcattgtacctaatttcaaatgtttccagttacccagatagccctgacttctttttgttcagctactaaatagaaattgtggctgcttgagaacatggttatggcatgtgggccacctaatgacaagttgccttttacttatttttcttctattttgtttttaattgacacataatagttgtatatatttatggggtacaatgtgaggttttaaggttttatacattgtattatgatcaaatcaggataattactgtatcaatcatatgaaacacttatttcttcaccaaatcatctcttctagatattttgaaatatacaatacattatcattaacgattttcacccaactgtgcaatagaagaccagaacttattcctcctatctaactgtaacatagtacccactgactaacttctcctcatctctccctccccctcattttctctaggcactgataaccactattatactgtctacccccatgagatcaaattttttagattccacatatgagtgagatcacgtcctttgcagggacatggatggagctgcagggcattatcctcagcaaactaatgtaagaacagaaaaccaaataccactcattctcacttctaagtgggagctaatgatgagaacgcagggacacatagaggggaacaacacacactggggtcttttggagggtggagggtggaaggacagagaggatcaggtaaaactaatgggtactaggcttaagacctggggtgatgaaataatctgtacaataatctgtacaacagacccccagttacagacatgaccctcagtgtgggataggtgaaatgtgagagatggaggtagcgatgtccatgaggcagtccagcactcaggagagaggactgggttggacagacatgctgagaagtcattaggatatagatggaggttaaagctatggaagtggataagattacccagcaggagtgtacagagtgagaagagaagtggaggagaaaggttgagaaagagcaggaaggggcagggacggagcaggaagagggaatggaaggggaaggcagtgtaagggaaggcagtgtaaggcaaggcagagggctgagggcaaactcctgtgagcaccagcatatcagagacaggcagggggaaaggagcccatgagagagacagagaaggtcagacggctatgtaatcactcagaggctagaaaaagaaacatattcaggaagaaaattcatagtatctaaagatgtggagttcacataaaataaaagctaagaagcagccatggattttaggaagtcagaggacattggtaacctcaacaacagcaggctcagtggagagacggaggcagacacaagattttaggcagtgtagtagtgaagtggacagtgaggaagtgaggacattgaatgcagccattttatccaagaaaaagaggcagaagtggctgaggaggcatataggccatggatttttttgttggttggttggttcttttgctttttatttagtgttttttttaatgagcaacttgagtacatttaaatgctgatgagagagttgtttatagagagaataatattacttacaggagttttgaggaaaggtgggagagcatacttaggtggagccactagccatacccagtagaaggtattccttctgataactgggagacaaaagaaggaataagaataaggacatggcaagtttgtgggtgggtgggtaggcggacaggattttgaaggaatccccacatgatggcatctgattgttttctgtgacacaggaaacacattcattttcagagaataaagagggaggtgacagagtaggaggtgtgagaacagtgggaaaactttgaaatgtttgtgaattgcgaaatacatcaccaggaacccacagaagttttctcaagcaggcttagggtccatcggacgtaggggaaattggatatgtaggggcatcaatgtgctggattcggtgaggttctccagaggagctcagcagcctagaataaccagatggtgggttccacaattgatccaggcaggactgactgaaataaaaatgggcaacccctggttcaaaaacaattaagaatttcaagatggcaacagcagagcattaaactaagcctagcacccctctgtgtatggaccctgtgtgtctgcacaggttgcatgcccgtgaagccaatcttggatccaagctgagggttttgccagacaggatggatgaatggataaaaatatgaatcacgtgatggtccaagcagggtagagaaagggggatactgtaaagaagagatgagaatgaaaggagaatattttacacataagtgaaataaatgtaagcaataaaatgtggcagttagcccacttatttattctttatttgcaataaaacagttaactctagcttttaatttcaatgattctttatatttctatagttaccaaatttagttgaagttctagttttgcacagaccttcttaagggagttttgctttacagattttttgaagggagttcaatgtttaaatgagaaagaaaacttgtatcaactagtgtcctttttgtgttgttttgtttactggggtagacaggctcagacaaatatttcagtgcagaatgttgtgtgctgtgggaaaggtttaagtgcatgatttaaagtgatgactgaggacaaagcatcttctccacttggtagtgccagggagttgagcctttgtctgggtcttgacacaggagtagaaatttgccaggtcaaaaggaaaattaagaggatatccaggctgaggaaacggttatgcagaggttcagatgttagaaacgacatgatgctttcactacatcataaaaagttgagtcaggaaagtgctaaagcatggggcctaaaaggaaggaagacttcagttgctcttgaactgggagccaccaaaaggctttataaatgatagaatgctacaatcagattggaactgtggaaacatcactctatatagaaaggatcagattggaataaggcacaagatcaggaaaatgctgcttcagcatttcaacttaaaaacacccttaattttataagtagtctacacttccctgaagcccctccctagaggcatagatcattattactattttggtttgcctttttgtaattttgctagaactagctttccaaatctgggatgtatattataaacttaccaaagcttgtcttaagtgtgaatataaaagtggctttctggtttgaattctttgcagtaacacaggtgtcttatcattgctgtaacaaatcactacaaacttaatggcttaaaacaggaaaaacttattatctacacttctgtaggtccaaaatgggcctcactaggttaaaatcaaggtattggcaggactgcattgcttctggagggttgtcacgggggttcaagggattgggggccatatcaaagaaaaagatatgaccacgcaggcagtaatacacaacaaagtttattgggtggcacttggacagggttgcgtgaaaaggtggctcctcacagcatgaaatgatccagaggcttagagacaggggccaccatacagagaggagaggacaaggggactcccagtggggaggtgaatcagagggggctcacttgtctaggtgatgttgctcagctgcacagtgggggagcctctgggtcagagagcttcaaagagcagcagtgccatgggaccttataagtgcaaggaccagcagatgctaggcatggtttcgtgggctatgcaaagcagtcagggtctagatggctaaaaatctgcttgtttaggctatttttaaaataatggaatgtgtaaaatttgagtttggtgccagcaagctttggagataacaggtctcaacctatagtggggaaataaacaaccaaggggacaatactcagaggccatctttggctcatttatataacagtgttctaggggagaatctgatttcttgacttttccaacttctagagctacttacattccttggctcatagtcccctttctccaaaggggaaagttgttcaaagccataacattgcatttctctgacccttcttccattgccatgtgtacctctgaccacagttgagaaaggttctccatttctaagagtcatgtgattaagttgtgagcacgtagatcatctagggccctctccccatccttagtttcttaatcacatctgcaaagcccctctgctttgtaggataacatattcacaggttccaaggattaggacacagacatctttggtaggcattatcctgcctgccacaaacagcaatggtttccactgcaactctgagagcatccgttgggcactgtagcatgctccatgcacactcaggacagtccagaagtaccaggaggtgaatgctacaggagtggccctcaaccaatgagaactgggagttggtggccaaataccaagcttcctcaacccttggtaagtcaagtctcagtctctcagaggtttgagccccatttggcaaccatggtcacctgctgattattcacacatcctttattgacttttctcctttccttgtcctacacttccccactccctcaccacactcctgttgttgcctcccaagtaaacctcttgcatgcaatccctcatctcagggttgctttggagagaacaaaaacaaactaaggtgcaatgcctcctaggccaaggacctcatgagaatcacaacccactgaaccccatcctcggcctccccactaaacaccagattctggaggactttttgtgcctaaagtgtggaaacagagggaatctaggagcagcaagtgtcaaacaatggtttattgtaccttacagttggcattgctaaaatatttctgtgctgctgagcttctaaaataggtttcataacacaattctattgctttatgtccctgaaatcaagcctgtgccttcagctctactagtgtttcataaaggctatgatggcagataccttgaaccttcttctttcactatctagctcttaattggtgtaagattctttttttccactttaaaatccagatcctgcacaatggtttaagattcttgatggcaacttgagctgtagttatttcagcataactggactctcataaaaagatcgagctaaatgacagaaaagtctggtgcttccttggcattacatcagagatgtgggtttgcctaatcatagtagtaatttgtctctatcactgttattcttgtttttaacaagctgatttggggacaatatgcttaaatggagttatttcccacctgattgatgaggcagcatcagacgcgagtataaccgtttataaaataaatgaccttggctctgtgcaggagtgggtaaaaggaaacgacccctgccttcttagttttcattctaagctgctagacaatcctagatttcatttcttcaacaaatagtttttgaatgcttgccttgtacagtgttttgttttagataaggggcagataaaaaaaactgcttgaaacctgttttcacaaaattttagaggtcaatatcagaaaaaaagtacaaaaatgttctaatatgaggtagagaattttaagaaccataagagagttatagttggagctgtggcaattcccaggaagggagagtatagtgtacttccagctcttaaggagggaggagattctcaagaaagaagcagcatttgtaaagttcattttatcttagaatgttaactgtaagttattctaaactcatcttgttattgtcagtaaatgaaacagagattaaataattaaataggtaatgaaaactacattctttaaggtggcatttaatgctcattagaaagtagccttatcctgccttgctgatacacatttacatcagatgaacctggagagcttcccactccaagaccttcaagaggaaagtgagagtcagtgacacggaagctttgtttgatctaaggcagtggttctcagccaggagctatttttccccaccccaggggacatttggcaatgtatggaggcgtttttagttctcacaacttggggttggggactgtgtgtgttgctgaactctaatgagtagagaccaaggatgctgctaaacatcctacagtgcacaggatggtgcccatagcaaagaatcatctgacccgaatatggatagtgtcaagtttgaaaaaccctaatctaagggacagaagcatgctgtgcacacagaggactgaggtttagcttcatgagtgcaagctgcttatgaataaagatgtcactcctgtcaggagtaattaattagagctagtataacccagttgacaaaatagtcagaaaaacctttcattaagaatttcctcttttgtaagtgaactcttttactctacataaagttctttttatttacatcatatagcaaatcagggatccaaaatatggttctttgtactggtaatgaacaggggcatgaattttgttgggtgtatgatttaattgcttttcaaaatgttgacatgttgacatgggtgtaaaaacatcaggaggttaagttattaaatgcctccacttcattccactctatctgctgctgctaggatttgttcaagagcaacagaagtcataccagaaatgagctctggtattttctagaaacaaggtaacccattacagcatggttctcaatcctggttacacactagagacacctgggagctttttaaaatctaaatgcccagaccccacctcagaccattaaatcagaatatttaggtgtagagcccagacatcttggttttataaggcttcccaggtggttgcaatgtgaagccaagtttgagaaccttgcttctttaaatgtcatctgttgaccagcagcatcagcatcacctacagcttgctagaaatgcagcctctcaggccctaccccagacgtgtggaatcaaaaataacaggattctcaggagattcactagcacattaaagcttgagaagtgctgctctagaatatatcgcagagagtccacttttaaattgtatgcatgttgcaatatgcacagtctaaaacaaggcatactattactattaagacatggtaaaaagctccaaagctttaaatagaattattttcacttggtaagaaatattaagtttattactgtggctgcttgtgttttgcactaaattttatttttaattgtgaaagatttcaatcatatagagtaatttaaccctatgttgcttgttgttttgtttctctcaagaagagtaatcactaagtagcctaggattatcattctggtattaggagccaaatgggaaccccatgaaagaccttttcctataactgagaaggttccttctcagctctgtgttcacatacacaaggaggaaatgatctgaaatggcatgtaacaggatccatgatagagtgaggagcttcacctttgttaacaagattgaacagtgcacacatgcattgtagtaaaacaataattctaaatagtcatacaacttcattctggaaagcacaaaatgcttcaaattatggtagtttggcagtgatatctccacagggagtttataaggtttgctgaatgtcgtacagccaattcctgactgccagacctgagacgccttaattcaacacagaatcattgaatgttctttcacacttcctgtcttttagggcagattgattaaaataaaacttacaaaaatacctgtcttaaagtcagccttcttcatcccagccaagtaccctatcctgtcaatatgtttcattacagcaccatttcctggaattactgccattgaattcccgtcctcttaataacatatactttttctctccaaaacatgcaaaaaagaatatgagagagaagcatgacatagtgacacatgcttagggccaggagtccagctggctgaatctaaatcctggctggtgctttatttgctgggtgattagagtcatggcctaaccactctgggtctcagtttcttcatctgtagaaagagtctaataaagtcctttctcatgggctgctgttaggagcaagcaagattatgcacgtgaagaacagtgccttgcatacagccaatacttatgaagtatttcctttctcttcctttcgcctgctttttgacatgagaatattgcatgatacagagtttggagcatgaatcccttcaccctggtagtgagcttagaacctgataggtagttttttaacccaccccccaccctccaccctctaaaaaaaccaaaaaacaacaacaaagaaaatatcatggtatatcctgctttgtaaaagtaaatactactttgtgaaacttttgttgccattagatatattaatgtgtgtggaagtgtgtgtatgtgtgtcctggttagtaatggaaaatatgttttcctactttgacagcaaaaaaggtgtgtgtgtgtgtgtgcacgcgcgcgtgttgcatgcactgttagatgacagtctttattttttttctagctttaaggtataattgacaattagaaatcatatatatttaaggtatacgacttgatgatttgatatatgtatacactgtgaaataatcaccatgattaaactaattaacatgtccatcatctcacattgttaccagtttcttttttttccttcctttctaccttctttccttccctccctccttctttctttcatgagaacactaaagatctacccccttagcaaatttcaagtatacaatacagtattgttaactatagtcacattgttgtacattagatctccagagcttattcatctcacagaactgaaactttgtatcccttgaccaacatcttcccctttcccctcactctatctcttggcaaccaccattctactctctgcttctgtgagtttgattattttagattccacatataagtgagaacctgcagtatttcacagcaaaaagttttgaaggccagtgctctcagggtggatcaggccaggtaaacaaattcacctgaccatctcaggcttaaaccttctcacataccctcaagaggcagtcacagacacagtaggaggggtcatttggttgccatgatgacagggacaggaggtatatgttgcactaactatattgcacctcactaaaacttgctaagccctcgcttttgtttgaccagcccacactcacacgccacctgagtattatgatgcccatgacccagtgggctcatcactccgtgacctgccttcagagttcaagctgtgtcatcctcagctggacacaacatctgcccaattatacagcacacagctgggagaaaagagagacatcaggccaggcgcggtggctcacgtctgtaatcccagcactttgggaggccgaggtgggcggatggcctggggtcaggagtttgagaccagcctgaccaacatggagaaaccccgtctctactaaaaatacaaaattagccgggcacggtggctcatgcctgtaatcccagctactcgggaagctgaggcaggagaatcacttgaacctgggaggcggaggttgcggtgagccgagatcgcgccattgcactctagtctgggcaacaagagagaaactccgtctccacacaaaaagaaaaaaaaaagagagagagacagcaactcaggagttaagtccattttctatgaaaatatatcgtcttagaaccatatcaggttttcctttttgcctctgattataactattgtattgacatctttgaaaacgaaagggagagctgggcccagtggtgcatgcctgtaatccctgctacttgagtggctgagatgggaggatcacgtaggccagcagttcaaggctgcagtgagctatgatcacggcactgcactgcagcccggacaacagagcaagaccctgtctctttaaaaaggagtagggaagggctacagaccccccatcatgtgccaaatactgtgttacataccttcatgcacactttcttaactagaaactcagctggtcaacaattagatcaacagatactggcattattttcccatagtgaccaatctgtcttctgtgtttacttcaatcaatcttccctctgggcctacagacaagttttctctctgaaatattaaatctggtaaccgtaataatgaagcagagaaaagaggaactcttggaaatgcactacagatactccaccaaacaaactctcattttatccataattttccatttttttccagcaagagttgcgtataagaagctataagcgacagtgaacaaacaaatggttgcagggaaagcataagggagctaggacagagatgatctgcaaagctaaatcaatcataagccagaataatggagcatagactgtgtttctggttcactctgctgctttgatctgcagtccaatgctctacctctgagctataccccctccttactctgctgctttgaatgtccttgagagaagcaataggaaagtgcctcctgatggtttacagtgttcacctgcttcggtaactgctaattttaaaccagaacctacagtccatattcattaaagaagagctagcttaccaacatcattcaaattcaggagataagattggccagagaaagcaggtttatagtttttcacctggagaaacacatttgttctgcagctgtggaaagcaatgacatgatggcccatagatgtctctctcctcaggacatgcctcactgcccctctgctagaaacctcctaacacttctccaagtcacacctgggcgatttcatcatgaacctaacctgtctcttctaagttggcaggaagacatcgagggccagaccaaatatagatctgatcctagtgattgagttctcagttcttgagtttactgagccccctgcagaaacaaacaactcaccaaacttccactgcaaacagcattgactttcatccctctgagctacttccagcagaaattgagcagtaagagggaagaggggaaagaaagcagtggctatctggaaggttgatatcattgcttgaagcctctaggctatcaaaacaatataataaagacaggcctctgtgaacaccatgtgtcagcctctaaaaggacatacattcattatttacataatgtgaggtaacatgttactatatcaggagttttcttattctatattctatattttatatattctatattagagtcatcttcaaaattataacagcagcaaagggacttgttgcctaattaaaacccttaaaaatgatgaaataaaatattatgtacgtcaaagataattgaaagaggaaaatatgcctgaactgaactgttgttacggttgattatattagaacagggtttctcaaaactggactagaaacttctgagagattatggagggccatagcaggacatagcttatcaaatacatctttcctgaacttgggtcagcaccttcaatgtggtttaccctcttagacttcttaacttagcagtttttacacacagagactccataaatagaagagatataaattttcacctagtcccctaacccattcaacatttccaacaaatggctgaatacttgactatttctagcaatggtgagttcattaccttccaaggtggtatgttccatgttcagtcacagagttgttaaaagttcatcctcatatagagttgaattctgtctccctgtaatatcaaccaacagtctctgattagtttccttggagccattaatacaaatatgagtgaactcaaaagagcccttcattcttttgaaaatacttgtcatatcagccaggcttatctcttctcaaggccagccttttgttgttccttctattcttgttccttttatgcttcctcatgtgttgtcactttcaggaacattcaccaccctgggagggttcccttgcccccaaacttattctcaatctgtcctgtttgtatctcataatcctacccctttttctatccagtgacccagggacaactgtttataaattggaatatcaatgagattctctctttcaagaattcaaacagaggttctgatacgctaattagatgacagtgaggacttgagttgaacagtttcacatagagctgaggcggtgtgggcctgattggaacatgaatgattatgggaacctggtaagagaagagcagaaattggagagagcatgagccctgagaaattgagaacactctcacttcctgacttgctcattggagctcctgggctagatagccctgtgtataccatcatgctaacatttattgagcatacactatataccaggcatgtaaacttttaatgtacatttccctgaatcttctcaaaaaaccctctaaggaaggagatatcatctctattttactacaaaagagactgaggcacgtagtaagtgacttacccagttcccacaatggttagtggcagagccaagatttgaaaccagagttttcgctccagagcccaggcttctcacctttacagggcattgcttccctatccttggaaacttatgagattatcttacaataattttcttataataattccttaaagacagttccatttatttaagctactatgagtgagtttctgtcctttgtaacaaatcttccgcgattaagatgccagatggttaaaagataccaactaatggccaaatggcagaggcagtgcattttgtcatgttattatagaaaaaaatgccatctagctttccttcaattgccttggcataacattaccttttccatagtatctggtggtctgttcctttgccagagcagatatcacattatattatagtcatttgtctgtatcagggtttcccaaccttagcactgttgagatttgatgctagataattcatgctttgtggtgggggctgtcttgtgcattgcaggatgttcagcagtatcctggcctctatccactagatgccagtaaaacaccctctcccagttgtgacaaccaaaatgtctccagacattgccaaatatcccctagggggcaaaaatgaccctagttgagaatcactcgtctacatgttctagatcctctccactaatcgcacactgacttcaagtgcaggattttgtcttctttatccttgtttctgtccaacgcttggtacattaagataatcactcttaattgaaaaaaaaaaaactatagttgcttgcattaaagtggcgttttgtagttaaaagtctggagtaactgtacacctgtatccatctgggtatagtcatgaagacaaagacattaaaagtagtaccaaaatcaagggtttaatatagaaattaggctttatatgaatgtgggggagtaactgggggggttaaggtctaaaaggcaatagtcaaaggatgggacttaacatgaagttctgagtagaaaaccaagtgttcacagaaaaatctgagaagtcaccaggtctaggcaccaaagtaagatcataaagtgggagtccacagaaaggtctagccaccgtgtctaacaaagcagcctcttctgaccccaatgattcccaaaagtaatagcctctgcttcctttctgctttccagatcttccaagtttctcttactgaaaaatcctaacctgcaaccaatccagaagagaattctgggaaatatagttcttcccagccttaggcagatgcctaaggagtggtggtgccagataaacaacagataatcccatacaataaccactttggcaccaagtgtgtggatatatatagagagagaagttgaagcacgataaagatctagagaatttggcagtcagaatcatccaagttagtaaacaagcaaatgcttgatgtgatttgtcactgatgctgttattattgttttgagtttagtagtgggttcatcccctaatcacctgacccctccagtctcaacattcaccttgcaccctgaacagatggcaaatgatattaataatcaaacagctcatactccagatggaagatgttcaccttcatgcttcttagaattttgtgtgtcttttgagcactctagctagagcagaattgacagaaactgctgtgaaagaatttccatatgcaaggcattgcttctcttatgaggaattgaaatatcacagccatattatccatttctaaactactctctaaggctacagatgacattaaataaaaacatttctgcttgatagattttgaacagaaagccaaacaactatttttaaacaattacttctagtccatttaaaatgtggtgctgtaggtgaggtatgatccaaagaagagtgaaaaatatatttcactatagaaaattctattcaaaatatacattgaaaagacaaagacttcagagtttgcatggcccacaaagcctaaaatgttgactatctagccctttacagaaaatgtttgctgactcctgggctagagggagaacagcaggagttaaggtctgagaggtaaaggggatgttacaaggacttatgaggagaaccactggagagttttgagctgaagatgacctgatttgactggaaatttaacagaatccatttatttgctatgttgaaaatagacactattgttgggaggacaggtctagaagccagcagaccatgtagatgactactgcaataattctggtgggaattatcctgatgagccaccaaggggtggctcagaccagcatgtagtgttggagatggcaagaagttattaggttctggtttgaagcttgaactgattctatttcctggtttgaagcttgaactgattctatttcctgatactagatatattgcatagccccacataggtgtaggggaggctagaatattcagactttccacgtacacatttatgaccagccaaaacaggggttctcaagtagggttgatttactcatccaggagacacttggcaatgtcttgagacatttttggtgtcacagttcaggggcggggtgctactggcatctagtgggtaaaggccatgtaggctgctaaacatcctgaaatgcaaagctcagttcccaagaacaaataattatctagccccaagtatcaatattcctgcaggtaagcaaccttgaactaaagaaagatccaccattatgagaagaaataaagaatgggttttggtggtaactaggagttgtatagcccaactcaactccctatgccgccaccccagccatttacaggctgtggcaacatcagttccaagatttctgctcataccacaactgagttctgtttgttctcccctgcccatacattttccccactactgggggtgaagtctgtcatgaataagaggccctactggcatttttaaatgcatgaggcttgtaaaaataacatgtgtgatcaaggcaatgaaggtgatgttgtataatgatagctaaatagtacaaagcaccacagtgcaggtattaatttgttttaagagatttatgaagagaatattccattaattagaattttaagacttaaaaacggatgtttggtaattactatagatttacagggattttgctttccttgctaaacccaaatgaatagaatatgagttcaaataccctaatgttatacaaatactccttagtcttttgctatgggtgttaactgataagatcgaaatttatttggtaaaatatttgaatatatctaatatgtattgacttttaactagctttattattttgaattgtaaacacatacataaatgaaaaaaagtctttatattctaaaatttttgtctattccatttgttttccttgcaaataagtatgcactttcttttaagattcttaacagggtgaatctaattttcacactatgtggctgctcacgagcttaatacttggccaaaaaaatggacggtgtttcaaaaatagaaaacctcagttattgagtgacattgttaagcttaggtttgccctaattttatataaatccagtatgcaaaaataagccatatggtaaataagcaaggaaatgacttttcaagttacaaaatacttttttcatattaccattcacttaagcctttactttatacatatatgcattcaatgtaggaagattcagccaagtattattctaggcactggggatatcaaaatatgtcagaacgggcccctgcacttgaaagttacatgaaagaggcagacacgtaaatagttgaatttaatatgatgcagtagattccattatggagacatgtactacaggaggtaaggaggaacccatggctcaggatcaggggtcaagaaaaggcattctgaatagaataatggcagagtagaatcttaaaagacttgaaggagtttaccaggtaaaaagaggtgaggattattctatataaagggaagcagtttatagtcaaaggtcatgtaatcctatgagagaagtaggtgtaaggcaggacatgggggtccttgaatgtcacacaaaggagcttgggagtggtcattaaggagatgagaaactgttgaaaagtattaagtcttgaaatggaagcaatggtccaacggcatctattccactaaagtagaaggcagggatagctccataatctgcgtagcacagtgcaaaattaaaatgtaggtcccttgtttaaaaattattatgaatgtcaacatggctatagcagagcattaagccaagcacaggacccttctaagcactgggcactgtgtgactgtatagtatgcatactcacgaagctgaccctgtcagaaggtctcagggccggggttgaaagaagacaataaaacccttatttgcatgtgtctactccctggttgggaagaaaaatcttaaatatatcaaccagctagagattagtctcaaggcaacatactagccagcattatagtcctatacccacaaattcagaaaatggccaaatgtcctatctcttcattttaaagatgaggaaattgaagaacaaaaaaaaattgagggactgtcccaacctcacacatctaggttatagtaaagatgtgaattcaaccaaagcctttcagattctagcccagtgatttcctctgttcctctgcaatatccagtctatttaaagtgagtagaagaggatggaagtcctttgagggaagagattgatccagaggctgcagaaaggactacaattggtaaagagagagttatctgccaggagacaactgctgtcctctcccttcccccagggagcacgacttttctgtgtccttacttagaattaagaggatcactacaaacacaattattgagtaatgattaggaaccaggcaatgtactctagagaatagggctacagagttaattttgacatgctcccaggagctcacccctctggtgagcaaagataatagtgaaaatcagctatcaaaacccagagtccttgggcatctatcctttaatatgaatgggaagcaatattaaagaaaataataaaaagaaaaatggaaattaatacctaaaaccaataggtaactagaaagtctttttcagaataggagaatcatggatgatttgcacatcgccttgtatgtctcagcagtgttaccatcagtaccttcaccaactctggagacttcaggctaaactgaaccccaataaacctttgtacatatctcaaaaatatgcctcctattatactctatttcgttatttatgcccccttcaaaaaaagcaacaacaaatctgacgtgtccaaagtttagaagtatatcttaattatgtgcttccagagccaagtccagtgcctgccctataataggagcttctttattcaacattactgccgatggtcaataaattgaatggattgacagatgaggtcagtgtaactgggggcaccctccaagtggagggcctgggtacagagagaagctttcagtgcatcaaggtgagagaagcagggtcagccacatccaagagatacttctgccatttcactcttcttttatccttctgccaatttcttcacttaagaaagtaaaaaaaaaaaaaaaagtagatatcaagtcctttacctaggcttaattcttatatatactcctacacacagttttacctctcattgatcattttaaattgaaataattaaactaccttataggacacgggctcacttttctaaccaggtcaggttttgattgcattcattcacaatctttacctgtgcataagcctgctctaatatttatttgtagagatcatctttctttcttaagtttattttgtcatagagttgtatatagttatgagtacattcaactctgtggaatgcagatattatagaaaaggttaagtataaatcactttatatggagtacatcatgaattagatgagcttggatttactagcaactggaagatccttctgtaaagtaaaaaaaaaaaaaaaaacccatcggtcaataaacaaggatttatcaagaattttttgagcacgcattagattactcagttatgaatccaatttcaaagaaatcatccactgatttattgcttttatatggttcagatacttattttgaaaggaagcacacttgtgtttggttttataccagaggagagataggctgatgagtaaatgtgattctctgaaatggtacccctgagaatgtcgtcgggtacgacattggtttcctgctaatgtatcattactgagatgaagtcaagatgtttatttttcaagcagaagttacattctctatcaatatgacattacattatagtgctgctagttcttcagggatatgattgattcctatagtagggtggatataggagccttaggcagtgatgctgtatctcaagtgactaagataagatacaggcagctcactgcacagagagccactagccagtttacctagcatgacttacagagcagttttcaccaacactgtacttagactggcatttttagtcctacttttaaatttgaaaagccaaccagtggtcaatcaggaacacattcaatcccatatatttgtaatatttatcttactttatggcaggaattctaggtttagataactagctattgaaagtgtaatatttggcacaacgatgactcaaatagcctgttccagttactgtgctgaataaaccacttcaaacttattggcacaaaacaaccatcttactatgctcaggaatttgtaaaaggcagagtaggaatgacttgtctctactacatgatgtctgacatattagctcagacgattcaaagacacatgattatttgacagctaggagtcagtcatctgtagacttgtttgtccacatgtctggtgcctaggctaggaaaactctaagactaagactgctcatcagagtgcctacacatagtctttccatgtggcttgacttcctcacagcatggcagcctcagggtagttggattttttatatggtgtcccaagactccaggcccaagtgcaccagtgaacatggcaaggctgcattgccttttatgaactaacattggaagtcatacagtgtcatcttcactgcattctattacttacaagcaaacataagcctgcccagattcaaagggaggggacatagacccctaactctcagtaggaagagcttcaaagtcacaatgaagaaaccatgtgaatgggacatattgttgtggccatctttgacaaatacattttgccacagtccaccctcttcgcacaacaattcacatccctcccacgtgcaaaatatgctcactcccttttccaagaccaccaatattaaatgcacacctacaggaatagtaaaatagaaagctgttttttgttattggtgttttattttattttctgggtaaggggaaataattaatgacctataaaagacttcaatgggtgaaacattgattacaggtattgaactaaaatgtagctcaacctgaagaataggagaagacactttcaaactcttcatccaataagggatcaatatcaaaaatatacaaggagctcaaacaactcaacagcaaaaaatccaaataatccaatttaaaaatggaaaaagtatctgaatagacatttctcaaaagaagacatacaaatgaccaacaggtatatgaaagaatgctgaacatcactagtcatcagagaaaagcaaatcaaaatcacaatgagatatcatctcaccccagttagaatagctattatcaaaaagacaaaaaataacaaatgctagcaaaaatacagaagaaagggaactcttatatactgttggtgggaatgtacattaatacagccattatggaaaacagtatagctcaaaaggctaaaaatagaaataccatataatccagcaatcccaatactggctctatatccaaaggaaaggaaaacagtatgttaaagagatatctgcactcccatatttactgcagcactatttacaaaagacaagacataaaatcaacatacatatccatcaacagataaatggataaagaaaatgtagtgttcatacataatggagtactattcagtcttaaaaaaatcaaatcctgtcattaatagtatggatgagtctggaggacattatgttaagggaaataagtcaggcagaaaaagagaaatactacaatttctcatttttgggagctgaaaaagtagatctcatagaggtagagggtagaatagtggttactagaggaagagaagggtagaaaggagtgaggaatagggacagtttgattaacagatacagaagtacagctacataagaagaacaagtttcagtattctatagcactacagtaaacaataatttattgtatttttttcaaagagctagaagagaggattttgaatgttatcaacacaacacagtgattaagttttgaggtgatttatatactaattaacttgatttgatcattacacattgtacacgtgtattgaaataccacccttacctcataaacatgtacaattatgtgtccattaaaatatatttaaaaatttaaatgtagctcaaaactcaggatctcatcatgtaagtcaaatgaagcatctcaggttaagcattttggatacagttaaaaatgaaaacctgggaactaaagagacaaggtatctgctccacttactcaacagacaatatggagacatacagaggataactgttatagactcttccattcaaaaatagggggaacaagaggcacacagcagtcactagttaacaggaattctgagacctagaaaggtccatgttggaagatccttgtttgggggatatattccttggttgtcctctctagtttttgggtctgctctctggactcttattctgctatttgaaacatctttctttttctataagaaggggcacttgtttgccactgagtaacctttttagtctatttattgtctttaaaagattaggagtctaaagacctcctttcattttatactatctttgttgttttcagtccaaacatacaattccttaaaaactgttgggggcagggctgggcatgttggctcatgcctgtcattccagcattttaggagaccaagatgggaggattgcttgagtccaggagtttgggaccagcctggacaatatagtgagacccccacctctacaaaaaaattagccagacatggtggcacatgacccgtccaccttgggaggctaaggcaggaggatcacttgagtctgggtagtcgaggctgcagtgagctgtgatcatggcactgcacttccagccttggtgacagagtgtgaccctgtctcaaaaaaaaaaaaaaaaaaatactgttggggtttatatataaatttataatccacttcattagacaaaagctatactcacaaatattttcaagataaaccctgttttagttaggaggattacgttttagagatgtattgcatagcatggtgactatagttaataataatgtacatttcaaaattgctaaaagaatagattttaagtgttctcaccacaaaaaatgattagtatgtgaagtaatggatatgttaattaccttgagttaatcattccacaacaaaacactacattatactccataaatatatacaattattatttatcaattataagcccttgttatcttaggctccctgtgagtatgctgtgtggcccaacacccttaatattcgtagaagcttattgtttagaggagacaatctgtaaggcatgttcttatgatccttataagacctattgcctgtctgaaagagcttatcaggtactgctttagatatttctcaggttttaacaaagaatcgtacagtcccaccctgtatatgattttttcccctgaggcctgttctgatttgaggacccttcgcaggctgaaaagacttattctggatcctttacatttcctccaacttctacttggacacttaatggcctgttcttcagttctttgtcctctctcagtttggtatcagcagctaaaagccaagcagcatcctcagtgctctatctggaaatctccttaggtagatgatgaggtttattaagtatattttctattttccatgttaccacaggaaacaatgttggtaaacttttccccatcctccagctttccacagcaattgcctttctttcctcccagtcttccaacaacctccttgagggccttccagcttctgcctgctgcctggtcccaaagataatgccacaacatttcagtttttgatacagcatcaattatctgtgtagctatctattactgcataataaatcatccaacatcttagtggcttaaaacgataacaagcagttcattatctctcacactttctgtgtgttaagaatttgggaagatctcagctaggcagttgtggttcggggtctctcctcttggtgcagtcagacagtaactggggctggaacagctgggagttgggcaggcatcattctttcttcatgtactcacagggcttttccatgtgatttctccacatgggctactttgagttcttcatagcatggtggtctcagggcagtcagacagttgacatggtggctcatggttccaagcacaccaggattggagcttcatcactttttatgacctagacttagaagttacttagtgtcacttccaccaaattctgttgattaggagcaagtcacaagcccacttagactcaagtggaggggatacagaccccatgtctcaatggaaagagtgtcaatgataatactgttaagaaaaaagcatatgggatgggagatattgttgtggctatctttggcaaacacaatataatacagtctgtgacttctatatgacatatggaagcatgcagaggagaaagaagtgggaactgcttctcttctctttgccttgccaacatgccactatgctatccacagaccagtttgagagggccctgcagaatgagtgtaggggatcccaccagctgacctaaaccatggctactccataaagcttcctttggaatacttagctgacatgcagaatgatacttataatttcattttatcctcagcatcagagcaaagatttattctgaatccaaaattatttacaagtattgccttatctgggtaaaacttgaaaagtatttaaaagaataattttaactgtattggctaatggctgattttagcataagtcaccttcagtattttttgtcttgcaaacagtttggggttgaaaagaaagactgccagtcatgcattaaaatataaccaagtgtatgcctccagctgagatctctctgagttacagactgtccattgcaatcaatcacctaccccatgtatctattcgaatgtctcaagtgcacctcaatcgtattattttccccaaacttaatgtgatcctcttttggtgtcttctttctcattgaatggcattaatatccatctagtggtttaagctggaggttaaccttgacaatttccaatccatctctaagacctgttgattgcccctctatgtctctagttggcacattgctctctacctataccaccacccattaaatccaaatcattatcatctctcatctggaccattgctgtagctttgtaacttcttggattcacttttgcgttcctctaggcagtcatccacatggcaaccaaagtgatttatttcaatatgctgatctggttatgtcatgcaatctccattaaaagccagttatggctccccttggttctcaaaataaagcttcatcagacactggtttacagggccctatatgatgtagcccctggttcatttctgaaacattgtctcactccacactccccctgtattccaggcctcagttgcatccctcaattgcagcaaaccctcctatctcagacattgccaaaccctgccttcacctctttaatgcctctcattttttaaatctctaatgaaatatcacttcctaggggaaaagcttctcttatctgtcagattagaccaggaccccatttagtaagctctcatagcatcttataattttccttcagagcccttatcatagttagtaattatgtattcatgtgattactttattgtttcccttcatctcaaggttgcaaactccttgaaggcaagaatcaaatctattttgctctccactggatccccggcacatagcacagtgcctggcatctctgcaagccttttccaaccactcaatctaaaacactcccttctatgccacttgcctaagtctcttaccttaactgtttatttttttccaaagcacccatcattatctgtgtgtgtcttgtgtgtatatgcattcgtatatgtatatgtgtgtatatgtataaatatgtttgtgtgtgtgtataatttgtttacttgttactgtttccccctctagaatgtaaattccaaaaaatcagagacttttgtattcttgttcattgctgtaactctaccacgtacctggcacataataggtactcaataaatatttgttaaaaatgtgagaaataagccaggcatggtggctcacacctgtaatcccagcactttgggaggccgaagcgggtgcatcaccggaagtcaggagtttgagaccagcctggccaaaatggtaaaaccccgtctctactaaaaatacaaaaattagctggacatggtggtgggcacctgtaatcccagctactcgggaggctgaagcaggagaatcacttgaacccaggaggcagaggttgcagtgagatgagatcacaccactgcactccaacctgggtgacaaaagcaaaactctgtctcaaaaaaaaaaaaaaaaaaaaaaaaaacaagaagaagaatggcagttgctcaataaataaatcctggaagtttcttctttaaaaatcaatgataaaaatatgctgcactgagaaagagataatacattgacatgtttttcttttggaaaaattgcctttcacaatctgcccaaaatgacactttgacagttttaattcatttcagcacatgtcattaagcaacaaggggctatatttggtttagtttatttcaactttgttgttctgcaaagctcagtcagattcttcattcataatcttgaatggaagccatttgggatttgataatggaagccatttgggatttgataggggcaaaaacgtacacaaatcaaacccagagactttggaatcagttttagaatcagacagacctggatttgaatctcagcttcaacatttattagcactataactataggaagccacataacttttcttggcctcagtttccccaagaaatatgtgacttgaaagatcaattcagtaacaggactgaccatggttttaagtgaatggtacagactcttaataaatgctatccatttattattcatgtctattcccaaagtacccatgatacaaaggaggaaattgaagccttaacagttgaagaaaatttcccaaggccattcctcttatatccaggtctgtgattaagcatcattcaaccatcatttgcttgggagattttttcagtgaaaacccactgtatttggacacatattgcttcctaagacagactggagagtccattatgtccttgcattgagtgagactcactacaaccttcagttccaactgagaaatttcctgtcccaacagaaaggaggctcagtccaataaaaaaatctgggtgagaaatgcgatggaaagatttttaggagtccttttacttcctcctttctcaagaataaaagaaaaattacaaatatagactctgctaaaatcttttcatctgtaagtgccatgttctttaattatattgaaatcatttgcttatgacaaacaattcactacaatgcaactccagtgagctttaggtcaatttcccatctagacaagaattattctaaacacaggaatgagcaaattttacaataagtaaaactgatgcataaaatacataaaattagataataaatttcaagcaaattgcacagtgccatggcagtgctttatacagcagacgggattaaggagatcttatcaaagtgcgatataaaaattgcatgtgttgaaaccttgactggatgattcattttctgtgagaatttaactaatcagtgaataacaaaagagggtcagctagaagtgcttattgctcagttactaaagatggaagatgatggataattaattgagtttctggctaatcagaagaaatggagaatatatgcctaaaattaattatttccttactggaaggacctaactgagtctacctgtaaatatgctcaactcagctgtggctacagattgttctttattttagtttcagtttatccatgactcaagctcatttcatataggaatcttgtcatattaccataacattttattctgaacctgctagaaaggcaattagtcatttattataacacaaaaaaattcaaattggttgcagttatgttttcagaatcaaaaccatctcctttgatgtgaataccataaagttctatatttaaaaggcattgaatgcatcataatggtaaataagaagacccttaaactagcattcatacctcctgcacataaaaccttaaatggataatttttactcacaacaggtttatttttgtggcagagaattttaaagaattgattaaattagctataactatgctcagaagcataatttgaaatagtgttgaatgaatgaggaaagtattttcaagcatagggaaaaccctcttaaaattcccttttgttcattattcagcaaacatttattaagcccccacagtttgcatgacgatgtacaatataatgagattctaacctgacatccttctattctagctctgttaattgaatgagttaatctttttagctgtccattcacagtatgtgatgaaagactatagaaattaaatgaatgagtcaatctgaaaagacacgtggacatgtatatttaagtttccttttgtgtgctaaaaatagtttactacctacataccctttctatttctttaggggcttcagaatttaaaagaacattatcttactgaggcggtgaactatatgcttaatcatgagtttctaaaggtttatagaggtgagagctgtaatttgcaagattctgcagatacgcaaaggaaaaaaacagcacagtaaatttgagcagataaggagaaaggtattttgaggggttgtttctatttcaatagtaactttagacttaaaaatatagaataggttgtacattttagagatggacatcggaactcatctagaccagtggtttccaacattttacattagagtcactggatctttaaaaaaaatagaccctaagttctcatccccagagactggtctagaaagggctgggaggggaggcaggcatacatgtatttgtaaaagttccccagcagccagagctgaaacccacagatcccagctcagccttgacattattggcatgaggtccctgaggctttgaaagaataagtagcttgcctaaggtcaacacagcttataagccttggagcaggcacagaacagaaatatccaaattcccagagcggatctctctttactaaaccaactggcatcatttctacttcacactggttgagatctaattaccaattagtagtagttgggaagtccaagactgcctataacaagtcccctcctcctaatgacctgtatgtgcttccttttcttgctaagcactgagtaagtcttcagatagttatgaggacactgatgacactgtaataattaatatatccagttattccacattttgaaaggcttcacttatttaaaacttttgcatccataaaatattcatatttttaaggcaaagaaaacaggtttaatatttgaatctgagtcccactttaagtcttcattatcgagtttatataactgagcacatggaagtactccgatgttaggctggattttgtttgctgacttccttatatgataatacctttagtttggccccttccaccagattctgaaagttccatgcagatagagcccttgtccaacttcatcaattgtctcccagcacctagtacaatgcttgtcacagaggcaacactcaacaattaatggttgaattaaaaatcctttattatattttgttaagaaatgagacagagtgcctttagccaacttgtgtaggataatcccatataaataaaagtatggaaagatggctttataaagtagtagttttatagttactttttaaagacctttggtctgatttttgtgatataatggtctgattaaaggttacaactaggccgaggcaggaaaatcacgtgagcccaggagttcaagaccagccttagcaacatagtgggaccccgtctctacaaaaagttaaacaaaaaattagctgggcatggtggctcatacctgtagtcccagctactcaggggtctgaggcgggaggatcacttgagcccaggaggttgagactgcagtgagccgtgatcatgccagttcaccccagcctgggcaacagagtgagactgtctcaaaaaataataataataaaggttataattaattttttattggaagcactaggtgcagtcattaataaaacctactaatgtatcaagcaaatgaggtttctgttttcccacctgattttcctagagatcaaatttacatggcgaaggatgacatggaatatttggcaattattcacacttgctatctctccagctcaaattccaagtcattgccaggttgcaatggaatgttcagccatgtttagggctggcttcaccagagatactgtatcacaatgggcaatgtcgataaatcaaaagcctcaaggactgcgttgaactcttcttcattttcaggctgcatgtatctcccacaaagggaggtggcacctgggtactacactaatttagctaaatgagccacatagaagcaaatctgttctgccttgcaggttctgcagcttcccctctgagcacgtatactataatctaatctacctattctgaagtccttgcaccactctttaaactgttacctgctctttcactccccattttgcacatgatcaagtgtaattaactgaaatagttcttctcaccttccttacctctccagggatctgctgttgaacttacaaaactcatttaagtacacaaggtacaaattgtccttgttgtaccatttgagttttacttaggctgtcattcatattataagtccttcatttagtataccttttatatgtggatgaagacactactgacattcagtaagcattaatgaaataaagttaataccaagtttccttgtcttttgggaaacataaccattattattatctggcaagataaagagtttagtgcctctggtgactcagaggagttgcatgttattgtggaaggcagtaatctagttacagaagaagataattcaattgatggctgtttacagttaagtcatttcaatcccagcttttcaaccccaccttttcaaccccaccgtttgaccccctcctttgacccaaacacatacccagatcccatacatttttctctaaggctatttgtcctttacaccaaggaataaatacaatttttcagacttttatctaatttatgtagaaataatcatacaaatatcactgacatcagctaaaatgacacatttaaatatggtagaaatgattcaccagccaaataatcaatgttaaaaatcaacactggaaaaattaaattattaatgaatatttaatctctgctatataaatgagatgaactagagggctggagggggaacaggtatatatataaggggctcaccttagatgtaacatcaacattaaacctaatgttaatgggggaattgcgctgtgaatgaaccacaatactataggttccttagggccaggcacacagcacaggctcagtaaatgttttctgaatgaatgaatgaatgaatgaatggtcctcttcatagacttacagtgtaacactgggatttggagaactgctttaaaatctctattcatatctagggattaataaactagattttgggaaagtcagtactgaatataatgtaggtgtttctgtttgttaattaattaaaatgaccacagtcattattcttacccttaatttctcagtctgaaaagttaatcaactgtatctgttccatgaataattgagttgaacttgaaagagaactcgctattccaaaagcctcccacaccaccagttaactgtgatttatccttttacttctaaagaattttaagcatcttccatctaacttgactgacaaccaatctgtgcttcctctgtctttattccgtcaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgaca
